US007868149B2

(12) United States Patent
Boukharov et al.

(10) Patent No.: US 7,868,149 B2
(45) Date of Patent: Jan. 11, 2011

(54) PLANT GENOME SEQUENCE AND USES THEREOF

(75) Inventors: Andrey A. Boukharov, Chesterfield, MO (US); Yongwei Cao, Lexington, MA (US); David K. Kovalic, University City, MO (US); Jingdong Liu, Ballwin, MO (US); James McIninch, Burlington, MA (US); Wei Wu, St. Louis, MO (US)

(73) Assignee: Monsanto Technology LLC, St. Louis, MO (US)

( * ) Notice: Subject to any disclaimer, the term of this patent is extended or adjusted under 35 U.S.C. 154(b) by 37 days.

(21) Appl. No.: 11/491,125

(22) Filed: Jul. 24, 2006

(65) Prior Publication Data
US 2007/0039076 A1 Feb. 15, 2007

Related U.S. Application Data

(63) Continuation of application No. 09/620,392, filed on Jul. 19, 2000, now abandoned.

(60) Provisional application No. 60/144,351, filed on Jul. 20, 1999, provisional application No. 60/163,469, filed on Nov. 1, 1999.

(51) Int. Cl.
C07H 21/04 (2006.01)
C12Q 1/08 (2006.01)
(52) U.S. Cl. .................... 536/23.1; 435/6; 536/23.2
(58) Field of Classification Search .................. None
See application file for complete search history.

(56) References Cited

U.S. PATENT DOCUMENTS

| | | | |
|---|---|---|---|
| 4,784,949 A | 11/1988 | Gelfand et al. | |
| 4,956,282 A | 9/1990 | Goodman et al. | |
| 5,011,912 A | 4/1991 | Hopp et al. | |
| 6,093,545 A | 7/2000 | Goodearl et al. | |

FOREIGN PATENT DOCUMENTS

WO  WO 00/18922  4/2000

OTHER PUBLICATIONS

"Revision History for BAF30287," printed from <http://www.ncbi.nlm.nih.gov/entrez/sutils/girevhist.cgi?val=BAF30287&log$=seqview> on Mar. 1, 2009.*
Database sequence GenBank U93559, printed on May 28, 2009 from http://www.ncbi.nlm.nih.gov/nuccore/1935917.*
Jeong et al. Korean J. Biolo. Sc. vol. 1, pp. 135-142, 1997.*
U.S. Appl. No. 09/815,254, filed Mar. 23, 2001, Boukharov et al.
U.S. Appl. No. 10/425,114, filed Mar. 28, 2003, Liu et al.
U.S. Appl. No. 11/329,175, filed Jan. 11, 2006, CaJacob et al.
U.S. Appl. No. 11/329,160, filed Jan. 11, 2006, Bhat et al.
U.S. Appl. No. 11/329,388, filed Jan. 11, 2006, Andersen et al.
U.S. Appl. No. 11/330,082, filed Jan. 12, 2006, Buehler et al.
U.S. Appl. No. 11/330,083, filed Jan. 12, 2006, Byrum et al.
U.S. Appl. No. 11/330,364, filed Jan. 12, 2006, Abad et al.
U.S. Appl. No. 11/331,019, filed Jan. 13, 2006, Fincher et al.
U.S. Appl. No. 11/331,032, filed Jan. 13, 2006, Fincher et al.
U.S. Appl. No. 11/352,295, filed Feb. 13, 2006, Andersen et al.
U.S. Appl. No. 11/353,150, filed Feb. 14, 2006, Andersen et al.
U.S. Appl. No. 11/486,299, filed Jul. 14, 2006, Byrum.
U.S. Appl. No. 11/490,207, filed Jul. 21, 2006, Brown et al.
U.S. Appl. No. 11/491,178, filed Jul. 24, 2006, Hinkle et al.
U.S. Appl. No. 11/491,371, filed Jul. 24, 2006, Byrum.
U.S. Appl. No. 11/497,489, filed Aug. 2, 2006, Byrum et al.
U.S. Appl. No. 11/503,243, filed Aug. 14, 2006, Kovalic et al.
U.S. Appl. No. 11/520,715, filed Sep. 14, 2006, Liu et al..
U.S. Appl. No. 11/521,349, filed Sep. 15, 2006, Byrum et al.
U.S. Appl. No. 11/595,983, filed Nov. 13, 2006, Boukharov et al.
AA501409, EST Database (Aug. 19, 1997).
Aach et al., "*ent*-Kaurene Biosynthesis in a Cell-Free System From Wheat (*Triticum aestivum* L.) Seedlings and the Localisation of *ent*-Kaurene Synthetase in Plastids of Three Species", *Planta* 197(2), 333-342 (1995).
Adams et al., "Complementary DNA Sequencing: Expressed Sequence Tags and Human Genome Project", *Science* 252(5013), 1651-1656 (1991).
Ait-Ali et al., "The *LS* Locus of Pea Encodes the Gibberellin Biosynthesis Enzyme *ent*-Kaurene Synthase A", *Plant J.* 11(3), 443-454 (1997).
Anaviev et al., "Oat-Maize Chromosome Addition Lines: A New System for Mapping the Maize Genome", *Proc. Natl. Acad. Sci. USA* 94, 3524-3529 (1997).
Anton et al., "Sequencing and Overexpression of the *Escherichia coli aroE* Gene Encoding Shikimate Dehydrogenase", *Biochem. J.* 249, 319-326 (1988).
Attwood, "The Babel of Bioinoformatics", *Science* 290(5491), 471-473 (2000).
Bentley, "The Shikimate Pathway—A Metabolic Tree with Many Branches," *Critical Rev. Biochem. Mol. Biol.* 25(5), 307-384 (1990).
Birkenbihl et al., "Cosmid-Derived Map of *E.coli* Strain BHE2600 in Comparison to the Map of Strain W3110", *Nucleic Acids Res.* 17(13), 5057-5069 (1989).
Bishop et al., "The Tomato *Dwarf* Gene Isolated by Heterologous Transposon Tagging Encodes the First Member of a New Cytochrome P450 Family", *Plant Cell* 8, 959-969 (1996).

(Continued)

*Primary Examiner*—Shubo (Joe) Zhou
(74) *Attorney, Agent, or Firm*—Matthew L. Madsen; Ying-Horng Liu; Arnold & Porter LLP

(57) ABSTRACT

The present invention is in the field of plant biochemistry and genetics. More specifically the invention relates to nucleic acid molecules from plant cells, in particular, genomic DNA sequences from rice plants and nucleic acid molecules that contain markers, in particular, single nucleotide polymorphism (SNP) and repetitive element markers. In addition, the present invention provides nucleic acid molecules having regulatory elements or encoding proteins or fragments thereof. The invention also relates to proteins and fragments of proteins so encoded and antibodies capable of binding the proteins. The invention also relates to methods of using the nucleic acid molecules, markers, repetitive elements and fragments of repetitive elements, regulatory elements, proteins and fragments of proteins, and antibodies, for example for genome mapping, gene identification and analysis, plant breeding, preparation of constructs for use in plant gene expression, and transgenic plants.

20 Claims, No Drawings

OTHER PUBLICATIONS

Bonner et al., "Cloning of cDNA Encoding the Bifunctional Dehydroquinase-Shikimate Dehydrogenease of Aromatic-Amino-Acid Biosynthesis in *Nicotiana tabacum*", *Biochem J.* 362, 11-14 (1994).
Bork, "Powers and Pitfalls in Sequence Analysis: The 70% Hurdle", *Genome Res.*, 10, 398-400 (2000).
Bougri et al., "Members of a Low-Copy Number Gene Family Encoding Glutamyl-tRNA Reductase are Differentially Expressed in Barley," *Plant J.* 9(6), 867-878 (1996).
Broun et al., "Catalytic Plasticity of Fatty Acid Modification Enzymes Underlying Chemical Diversity of Plant Lipids", *Science* 282, 1315-1317 (1998).
Bukanov et al., "Ordered Cosmid Library and High-Resolution Physical-Genetic Aap of *Helicobacter pylori* Strain NCTC11638", *Mol. Microbiol.* 11(3), 509-523 (1994).
Charles et al., "Isolation, Characterization and Nucleotide Sequences of the *aroC* Genes encoding Chorismate Synthase from *Salmonella typhi* and *Escherichia coli*", *J. Gen. Microbiol.* 136, 353-358 (1990).
Chen et al., "Microcolinearity in *sh2*-Homologous Regions of the Maize, Rice, and Sorghum Genomes", *Proc. Natl. Acad. Sci. USA* 94, 3431-3435 (1997).
Coulson et al., "Toward a Physical Map of the Genome of the Nematode *Caenorhabditis elegans*", *Proc. Natl. Acad. Sci. USA* 83, 7821-7825 (1986).
Day et al., "Cloning of the cDNA for Glutamyl-tRNA Synthetase from *Arabidopsis thaliana*", *Biochim. Biophys. Acta* 1399(2-3):219-224 (1998).
Duncan et al., "The Overexpression and Complete Amino Acid Sequence of *Escherichia coli* 3-Dehydroquinase", *Biochem. J.* 238, 475-483 (1986).
Eberhard et al., "Cloning and Expression in Yeast of a Higher Plant Chorismate Mutase", *FEBS Lett.* 334(2), 233-236 (1993).
Ebert et al., "Identification of an Essential Upstream Element in the Nopaline Synthase Promoter by Stable and Transient Assays", *Proc. Natl. Acad. Sci. USA* 84(16), 5745-5749 (1987).
Efstratiadis et al., "Enzymatic in Vitro Synthesis of Globin Genes", *Cell* 7, 279-288 (1976).
Eiglmeier et al., "Use of an Ordered Cosmid Library to Deduce the Genomic Organization of *Mycobacterium leprae*", *Mol. Microbiol.* 7(2), 197-206 (1993).
Evans et al., "Immunodetection of Recombinant Proteins Based on Antibodies Directed Against a Metal Binding Peptide Engineered for Purification by Immobilized Metal Affinity Chromatography," *J. Immunol. Meth.* 156(2), 231-238 (1992) (Abstract Only).
Entrez Accession No. M21071 J03227 (Sep. 15, 1989).
Entrez Accession No. 170374 (Sep. 15, 1989).
Entrez Accession No. M27715 (Jun. 15, 1990).
Entrez Accession No. 153878 (Jun. 15, 1990).
Entrez Accession No. X59509 S55160 (Jun. 30, 1993).
Entrez Accession No. 48906 (Jun. 30, 1993).
Entrez Accession No. Y00710 (Sep. 12, 1993).
Entrez Accession No. 40978 (Sep. 12, 1993).
Entrez Accession No. Z26519 (Dec. 2, 1993).
Entrez Accession No. 429153 (Dec. 2, 1993).
Entrez Accession No. 551666 (Jan. 25, 1995).
Entrez Accession No. X81413 (Jan. 25, 1995).
Entrez Accession No. M87280 M99707 (Apr. 12, 1995).
Entrez Accession No. 551855 (Apr. 12, 1995).
Entrez Accession No. 313150 (Jun. 13, 1995).
Entrez Accession No. X73535 (Jun. 13, 1995).
Entrez Accession No. X04306 (Jul. 12, 1995).
Entrez Accession No. 40973 (Jul. 12, 1995).
Entrez Accession No. D63474 D16312 (Jul. 27, 1995).
Entrez Accession No. 474964 (Jul. 27, 1995).
Entrez Accession No. 987267 (Jul. 31, 1995).
Entrez Accession No. U32579 (Sep. 16, 1995).
Entrez Accession No. X82831 (Mar. 1, 1996).
Entrez Accession No. 1213067 (Mar. 1, 1996).
Entrez Accession No. 1220402 (Mar. 5, 1996).
Entrez Accession No. M63245 (Mar. 11, 1996).
Entrez Accession No. W49458 (May 28, 1996).
Entrez Accession No. 1421741 (Oct. 17, 1996).
Entrez Accession No. U54770 (Oct. 18, 1996).
Entrez Accession No. X86101 (Nov. 8, 1996).
Entrez Accession No. 520943 (Feb. 26, 1997).
Entrez Accession No. 2160544 (Jun. 5, 1997).
Entrez Accession No. U63652 (Jun. 6, 1997).
Entrez Accession No. 2257714 (Jul. 15, 1997).
Entrez Accession No. U93215 (Jul. 15, 1997).
Entrez Accession No. 2224890 (Jul. 31, 1997).
Entrez Accession No. 2224892 (Jul. 31, 1997).
Entrez Accession No. U61385 (Aug. 1, 1997).
Entrez Accession No. U61386 (Aug. 1, 1997).
Entrez Accession No. 2316104 (Aug. 8, 1997).
Entrez Accession No. AF010169 (Aug. 9, 1997).
Entrez Accession No. 1524045 (Aug. 20, 1997).
Entrez Accession No. X96943 (Aug. 20, 1997).
Entrez Accession No. Y12809 (Dec. 2, 1997).
Entrez Accession No. D88382 (Mar. 17, 1998).
Entrez Accession No. 3068709 (Apr. 2, 1998).
Entrez Accession No. AF058763 (Aug. 16, 1998).
Entrez Accession No. 3420233 (Apr. 20, 1998).
Entrez Accession No. AF049236 (Apr. 22, 1998).
Entrez Accession No. AF038152 (May 7, 1998).
Entrez Accession No. 2708690 (May 7, 1998).
Entrez Accession No. AC003058 (May 16, 1998).
Entrez Accession No. 3135277 (May 16, 1998).
Entrez Accession No. 3288821 (Jul. 20, 1998).
Entrez Accession No. AF063901 (Jul. 21, 1998).
Entrez Accession No. 3435196 (Sep. 21, 1998).
Entrez Accession No. AF067773 (Sep. 22, 1998).
Entrez Accession No. 3694811 (Sep. 24, 1998).
Entrez Accession No. AJ225107 (Oct. 1, 1998).
Entrez Accession No. 3093410 (Oct. 1, 1998).
Entrez Accession No. AF060481 (Oct. 4, 1998).
Entrez Accession No. 3925407 (Nov. 24, 1998).
Entrez Accession No. AF083948 (Nov. 25, 1998).
Entrez Accession No. AB015492 (Dec. 11, 1998).
Entrez Accession No. 4001680 (Dec. 11, 1998).
Entrez Accession No. AF017431 (Jan. 2, 1999).
Entrez Accession No. 3080490 (Jan. 12, 1999).
Entrez Accession No. AL022602 (Jan. 12, 1999).
Entrez Accession No. AB011416 (Feb. 5, 1999).
Entrez Accession No. AAC17095 GI:315616 (Apr. 5, 1999).
Entrez Accession No. AP000836; GI:6539551 (Aug. 12, 2000).
Entrez Accession No. AY013245 (May 7, 2002).
Fiedler et al., "The Formation of Homogentisate in the Biosynthesis of Tocopherol and Plastoquinone in Spinach Chloroplasts", *Planta* 155, 511-515 (1982).
Garbe et al., "The *Mycobacterium tuberculosis* Shikimate Pathway Genes: Evolutionary Relationship Between Biosynthetic and Catabolic 3-Dehydroquinases", *Mol. Gen. Genet.* 228, 385-392 (1991).
Gasser et al., "Structure, Expression, and Evolution of the 5-Enolpyruvylshikimate-3-Phosphate Synthase Genes of Petunia and Tomato", *J. Biol. Chem.* 263, 4280-4289 (1988).
Gaubier et al., "A Chlorophyll Synthetase Gene from *Arabidopsis thaliana*", *Mol. Gen. Genet.* 249, 58-64 (1995).
GenBank Accession No. U03774 (Jun. 22, 1994).
GenBank Accession No. L37750 (Aug. 3, 1995).
GenBank Accession No. H30177 (Aug. 16, 1995).
GenBank Accession No. W21756 (May 6, 1996).
GenBank Accession No. X80265 (Feb. 26, 1997).
GenBank Accession No. E03435 (Sep. 29, 1997).
GenBank Accession No. AF015462 (Jul. 16, 1998).
Genbank Accession No. AC005922 (Nov. 14, 1998).
GenBank Accession No. X74737 (Jan. 21, 1999).
GenBank Accession No. AU033328 (Apr. 28, 1999).
GenBank Accession No. AQ402486 (Mar. 13, 1999).
GenBank Accession No. AI861202 (Jul. 19, 1999).
GenBank Accession No. AC018632 (Dec. 15, 1999).
GenBank Accession No. AI834598 (Feb. 2, 2000).
GenBank Accession No. AZ134591 (Jun. 2, 2000).
GenBank Accession No. BE428765 (Jul. 26, 2000).
GenBank Accession No. BF542512 (Dec. 11, 2000).

GenBank Accession No. AW871780 (Dec. 11, 2001).
GenBank Accession No. BQ603510 (Jun. 24, 2002).
GenBank Accession No. DR37H4T (Nov. 22, 2002).
GenBank Accession No. BX513761 (May 27, 2003).
GenEMBL Accession No. AF096555 (Jul. 22, 1999).
GenEMBL Accession No. AL096768 (Dec. 12, 1999).
GenSeq Accession No. AAZ35275 (Mar. 27, 2000).
Gerhold et al., "It's the genes! EST access to human genome content", *BioEssays* 18(2), 973-981 (1996).
Gibson et al., "The Bacteriochlorophyll Biosynthesis Gene, bchM, of *Rhodobacter sphaeroides* Encodes S-Adenosyl-1-Methionine: Mg Protoporphyrin IX Methyltransferase", *FEBS Lett*. 352, 127-130 (1994).
Goers et al., "The Differential Allosteric Regulation of Two Chorismate-Mutase Isoenzymes of *Nicotiana silvestris*", *Planta* 162, 117-124 (1984).
Goff, "Rice as a Model for Cereal Genomics", *Curr. Opin. Plant Biol*. 2, 86-89 (1999).
Hedden et al., "Gibberellin Biosynthesis: Enzymes, Genes and Their Regulation", *Annu. Rev. Plant Physiol. Plant Mol. Biol*. 48, 431-460 (1997).
Herrmann, "The Shikimate Pathway as an Entry to Aromatic Secondary Metabolism," *Plant Physiol*. 107, 7-12 (1995).
Hong, "A Rapid and Accurate Strategy for Rice Contig Map Construction by Combination of Fingerprinting and Hybridization", *Plant Mol. Biol*. 35,129-133 (1997).
Hundle et al., "Functional Assignment of *Erwinia herbicola* Eho10 Carotenoid Genes Expressed in *Escherichia coli*", *Mol. Gen. Genet*. 245, 406-416 (1994).
Ibba, "Biochemistry and Bioinformatics: When Worlds Collide," *Trends in Biochem. Sci*. 27(2), 64 (2000).
Iyer et al., "*Quod erat demonstrandum*? The Mystery of Experimental Validation of Apparently Erroneous Computational Analysis of Protein Aequences", *Genome Biol*. 2(12), 1-11 (2001).
Johnston et al., "Cloning and Characterization of Potato cDNAs Involved in Tetrapyrrole Biosynthesis: Ferrochelatase (Accession No. AJ005802), Chloroplatic Protoporphyrinogen IX Oxidase (Accession No. AJ225107), and Mitochondrial Protoporphyrinogen IX Oxidase (Accession No. AJ225108)", *Plant Physiol*. 118, 329-331 (1998).
Keon et al., "Isolation and Heterologous Expression of a Gene Encoding 4-Hydroxyphenylpyruvate Dioxygenase from the Wheat Leaf-Spot Pathogen, *Mycosphaerella graminicola*", *FEMS Microbiol. Lett*. 161, 337-343 (1998).
Kidwell et al., "Transposable Elements as Sources of Variation in Animals and Plants", *Proc. Natl. Acad. Sci. USA* 94, 7704-7711 (1997).
Kim et al., "Construction and Characterization of a Human Bacterial Artificial Chromosome Library", *Genomics* 34, 213-218 (1996).
Knott et al., "Randomly Picked Cosmid Clones Overlap the *pyr*B and *ori*C gap in the Physical Map of the *E. coli* Chromosome", *Nucleic Acids Res*. 16, 2601-2612 (1988).
Ko et al, "An 'Equalized cDNA' Library by the Reassociation of Short Double-Stranded cDNAs", *Nucleic Acids Res*. 18(19), 5705-5711 (1990).
Kyrpides et al., "Whole-Genome Sequence Annotation: 'Going Wrong With Confidence'", *Mol. Microbiol*. 32, 886-887 (1999).
Kurata et al., "A 300 Kilobase Interval Genetic Map of Rice Including 883 Expressed Sequences," *Nature Gen*. 8(4), 362-372 (1994).
Lange et al., "Cloning and Expression of a Gibberellin 2β,3β-Hydroxylase cDNA from Pumpkin Endosperm," *Plant Cell* 9(8), 1459-1467 (1997).
Lange "Cloning Gibberellin Dioxygenase Genes from Pumpkin Endosperm by Heterologous Expression of Enzyme Activities in *Escherichia coli*", *Proc. Natl. Acad. Sci. USA* 94(12), 6553-6558 (1997).
Lange et al., "Expression Cloning of a Gibberellin 20-Oxidase, a Multifunctional Enzyme Involved in Gibberellin Biosynthesis", *Proc. Natl. Acad. Sci. USA* 91(18), 8552-8556 (1994).
Liepman et al., "Sequence Analysis of a cDNA Encoding Alanine:Glyoxylate Amino Transferase from *Arabidopsis* (Accession No. AF063901)", *Plant Physiol*. 117, 1125-1127 (1998).

Lim et al., "Porphobilinogen Deaminase is Encoded by a Single Gene in *Arabidopsis thaliana* and Is Targeted to the Chloroplasts," *Plant Mol. Biol*. 26, 863-872 (1994).
Mahairas et al., "Sequence-Tagged Connectors: A Sequence Approach to Mapping and Scanning the Human Genome", *Proc. Natl. Acad. Sci. USA* 96, 9739-9744 (1999).
Martin et al., "MYB Transcription Factors in Plants", *Trends Genet*. 13(2), 67-73 (1997).
Martin et al., "Mendel's Dwarfing Gene: cDNAs from the *Le* Alleles and Function of the Expressed Proteins", *Proc. Natl. Acad. Sci. USA*, 94(16):8907-8911 (1997).
McCombie et al.,"*Caenorhabditis elegans* Expressed Sequence Tags Identify Gene Families and Disease Gene Homologues," *Nature Gen*. 1, 124-131 (1992).
Meinkoth et al., "Hybridization of Nucleic Acids Immobilized on Solid Supports", *Anal. Biochem*. 138, 267-284 (1984).
Mende et al., "The Geranylgeranyl Diphosphate Synthase Gene of *Gibberella fujikuroi*: Isolation and Expression", *Mol. Gen. Genet*. 255(1), 96-105 (1997).
Mohan et al., "Genome Mapping, Molecular Markers and Marker-Assisted Selection Crop Plants", *Mol. Breed*. 3, 87-103 (1997).
Nakane et al., "Nucleotide Sequence of the Shikimate Kinase Gene (*arol*) of *Bacillus subtilis*", *J. Ferment. Bioeng*. 77, 312-314 (1994).
Nakayashiki et al., "Nucleotide Sequence of a cDNA Clone Encoding Glutamyl-tRNA Reductase from Rice (Accession No. AB011416)", *Plant Physiol*. 117, 332 (1998).
NCBI Accession No. S42508 (May 8, 1993).
NCBI Accession No. D23883 (Nov. 29, 1993).
NCBI Accession No. AAA34069, corresponding to gi:535771 (Sep. 11, 1994).
Norris et al., "Complementation of the *Arabidopsis pds 1* Mutation with the Gene Encoding *p*-Hydroxyphenylpuruvate Dioxygenase", *Plant Physiol*. 117, 1317-1323 (1998).
Oka et al., "Replication Origin of the *Escherichia coli* K-12 Chromosome: The Size and Structure of the Minimum DNA Segment Carrying the Information for Autonomous Replication", *Mol. Gen. Genet*. 178(1), 9-20 (1980).
Okubo et al., "Large Scale cDNA Sequencing for Analysis of Quantitative and Qualitative Aspects of Gene Expression", *Nature Gen*. 2, 173-179 (1992).
Phillips et al., "Isolation and Expression of Three Gibberellin 20-Oxidase cDNA Clones from *Arabidopsis*", *Plant Physiol*. 108(3), 1049-1057 (1995).
Porra, "Recent Progress in Porphyrin and Chlorophyll Biosynthesis", *Photochem. Photobiol*. 65(3), 492-516 (1997).
Russell et al., "Structural Features can be Unconserved in Proteins with Similar Folds. An Analysis of Side-Chain to Side-Chain Contacts Secondary Structure and Accessibility", *J. Mol. Biol*. 244, 332-350 (1994).
Sakamoto et al., "An Overview of Gibberellin Metabolism Enzyme Genes and Their Related Mutants in Rice", *Plant Physiol*. 134, 1642-1653 (2004).
Schmitz et al., "The Tomato *Blind* Gene Encodes a MYB Transcription Factor that Controls the Formation of Lateral Meristems", *Proc. Nat. Acad. Sci*. 99(2), 1064-1069 (2002).
Schünmann et al., "Identification of Three cDNA Clones Expressed in the Leaf Extension Zone and with Altered Patterns of Expression in the *Slender* Mutant of Barley: A Tonoplast Intrinsic Protein, a Putative Structural Protein and Protochlorophylide Oxidoreductase," *Plant Mol. Biol*. 31, 529-537 (1996).
Seffernick et al., "Melamine Deaminase and Atrazine Chlorohydrolase: 98 Percent Identical but Functionally Different", *J. Bacteriol*. 183(8), 2405-2410 (2001).
Sigma Chemical Catalogue (Sigma Chemical Co.; P.O. Box 14508, St. Louis MO 63178) 1993, product Nos. 01256, 03628, 04375, pp. 736-737.
Smith et al., "Partial Purification and Characterization of the Gibberellin $A_{20}$ 3β-Hydroxylase from Seeds of *Phaseolus vulgaris*", *Plant Physiol*. 94:1390-1401 (1990).
Smith et al., "The First Step of Gibberellin Biosynthesis in Pumpkin is Catalyzed by at Least Two Copalyl Diphosphate Synthases Encoded by Differentially Regulated Genes", *Plant Physiol*. 118, 1411-1419 (1998).

Stammers et al., "Rapid Purification and Characterization of HIV-1 Reverse Transcriptase and RNaseH Engineered to Incorporate a C-terminal Tripeptide α-Tubulin Epitope", *FEBS Lett.* 283(2), 298-302 (1991).

Tanaka et al., "The Third Member of the *hemA* gene Family Encoding Glutamyl-tRNA Reductase is Primarily Expressed in Roots in *Hordeum vulgare*", *Photosynthesis Res.* 53, 161-171 (1997).

Tanksley et al., "Chromosome landing: a paradigm for map-based gene cloning in plants with large genomes", *Trends in Genet.* 11(2), 63-68 (1995).

Tikhonov et al., "Colinearity and its Exceptions in Orthologous *adh* Regions of Maize and *Sorghum*", *Proc. Natl. Acad. Sci. USA* 96, 7409-7414 (1999).

van de Loo et al., "An Oleate 12-Hydroxylase from *Ricirus communis* L. is a Fatty Acyl Desaturase Homolog", *Proc. Nat. Acad. Sci.* 92, 6743-6747 (1995).

Venter et al., "A New Strategy for Genome Sequencing", *Nature* 381, 364-366 (1996).

Venter et al., "The Sequence of the Human Genome" *Science* 291, 1304-1351 (2001).

Wang et al., "Construction of a Rice Bacterial Artificial Chromosome Library and Identification of Clones Linked to the Xa-21 Disease Resistance Locus", *Plant J.* 7(3), 525-533 (1995).

Wells et al., "The Chemokine Information Source: Identification and Characterization of Novel Chemokines Using the WorldWideWeb and Expressed Sequence Tag Databases", *J. Leukocyte Biol.* 61(5), 545-550 (1997).

Wendel et al., "New Isozyme Systems for Maize (*Zea mays* L.): Aconitate Hydratase, Adenylate Kinase, NADH Dehydrogenase, and Shikimate Dehydrogenase", *Biochem. Genet.* 26(5-6), 421-446 (1988) (Abstract Only).

Wenzel et al., "Physical mapping of the *Mycoplasma pneumoniae* genome", *Nucleic Acids Res.* 16(17), 8323-8336 (1988).

Winkler et al., "The Maize *Dwarf3* Gene Encodes a Cytochrome P450-Mediated Early Step in Gibberellin Biosynthesis", *Plant Cell* 7(8), 1307-1317 (1995).

Woese et al., "Conservation of Primary Structure in 16S Ribosomal RNA", *Nature* 254, 83-85 (1975).

Yomo et al., "Histochemical Studies on Protease Formation in the Cotyledons of Germinating Bean Seeds," *Planta* 112(1), 35-43 (1973).

Zhang et al., "Physical Mapping of the Rice Genome with BACs", *Plant Mol. Biol.* 35, 115-127 (1997).

Zhang et al., "Construction and Characterization of Two Rice Bacterial Artificial Chromosome Libraries from the Parents of a Permanent Recombinant Inbred Mapping Population", *Mol. Breeding* 2, 11-24 (1996).

Zwick et al., "Physical Mapping of the *liguleless* Linkage Group in *Sorghum bicolor* Using Rice RFLP-Selected *Sorghum* BACs", *Genetics* 248, 1983-1992 (1998).

Christensen et al., "Regulation of Auxin Response by the Protein Kinase PINOID," Cell, 100:469-478 (2000).

Nozue et al., "A Phytochrome from the Fern Adiantum with Features of the Putative Photoreceptor NPH1," Proc. Natl. Acad. Sci. USA, 95:15826-15830 (1998).

Lawton et al., "Molecular Cloning of Plant Transcripts Encoding Protein Kinase Homologs," Proc. Natl. Acad. Sci. USA, 86:3140-3144 (1989).

Lin et al., "Differential Accumulation of Transcripts Encoding Protein Kinase Homologs in Greening Pea Seedlings," Proc. Natl. Acad. Sci. USA, 88:6951-6955 (1991).

Abstract of Khanna et al., "Photoregulated Expression of the PsPK3 and PsPK5 Genes in Pea Seedlings," Plant Mol. Biol. 39(2):231-242 (1999).

Abstract of Chono et al., "Characterization of a Protein Kinase Gene Responsive to Auxin and Gibberellin in Cucumber Hypocotyls," Plant Cell Physiol., 39(9):958-967 (1998).

GenBank Accession No. AAB54117 (May 12, 1997).
GenBank Accession No. AAC26704 (Mar. 11, 2002).
GenBank Accession No. AAB95304 (Feb. 27, 2002).
GenBank Accession No. CAA66616 (Nov. 14, 2006).
GenBank Accession No. AAD34696 (Jun. 2, 1999).
GenBank Accession No. AAB71418 (Sep. 29, 1997).
GenBank Accession No. BAA82168 (Jul. 3, 1999).
GenBank Accession No. AAC78477 (Nov. 19, 1998).
GenBank Accession No. BAA36192 (Mar. 15, 2002).
GenBank Accession No. CAA82993 (Apr. 18, 2005).

* cited by examiner

PLANT GENOME SEQUENCE AND USES THEREOF

CROSS REFERENCE TO RELATED APPLICATION

This application is a continuation of U.S. application Ser. No. 09/620,392 filed Jul. 19, 2000, now abandoned, which claims priority under 35 U.S.C. §119(e) to U.S. Application Ser. No. 60/144,351 filed Jul. 20, 1999, and to U.S. Application Ser. No. 60/163,469 filed Nov. 1, 1999, each of which is herein incorporated by reference in its entirety.

INCORPORATION OF SEQUENCE LISTING

This application contains a sequence listing, which is contained on three identical CD-Rs: two copies of the sequence listing (COPY 1 REPLACEMENT Oct. 18, 2006 and COPY 2 REPLACEMENT Oct. 18, 2006) and a sequence listing in Computer Readable Form (CRF), all of which are herein incorporated by reference. All three sequence listing CD-Rs each contain one file called "pa_00300.rpt" which is 462,735,360 bytes in size (measured in Windows XP) and which was created on Oct. 18, 2006.

FIELD OF THE INVENTION

The present invention is in the field of plant biochemistry and genetics. More specifically the invention relates to nucleic acid molecules from plant cells, in particular, genomic DNA sequences from *Oryza sativa* (rice) plants and nucleic acid molecules that contain markers, in particular, single nucleotide polymorphism (SNP) and repetitive element markers. In addition, the present invention provides nucleic acid molecules having regulatory elements or encoding proteins or fragments thereof. The invention also relates to proteins and fragments of proteins so encoded and antibodies capable of binding the proteins. The invention also relates to methods of using the nucleic acid molecules, markers, repetitive elements and fragments of repetitive elements, regulatory elements, proteins and fragments of proteins, and antibodies, for example for genome mapping, gene identification and analysis, plant breeding, preparation of constructs for use in plant gene expression, and transgenic plants.

BACKGROUND OF THE INVENTION

I. Rice

Rice is one of three cereals produced annually at worldwide levels of approximately half a billion tons and more than 90% of produced rice is for human consumption (Goff S. A. *Curr. Opin. Plant Biol.* 2:86-89 (1999), the entirety of which is herein incorporated by reference). Rice, however, is not only a commercially important crop, it is also a model for other cereal crops. The identification in *Oryza sativa* (rice) of proteins, genetic and physical markers, biological agents such as plant promoters, open reading frames, plant gene intron regions, plant gene intron/exon junctions, and regulatory elements, etc., is important in the development of nutritionally enhanced or agriculturally enhanced crops, in particular cereal crops. Such agents are useful in, for example, marker development, genetic mapping or linkage analysis, marker assisted breeding, physical genome mapping, transgenic crop production, crop monitoring diagnostics, antibody production and gene modification. Such agents can also have pharmaceutical or nutriceutical applications.

Rice can be used as a model for other cereal genomes because it has a genome size smaller than the other major cereals. The size of the rice genome is estimated at 420 to 450 megabase pairs. Sorghum, maize, barley and wheat have larger genomes (1000, 3000, 5000 and 16000 Mpb respectively). The smaller genome size of rice results in a higher gene density relative to the other cereals. Based on estimates of 30,000 genes in a cereal genome, rice will have on average one gene approximately every 15 Kbp. Similarly, maize and wheat have one gene approximately every 100 and 500 kpb, respectively. It has been reported that this higher gene density in rice makes it a target for cereal gene discovery efforts and genomic sequence analysis (Goff S. A *Curr. Opin. Plant Biol.* 2:86-89 (1999), the entirety of which is herein incorporated by reference). Although the genes in rice are present at a higher relative density than in other cereals, they are predicted to be arranged in a similar general order within the genome (Goff S. A *Curr. Opin. Plant Biol.* 2:86-89 (1999)). Comparisons of the physical and genetic maps of cereal genomes have lead to reports that colinearity of gene order exists among the various cereal genomes studied.

In addition to the general conservation of gene order among the cereals, studies of a number of individual genes demonstrate that there is also considerable homology among various cereal gene families. This conservation of gene and protein sequence suggests that studies on the functions of genes or proteins from one cereal could lead to the elucidation of the functions of orthologous genes/proteins in other cereals. Non-coding regulatory regions of the genome may also retain similar function between the various cereals. For example, strong constitutive or tissue-specific promoters from one cereal are likely to retain function when introduced as a portion of a transgene in another species (Goff S. A *Curr. Opin. Plant Biol.* 2:86-89 (1999).

II. Sequence Comparisons

Genome sequence information from rice allows comparisons of rice sequences with other rice sequences as well as with those of other flowering plant genome sequences, particularly other cereal plant species, and also with genome sequences and gene sequences from other organisms, including bacteria, humans, and yeast. Such information provides valuable insights into the translation of plant genetic information into a flowering plant and also reveals genetic differences involved in the differentiation of the plant kingdom. In addition, genome sequencing and mapping provides increased opportunities for identification and isolation of agents associated with plant traits, as well as insight into mechanisms of genome interactions.

Rice sequences can be compared, for example, to sequences that encode promoters or proteins or other sequences. These homologies can be determined by similarity searches (Adams et al., *Science* 252:1651-1656 (1991), the entirety of which is herein incorporated by reference).

A characteristic feature of a DNA sequence is that it can be compared with other DNA sequences. Sequence comparisons can be undertaken by determining the similarity of the test or query sequence with sequences in publicly available or propriety databases ("similarity analysis") or by searching for certain motifs ("intrinsic sequence analysis") (e.g., cis elements) (Coulson, *Trends in Biotechnology*, 12:76-80 (1994); Birren et al., Genome Analysis, 1:543-559 (1997), both of which are herein incorporated by reference in their entirety).

Similarity analysis includes database search and alignment. Examples of public databases include the DNA Database of Japan (DDBJ) (on the Worldwide web at ddbj.nig.acjp/); GENBANK® (on the Worldwide web at ncbi.nlm.nih.gov/web/Genbank/Index.html); and the European Molecular Biology Laboratory Nucleic Acid Sequence Database (EMBL) (on the Worldwide web at ebi.ac.uk/ebi_docs/embl_db.html). A number of different search algorithms have been developed, one example of which is the suite of programs referred to as BLAST programs. There are five implementations of BLAST, three designed for nucleotide sequences queries (BLASTN, BLASTX, and TBLASTX) and two designed for protein sequence queries (BLASTP and TBLASTN) (Coulson, *Trends in Biotechnology*, 12:76-80 (1994); Birren, et al., *Genome Analysis*, 1:543-559 (1997)).

BLASTN takes a nucleotide sequence (the query sequence) and its reverse complement and searches them against a nucleotide sequence database. BLASTN was designed for speed, not maximum sensitivity, and may not find distantly related coding sequences. BLASTX takes a nucleotide sequence, translates it in three forward reading frames and three reverse complement reading frames, and then compares the six translations against a protein sequence database. BLASTX is useful for sensitive analysis of preliminary (single-pass) sequence data and is tolerant of sequencing errors (Gish and States, *Nature Genetics*, 3:266-272 (1993), the entirety of which is herein incorporated by reference).

Given a coding nucleotide sequence and the protein it encodes, it is often preferable to use the protein as the query sequence to search a database because of the greatly increased sensitivity to detect more subtle relationships. This is due to the larger alphabet of proteins (20 amino acids) compared with the alphabet of nucleic acid sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one it replaced. Various scoring matrices are used to supply the substitution scores of all possible amino acid pairs. A general purpose scoring system is the BLOSUM62 matrix (Henikoff and Henikoff, *Proteins*, 17:49-61 (1993), the entirety of which is herein incorporated by reference), which is currently the default choice for BLAST programs. BLOSUM62 is tailored for alignments of moderately diverged sequences and thus may not yield the best results under all conditions. Altschul, *J. Mol. Biol.* 36:290-300 (1993), the entirety of which is herein incorporated by reference, uses a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package available that performs progressive multiple sequence alignments based on the method of Feng and Doolittle, *J. Mol. Evol.* 25:351-360 (1987), the entirety of which is herein incorporated by reference. Each pair of sequences is aligned and the distance between each pair is calculated; from this distance matrix, a guide tree is calculated, and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both the pairwise alignments and the multiple alignments. CLUSTAL W for UNIX and VMS systems is available at: ftp.ebi.ac.uk. Another program is MACAW (Schuler et al., *Proteins, Struct. Func. Genet*, 9:180-190 (1991), the entirety of which is herein incorporated by reference, for which both Macintosh and Microsoft Windows versions are available. MACAW uses a graphical interface, provides a choice of several alignment algorithms, and is available by anonymous ftp at: ncbi.nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of reported sequence motifs is PROSITE (Bairoch and Bucher, *Nucleic Acid Research*, 22:3583-3589 (1994), the entirety of which is herein incorporated by reference). PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by S. Henikoff, *Trends Biochem Sci.*, 18:267-268 (1993), the entirety of which is herein incorporated by reference; Henikoff and Henikoff, *Nucleic Acid Research*, 19:6565-6572 (1991), the entirety of which is herein incorporated by reference; Henikoff and Henikoff, *Proteins*, 17:49-61 (1993). BLOCKS searches a protein or nucleotide sequence against a database of protein motifs or "blocks." Blocks are defined as short, ungapped multiple alignments that represent highly conserved protein patterns. The blocks themselves are derived from entries in PROSITE as well as other sources. Either a protein or nucleotide query can be submitted to the BLOCKS server; if a nucleotide sequence is submitted, the sequence is translated in all six reading frames and motifs are sought in these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches (such as GCG program ProfileSearch) and Hidden Markov Models (HMMs) (Krough, et al., *J. Mol. Biol.* 235:1501-1531 (1994); Eddy, *Current Opinion in Structural Biology* 6:361-365 (1996), both of which are herein incorporated by reference in their entirety). In both cases, a large number of common protein domains have been converted into profiles, as present in the PROSITE library, or HHM models, as in the Pfam protein domain library (Sonnhammer, et al., *Proteins* 28:405-420 (1997), the entirety of which is herein incorporated by reference). Pfam contains more than 500 HMM models for enzymes, transcription factors, signal transduction molecules, and structural proteins. Protein databases can be queried with these profiles or HMM models, which will identify proteins containing the domain of interest. For example, HMMSW or HMMFS, two programs in a public domain package called HMMER (Sonnhammer, et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov, et al., *Proc. Natl. Acad. Sci.* 91:12091-12095 (1994), the entirety of which is herein incorporated by reference). On the basis of an aligned set of input sequences, a weight matrix is calculated by using one of four methods (selected by the user); a weight matrix is simply a representation, position by position in an alignment, of how likely a particular amino acid will appear. The calculated weight matrix is then used to search the databases. To increase sensitivity, newly found sequences are added to the original data set, the weight matrix is recalculated, and the search is performed again. This procedure continues until no new sequences are found.

III. Contig Assembly

A characteristic feature of a large scale shotgun sequencing project is that the sequence data can be processed and assembled into contiguous sequences (contigs), which represent a reconstruction of the original genome sequence from the cloned fragments. Likewise, individual Bacterial Artificial Chromosome (BAC) clones within a BAC library can be shot gun sequenced and these data can be assembled into contigs within each clone. Programs are available in the public domain that can analyze the sequence output and assemble the sequences into larger sequence regions representing contiguous sequences of the target genome. Examples of such programs can be found at, for example, on the website genome.wustl.edu/gsc, on the Worldwide web at sanger.ac.uk, and on the Worldwide web at mbt.washington.edu. An example of sequence reading program is Phred (on the Worldwide web at mbt.washington.edu). Phred reads DNA sequencer trace data, calls bases, assigns quality values to the bases, and writes the base calls and quality values to output files.

The process of assembling DNA sequence fragments generally involves three phases; the overlap phase, the layout phase and the multi-alignment, or consensus, phase. In the overlap phase, each fragment is compared against every other fragment to determine if they share a common subsequence, an indication that they were potentially sampled from overlapping stretches of the original DNA strand. Pairs of fragments are compared in two ways; 1) with both fragments in the same relative orientation, and 2) with one of the fragments having been reverse complemented. In the layout phase, a series of alternate assemblies or layouts of the fragments based on the pairwise overlaps is generated. A layout specifies the relative locations and orientations of the fragments with respect to each other and is typically visualized as an arrangement of overlapping directed lines, one for each fragment. The general criterion for the layout phase is to produce plausible assemblies of maximum likelihood. In this manner, it can be determined if there is more than one way to put the pieces together and if different solutions appear equally plausible. In such a case, one would return to the lab and obtain additional information to resolve the ambiguity. The multi-alignment, or consensus, phase uses more information than just the pairwise alignments in the layout. The sequences of all the fragments in a layout are simultaneously aligned, giving a final set of contigs representing regions of the target genome. An example of an assembly program is PHRAP, which can be found at the website chimera.biotech.washington.edu/UWGC/tools/phrap.htm.

IV. Gene Mapping and Marker Assisted Introgression of Plant Traits

Genome sequence information from rice provides markers that will assist in the development of improved plants. Marker assisted introgression of traits into plants have been reported. An initial step in that process is the localization of the trait by gene mapping. Gene mapping is the process of determining a gene's position relative to other genes and genetic markers through linkage analysis. The basic principle for linkage mapping is that the closer together two genes are on the chromosome, the more likely they are to be inherited together (Rothwell, *Understanding Genetics*. $4^{th}$ Ed. Oxford University Press, New York, p. 703 (1988), the entirety of which is herein incorporated by reference). Briefly, a cross is made between two genetically compatible but divergent parents relative to traits under study. Genetic markers are then used to follow the segregation of traits under study in the progeny from the cross (often a backcross, $F_2$, or recombinant inbred population).

Linkage analysis is based on the level at which markers and genes are co-inherited (Rothwell, *Understanding Genetics*. $4^{th}$ Ed. Oxford University Press, New York, p. 703 (1988). Statistical tests like chi-square analysis can be used to test the randomness of segregation or linkage (Kochert, *The Rockefeller Foundation International Program on Rice Biotechnology*, University of Georgia Athens, Ga., pp. 1-14 (1989), the entirety of which is herein incorporated by reference). In linkage mapping, the proportion of recombinant individuals out of the total mapping population provides the information for determining the genetic distance between the loci (Young, *Encyclopedia of Agricultural Science, Vol.* 3, pp. 275-282 (1994), the entirety of which is herein incorporated by reference).

Classical mapping studies utilize easily observable, visible traits instead of molecular markers. These visible traits are also known as naked eye polymorphisms. These traits can be morphological like plant height, fruit size, shape and color or physiological like disease response, photoperiod sensitivity or crop maturity. Visible traits are useful and are still in use because they represent actual phenotypes and are easy to score without any specialized lab equipment. By contrast, the other types of genetic markers are arbitrary loci for use in linkage mapping and often not associated to specific plant phenotypes (Young, *Encyclopedia of Agricultural Science*, Vol. 3, pp. 275-282 (1994). Many morphological markers cause such large effects on phenotype that they are undesirable in breeding programs. Many other visible traits have the disadvantage of being developmentally regulated (i.e., expressed only certain stages; or at specific tissue and organs). Oftentimes, visible traits mask the effects of linked minor genes making it nearly impossible to identify desirable linkages for selection (Tanksley et al., *Biotech.* 7:257-264 (1989), the entirety of which is herein incorporated by reference).

Although a number of important agronomic characters are controlled by loci having major effects on phenotype, many economically important traits, such as yield and some forms of disease resistance, are quantitative in nature. This type of phenotypic variation in a trait is typically characterized by continuous, normal distribution of phenotypic values in a particular population (polygenic traits) (Beckmann and Soller *Oxford Surveys of plant Molecular Biology, Miffen.* (ed.), Vol. 3, Oxford University Press, UK., pp. 196-250 (1986), the entirety of which is herein incorporated by reference). Loci contributing to such genetic variation are often termed, minor genes, as opposed to major genes with large effects that follow a Mendelian pattern of inheritance. Polygenic traits are also predicted to follow a Mendelian type of inheritance, however the contribution of each locus is expressed as an increase or decrease in the final trait value.

The advent of DNA markers, such as restriction fragment length polymorphic markers (RFLPs), microsatellite markers, single nucleotide polymorphic markers (SNPs), and random amplified polymorphic markers (RAPDs), allow the resolution of complex, multigenic traits into their individual Mendelian components (Paterson et al., *Nature* 335:721-726 (1988), the entirety of which is herein incorporated by reference). A number of applications of RFLPs and other markers have been suggested for plant breeding. Among the potential applications for RFLPs and other markers in plant breeding include: varietal identification (Soller and Beckmann, *Theor. Appl. Genet.* 67:25-33 (1983); Tanksley et al., *Biotech.* 7:257-264 (1989), both of which are herein incorporated by reference in their entirety); QTL mapping (Edwards et al., *Genetics* 116:113-115 (1987); Nienhuis et al., *Crop Sci.* 27:797-803 (1987); Osborn et al., *Theor. Appl. Genet.* 73:350-356 (1987); Romero-Severson et al., *Use of RFLPs In Analysis Of Quantitative Trait Loci In Maize*, In Helentjaris and Burr (eds.), pp. 97-102 (1989); Young et al., *Genetics* 120:579-585 (1988); Martin et al., *Science* 243:1725-1728 (1989); Sarfatti et al., *Theor. Appl. Genet.* 78:22-26 (1989); Tanksley et al., *Biotech.* 7:257-264 (1989); Barone et al., *Mol. Gen. Genet.* 224:177-182 (1990); Jung et al., *Theor. Appl. Genet.* 79:663-672 (1990); Keim et al., *Genetics* 126:735-742 (1990); Keim et al., *Theor. Appl. Genet.* 79:465-369 (1990); Paterson et al., *Genetics* 124:735-742 (1990); Martin et al., *Proc. Natl. Acad. Sci. USA* 88:2336-2340 (1991); Messeguer et al., *Theor. Appl. Genet.* 82:529-536 (1991); Michelmore et al., *Proc. Natl. Acad. Sci. USA* 88:9828-9832 (1991); Ottaviano et al., *Theor. Appl. Genet.* 81:713-719 (1991); Yu et al., *Theor. Appl. Genet.* 81:471-476 (1991); Diers et al., *Crop Sci.* 32:377-383 (1992); Diers et al., *Theor. Appl. Genet.* 83:608-612 (1992); *J. Plant Nut.* 15:2127-2136 (1992); Doebley et al., *Proc. Natl. Acad. Sci. USA* 87:9888-9892 (1990), all of which are herein incorporated by reference in their entirety); screening genetic resource strains for useful quantitative trait alleles and introgression of these alleles into commercial varieties (Beckmann and Soller, *Theor. Appl. Genet.* 67:35-43 (1983), the entirety of which is herein incorporated by reference); marker-assisted selection (Tanksley et al., *Biotech.* 7:257-264 (1989)); and map-based cloning (Tanksley et al., *Biotech.* 7:257-264 (1989)). In addition, DNA markers can be used to obtain information about: (1) the number, effect, and chromosomal location of each gene affecting a trait; (2) effects of multiple copies of individual genes (gene dosage); (3) interaction between/among genes controlling a trait (epistasis); (4) whether individual genes affect more than one trait (pleiotropy); and (5) stability of gene function across environments (G×E interactions).

SUMMARY OF THE INVENTION

The present invention provides a substantially purified nucleic acid molecule, the nucleic acid molecule capable of specifically hybridizing to a second nucleic acid molecule having a nucleic acid sequence selected from the group consisting of SEQ ID NO: 1 through SEQ ID NO: 69652 or complements thereof or fragments of either.

The present invention also provides a substantially purified nucleic acid molecule encoding a rice protein or fragment thereof, wherein the rice protein or fragment thereof is encoded by a nucleic acid sequence selected from the group consisting of 69652 1 through SEQ ID NO: 69652 or complements thereof or fragments of either.

The present invention also provides a substantially purified protein or fragment thereof encoded by a first nucleic acid molecule which specifically hybridizes to a second nucleic acid molecule, the second nucleic acid molecule having a nucleic acid sequence selected from the group consisting of SEQ ID NO: 1 through SEQ ID NO: 69652 or complements thereof.

The present invention also provides a substantially purified protein or fragment thereof encoded by a nucleic acid sequence selected from the group consisting of SEQ ID NO: 1 through SEQ ID NO: 69652 or complements thereof or fragments of either.

The present invention also provides a substantially purified antibody or fragment thereof, the antibody or fragment thereof capable of specifically binding to the protein or fragment thereof encoded by a first nucleic acid molecule which specifically hybridizes to a second nucleic acid molecule, the second nucleic acid molecule having a nucleic acid sequence selected from the group consisting of SEQ ID NO: 1 through SEQ ID NO: 69652 or complements thereof or fragment of either.

The present invention also provides a transformed plant having a nucleic acid molecule which comprises: (A) an exogenous promoter region which functions in a plant cell to cause the production of an mRNA molecule; which is linked to (B) a structural nucleic acid molecule, wherein the structural nucleic acid molecule is selected from the group consisting of a protein or fragment thereof encoding sequence located within SEQ ID NO: 1 through SEQ ID NO: 69652 or complements thereof; which is linked to (C) a 3' non-translated sequence that functions in a plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of an mRNA molecule wherein the promoter nucleic acid molecule is selected from the group consisting of SEQ ID NO: 1 through SEQ ID NO: 69652 or complements thereof or fragments of either; which is linked to (B) a structural nucleic acid molecule encoding a protein or fragment thereof; which is linked to (C) a 3' non-translated sequence that functions in a plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of an mRNA molecule; which is linked to (B) a transcribed nucleic acid molecule with a transcribed strand and a non-transcribed strand, wherein the transcribed strand is complementary to a nucleic acid molecule having a nucleic acid sequence selected from the group consisting of SEQ ID NO: 1 through SEQ ID NO: 69652 or complements thereof and the transcribed strand is complementary to an endogenous mRNA molecule; which is linked to (C) a 3' non-translated sequence that functions in plant cells to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of an mRNA molecule wherein the promoter nucleic acid molecule is selected from the group consisting of SEQ ID NO: 1 through SEQ ID NO: 69652 or complements thereof; which is linked to (B) a transcribed nucleic acid molecule with a transcribed strand and a non-transcribed strand, wherein the transcribed strand is complementary to an endogenous mRNA molecule; which is linked to (C) a 3' non-translated sequence that functions in plant cells to cause termination of transcription and addition of polyadenylated ribonucleotides to a 3' end of the mRNA molecule.

The present invention also provides a computer readable medium having recorded thereon one or more nucleic acid molecules encoding a rice protein or fragment thereof, wherein the rice protein or fragment thereof is encoded by a nucleic acid sequence selected from the group consisting of SEQ ID NO: 1 through SEQ ID NO: 69652 or complements thereof or fragments of either.

The present invention also provides a method of introgressing a trait into a plant comprising using a nucleic acid marker for marker assisted selection of the plant, the nucleic acid marker complementary to a nucleic acid sequence selected from the group consisting of SEQ ID NO: 1 through SEQ ID NO: 69652 or complements thereof, and introgressing the trait into a plant.

The present invention also provides a method for screening for a trait comprising interrogating genomic DNA for the presence or absence of a marker molecule that is genetically linked to a nucleic acid sequence complementary to a nucleic acid sequence selected from the group consisting of SEQ ID NO: 1 through SEQ ID NO: 69652 or complements thereof; and detecting the presence or absence of the marker.

The present invention also provides a method for determining the likelihood of the presence or absence of a trait in a plant comprising the steps of: (A) obtaining genomic DNA from the plant; (B) detecting a marker nucleic acid molecule; wherein the marker nucleic acid molecule specifically hybridizes with a nucleic acid sequence that is genetically linked to a nucleic acid sequence complementary to a nucleic acid sequence selected from the group consisting of SEQ ID NO: 1 through SEQ ID NO: 69652 or complements thereof; (C) determining the level, presence or absence of the marker nucleic acid molecule, wherein the level, presence or absence of the marker nucleic acid molecule is indicative of the likely presence in the plant of the trait.

The present invention also provides a method for determining a genomic polymorphism in a plant that is predictive of a trait comprising the steps: (A) incubating a marker nucleic acid molecule, under conditions permitting nucleic acid hybridization, and a complementary nucleic acid molecule obtained from the plant, the marker nucleic acid molecule having a nucleic acid sequence selected from the group consisting of SEQ ID NO: 1 through SEQ ID NO: 69652 or complements thereof or fragments of either; (B) permitting hybridization between the marker nucleic acid molecule and the complementary nucleic acid molecule obtained from the plant; and (C) detecting the presence of the polymorphism.

The present invention also provides a method of determining an association between a polymorphism and a plant trait comprising: (A) hybridizing a nucleic acid molecule specific for the polymorphism to genetic material of a plant, wherein the nucleic acid molecule comprises a nucleic acid sequence selected from the group consisting of SEQ ID NO: 1 through SEQ ID NO: 69652 or complements thereof or fragments of either; and (B) calculating the degree of association between the polymorphism and the plant trait.

The present invention provides a method for isolating a nucleic acid molecule in a non-rice cereal comprising: (A) defining a genomic region of rice by reference to a marker molecule, wherein said marker molecule comprises a nucleic acid sequence selected from the group consisting of SEQ ID NO: 1 through SEQ ID NO: 69652 or complement thereof or fragment of either; (B) identifying a syntenic genomic region of said non-rice cereal that corresponds to said defined genomic region of rice; and (C) isolating said syntenic genomic region of said non-rice cereal that corresponds to said defined genomic region of rice.

The present invention provides a method for isolating a nucleic acid molecule in a cereal comprising: (A) defining a genomic region of rice by reference to a marker molecule, wherein said marker molecule comprises a nucleic acid sequence selected from the group consisting of SEQ ID NO: 1 through SEQ ID NO: 69652 or complement thereof or fragment of either; (B) identifying a syntenic genomic region of said cereal that corresponds to said defined genomic region of rice; and (C) isolating said syntenic genomic region of said cereal that corresponds to said defined genomic region of rice.

The present invention provides a method for interrogating a genomic region of a non-rice cereal comprising interrogating genomic DNA for the presence or absence of two marker molecules, wherein said two marker molecules comprise two nucleic acid sequences selected from the group consisting of SEQ ID NO: 1 through SEQ ID NO: 69652 or complement thereof or fragment of either, and detecting the presence or absence of said two marker molecules.

DETAILED DESCRIPTION OF THE INVENTION

Agents of the Invention (a) Nucleic Acid Molecules

Agents of the present invention include nucleic acid molecules and more specifically BACs or nucleic acid fragment molecules thereof.

Agents of the present invention include plant nucleic acid molecules and more specifically include rice, more preferably *Oryza sativa* L (japonica type), and more preferably *Oryza sativa* L (japonica type), cv. Nipponbare. A subset of the nucleic acid molecules of the present invention includes nucleic acid molecules that are marker molecules. Another subset of the nucleic molecules of the present invention includes nucleic acid molecules that are promoters and/or regulatory elements. Another subset of the nucleic acid molecules of the present invention includes nucleic acid molecules that encode a gene or fragment thereof. Another subset of the nucleic acid molecules of the present invention encodes proteins or fragments of proteins. In a preferred embodiment the nucleic acid molecules of the present invention are derived from rice, more preferably *Oryza sativa* L (japonica type), and more preferably *Oryza sativa* L (japonica type), cv. Nipponbare.

Fragment nucleic acid molecules may encode significant portion(s) of, or indeed most of, these nucleic acid molecules. For example, a fragment nucleic acid molecule can encode a rice protein or fragment thereof. Alternatively, the fragments may comprise smaller oligonucleotides (having from about 15 to about 400 nucleotide residues, and more preferably, about 15 to about 30 nucleotide residues, or about 50 to about 100 nucleotide residues, or about 100 to about 200 nucleotide residues, or about 200 to about 400 nucleotide residues, or about 275 to about 350 nucleotide residues).

As used herein, an agent, be it a naturally occurring molecule or otherwise may be "sub-stantially purified", if desired, referring to a molecule separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

The agents of the present invention will preferably be "biologically active" with respect to either a structural attribute, such as the capacity of a nucleic acid to hybridize to another nucleic acid molecule, or the ability of a protein to be bound by an antibody (or to compete with another molecule for such binding). Alternatively, such an attribute may be catalytic, and thus involve the capacity of the agent to mediate a chemical reaction or response.

The agents of the present invention may also be recombinant. As used herein, the term recombinant means any agent (e.g., DNA, peptide etc.), that is, or results, however indirect, from human manipulation of a nucleic acid molecule.

It is understood that the agents of the present invention may be labeled with reagents that facilitate detection of the agent (e.g., fluorescent labels (Prober, et al., *Science* 238:336-340 (1987); Albarella et al., EP 144914, chemical labels (Sheldon et al., U.S. Pat. No. 4,582,789; Albarella et al., U.S. Pat. No. 4,563,417, modified bases (Miyoshi et al., EP 119448, all of which are hereby incorporated by reference in their entirety).

It is further understood, that the present invention provides, for example, bacterial, viral, microbial, insect, fungal, algal and plant cells comprising an agent of the present invention.

Nucleic acid molecules or fragment nucleic acid molecules, or BACs or fragments thereof, of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook et al., *Molecular Cloning*, A Laboratory Manual, 2nd Ed., Cold Spring Harbor Press, Cold Spring Harbor, N.Y. (1989), and by Haymes et al., *Nucleic Acid Hybridization, A Practical Approach*, IRL Press, Washington, D.C. (1985), both of which are herein incorporated by reference in their entirety. Departures from complete complementarity are therefore permissible, as long as such departures do not completely preclude the capacity of the molecules to form a double-stranded structure. Thus, in order for a nucleic acid molecule, fragment nucleic acid molecule, BAC nucleic acid molecule or fragment BAC nucleic acid molecule to serve as a primer or probe it need only be sufficiently complementary in sequence to be able to form a stable double-stranded structure under the particular solvent and salt concentrations employed.

Appropriate stringency conditions which promote DNA hybridization are, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 69652 or complements thereof under moderately stringent conditions, for example at about 2.0×SSC and about 40° C.

In a particularly preferred embodiment, a nucleic acid of the present invention will specifically hybridize to one or more of the nucleic acid molecules set forth in SEQ ID NO:1 through SEQ ID NO: 69652 or complements thereof under high stringency conditions. In one aspect of the present invention, the nucleic acid molecules of the present invention have one or more of the nucleic acid sequences set forth in SEQ ID NO: 1 through to SEQ ID NO: 69652 or complements thereof. In another aspect of the present invention, one or more of the nucleic acid molecules of the present invention share between 100% and 90% sequence identity with one or more of the nucleic acid sequences set forth in SEQ ID NO: 1 through to SEQ ID NO: 69652 or complements thereof. In a further aspect of the present invention, one or more of the nucleic acid molecules of the present invention share between 100% and 95% sequence identity with one or more of the nucleic acid sequences set forth in SEQ ID NO: 1 through to SEQ ID NO: 69652 or complements thereof. In a more preferred aspect of the present invention, one or more of the nucleic acid molecules of the present invention share between 100% and 98% sequence identity with one or more of the nucleic acid sequences set forth in SEQ ID NO: 1 through to SEQ ID NO: 69652 or complements thereof. In an even more preferred aspect of the present invention, one or more of the nucleic acid molecules of the present invention share between 100% and 99% sequence identity with one or more of the sequences set forth in SEQ ID NO: 1 through to SEQ ID NO: 69652 or complements thereof. In a further, even more preferred aspect of the present invention, one or more of the nucleic acid molecules of the present invention exhibit 100% sequence identity with one or more nucleic acid molecules present within the genomic library herein designated BAC#OJ (Monsanto Company, St. Louis, Miss., United States of America).

(i) Nucleic Acid Molecule Markers

One aspect of the present invention concerns nucleic acid molecules SEQ ID NO:1 through SEQ ID NO: 69652 or complements thereof and other nucleic acid molecules of the present invention, that contain microsatellites, single nucleotide substitutions (SNPs), repetitive elements or parts of repetitive elements or other markers. Microsatellites typically include a 1-6 nucleotide core element that are tandemly repeated from one to many thousands of times. A different "allele" occurs at an SSR locus as a result of changes in the number of times a core element is repeated, altering the length of the repeat region, (Brown et al., *Methods of Genome Analysis in Plants*, (ed.) Jauhar, CRC Press, Inc, Boca Raton, Fla., USA; London, England, UK, pp. 147-159, (1996), the entirety of which is herein incorporated by reference). SSR loci occur throughout plant genomes, and specific repeat motifs occur at different levels of abundance than those found in animals. The relative frequencies of all SSRs with repeat units of 1-6 nucleotides have been surveyed. The most abundant SSR is AAAAAT followed by $A_n$, $AG_n$ AAT, AAC, AGC, AAG, AATT, AAAT and AC. On average, 1 SSR is found every 21 and 65 kb in dicots and monocots. Fewer CG nucleotides are found in dicots than in monocots. There is no correlation between abundance of SSRs and nuclear DNA content. The abundance of all tri and tetranucleotide SSR combination jointly have been reported to be equivalent to that of the total di-nucleotide combinations. Mono- di- and tetra-nucleotide repeats are all located in noncoding regions of DNA while 57% of those trinucleotide SSRs containing CG were located within gene coding regions. All repeated trinucleotide SSRs composed entirely of AT are found in noncoding regions, (Brown et al., *Methods of Genome Analysis in Plants*, ed. Jauhar, CRC Press, Inc, Boca Raton, Fla., USA; London, England, UK, pp. 147-159 (1996)).

Microsatellites can be observed in SEQ NO:1 to SEQ NO:69652 or complements thereof by using the BLASTN program to examine sequences for the presence/absence of microsatellites. In this system, raw sequence data is searched through databases, which store SSR markers collected from publications and 692 classes of di-, tri and tetranucleotide repeat markers generated by computer. Microsatellites can also be observed by screening the BAC library of the present invention by colony or plaque hybridization with a labeled probe containing microsatellite markers; isolating positive clones and sequencing the inserts of the positive clones; suitable primers flanking the microsatellite markers.

Single nucleotide polymorphisms (SNPs) are single base changes in genomic DNA sequence. They generally occur at greater frequency than other markers and are spaced with a greater uniformity throughout a genome than other reported forms of polymorphism. The greater frequency and uniformity of SNPs means that there is greater probability that such a polymorphism will be found near or in a genetic locus of interest than would be the case for other polymorphisms. SNPs are located in protein-coding regions and noncoding regions of a genome. Some of these SNPs may result in defective or variant protein expression (e.g., as a result of mutations or defective splicing). Analysis (genotyping) of characterized SNPs can require only a plus/minus assay rather than a lengthy measurement, permitting easier automation.

SNPs can be characterized using any of a variety of methods. Such methods include the direct or indirect sequencing of the site, the use of restriction enzymes (Botstein et al., *Am. J. Hum. Genet.* 32:314-331 (1980); Konieczny and Ausubel, *Plant J.* 4:403-410 (1993), both of which are herein incorporated by reference in their entirety), enzymatic and chemical mismatch assays (Myers et al., *Nature* 313:495-498 (1985), the entirety of which is herein incorporated by reference), allele-specific PCR (Newton et al., *Nucl. Acids Res.* 17:2503-2516 (1989); Wu et al., *Proc. Natl. Acad. Sci. USA* 86:2757-2760 (1989), both of which are herein incorporated by reference in their entirety), ligase chain reaction (Barany, *Proc. Natl. Acad. Sci. USA* 88:189-193 (1991), the entirety of which is herein incorporated by reference), single-strand conformation polymorphism analysis (Labrune et al., *Am. J. Hum. Genet.* 48: 1115-1120 (1991), the entirety of which is herein incorporated by reference), primer-directed nucleotide incorporation assays (Kuppuswami et al., *Proc. Natl. Acad. Sci. USA* 88:1143-1147 (1991), the entirety of which is herein incorporated by reference), dideoxy fingerprinting (Sarkar et al., *Genomics* 13:441-443 (1992), the entirety of which is herein incorporated by reference), solid-phase ELISA-based oligonucleotide ligation assays (Nikiforov et al., *Nucl. Acids Res.* 22:4167-4175 (1994), the entirety of which is herein incorporated by reference), oligonucleotide fluorescence-quenching assays (Livak et al., *PCR Methods Appl.* 4:357-362 (1995a), the entirety of which is herein incorporated by reference), 5'-nuclease allele-specific hybridization Taq-Man™ assay (Livak et al., *Nature Genet.* 9:341-342 (1995), the entirety of which is herein incorporated by reference), template-directed dye-terminator incorporation (TDI) assay (Chen and Kwok, *Nucl. Acids Res.* 25:347-353 (1997), the entirety of which is herein incorporated by reference), allele-specific molecular beacon assay (Tyagi et al., *Nature Biotech.* 16: 49-53 (1998), the entirety of which is herein incorporated by reference), PinPoint assay (Haff and Smirnov, *Genome Res.* 7: 378-388 (1997), the entirety of which is herein incorporated by reference), and dCAPS analysis (Neff et al., *Plant J.* 14:387-392 (1998), the entirety of which is herein incorporated by reference).

SNPs can be observed by examining sequences of overlapping clones in the BAC library according to the method described by Taillon-Miller et al. *Genome Res.* 8:748-754 (1998), the entirety of which is herein incorporated by reference. SNPs can also be observed by screening the BAC library of the present invention by colony or plaque hybridization with a labeled probe containing SNP markers; isolating positive clones and sequencing the inserts of the positive clones; suitable primers flanking the SNP markers.

Genetic markers of the present invention include "dominant" or "codominant" markers. "Codominant markers" reveal the presence of two or more alleles (two per diploid individual) at a locus. "Dominant markers" reveal the presence of only a single allele per locus. The presence of the dominant marker phenotype (e.g., a band of DNA) is an indication that one allele is present in either the homozygous or heterozygous condition. The absence of the dominant marker phenotype (e.g., absence of a DNA band) is merely evidence that "some other" undefined allele is present. In the case of populations where individuals are predominantly homozygous and loci are predominately dimorphic, dominant and codominant markers can be equally valuable. As populations become more heterozygous and multi-allelic, codominant markers often become more informative of the genotype than dominant markers.

In addition to SSRs and SNPs, repetitive elements can be used as markers. For most eukaryotes, interspersed repeat sequence elements are typically mobile genetic elements (Wright et al., *Genetics* 142:569-578 (1996), the entirety of which is herein incorporated by reference). They are ubiquitous in most living organisms and are present in copy numbers ranging from just a few elements to tens or hundreds or thousands per genome. In the latter case, they can represent a major fraction of the genome. For example, transposable elements have been estimated to make up greater than 50% of the maize genome (Kidwell, and Lisch *Proc. Natl. Acad. Sci. USA* 94:7704-7711 (1997), the entirety of which is herein incorporated by reference).

Transposable elements are classified in families according to their sequence similarity. Two major classes are distinguished by their differing modes of transposition. Class I elements are retroelements that use reverse transcriptase to transpose by means of an RNA intermediate. They include long terminal repeat retrotransposons and long and short interspersed elements (LINES and SINES, respectively).

Class II elements transpose directly from DNA to DNA and include transposons such as the Activator-Dissociation (Ac-Ds) family in maize, the P element in *Drosophila* and the Tc-1 element in *Caenhorabditis elegans*. Additionally, a category of transposable elements has been discovered whose transposition mechanism is not yet known. These miniature inverted-repeat transposable elements (MITEs) have some properties of both class I and II elements. They are short (100-400 bp in length) and none so far has been found to have any coding potential. They are present in high copy number (3,000-10,000) per genome and have target site preferences for TAA or TA in plants (Kidwell and Lisch, *Proc. Natl. Acad. Sci. USA* 94:7704-7711 (1997)).

Insertion elements are found in two areas of the genome. Some are located in regions distant from gene sequences such as in the heterochromatin or in regions between genes; other repeat elements are found in or near single copy sequences. The insertion of an Ac-Ds element into wx-m9, an allele of the waxy locus in maize is an example of a repetitive element found within a coding region. The effect of this insertion is attenuated by the loss through splicing of the transposable element after transcription (Kidwell and Lisch, *Proc. Natl. Acad. Sci. USA* 94:7704-7711 (1997)).

The genetic variability resulting from transposable elements ranges from changes in the size and arrangement of whole genomes to changes in single nucleotides. They may produce major effects on phenotypic traits or small silent changes detectable only at the DNA sequence level. Transposable elements may also produce variation when they excise, leaving small footprints of their previous presence (Kidwell and Lisch, *Proc. Natl. Acad. Sci. USA* 94:7704-7711 (1997)).

In addition, other markers such as AFLP markers, RFLP markers, RAPD markers, phenotypic markers or isozyme markers can be utilized (Walton, Seed World 22-29, Jul., 1993); Burow and Blake, *Molecular Dissection of Complex Traits*, 13-29, Eds. Paterson, CRC Press, New York (1988), both of which are herein incorporated by reference in their entirety). DNA markers can be developed from nucleic acid molecules using restriction endonucleases, the PCR and/or DNA sequence information. RFLP markers result from single base changes or insertions/deletions. These codominant markers are highly abundant in plant genomes, have a medium level of polymorphism and are developed by a combination of restriction endonuclease digestion and Southern blotting hybridization. CAPS are similarly developed from restriction nuclease digestion but only of specific PCR products. These markers are also codominant, have a medium level of polymorphism and are highly abundant in the genome. The CAPS result from single base changes and insertions/deletions. Another marker type, RAPDs, are developed from DNA amplification with random primers and result from single base changes and insertions/deletions in plant genomes. They are dominant markers with a medium level of polymorphisms and are highly abundant. AFLP markers require using the PCR on a subset of restriction fragments from extended adapter primers. These markers are both dominant and codominant, are highly abundant in genomes and exhibit a medium level of polymorphism. SSRs require DNA sequence information. These codominant markers result from repeat length changes, are highly polymorphic, and do not exhibit as high a degree of abundance in the genome as CAPS, AFLPs and RAPDs. SNPs also require DNA sequence information. These codominant markers result from single base substitutions. They are highly abundant and exhibit a medium of polymorphism (Rafalski et al., In: *Nonmammalian Genomic Analysis*, ed. Birren and Lai, Academic Press, San Diego, Calif., pp. 75-134 (1996), the entirety of which is herein incorporated by reference). Methods to isolate such markers are known in the art.

Long Terminal repeat retrotransposons and MITEs have been found to be associated with the genes of many plants where some of the transposable elements contribute regulatory sequences. MITEs such as the Tourist element in maize and the Stowaway element in Sorghum are found frequently in the 5' and 3' noncoding regions of genes and are frequently associated with the regulatory regions of genes of diverse flowering plants (Kidwell and Lisch, *Proc. Natl. Acad. Sci. USA* 94:7704-7711 (1997)). It is understood that one or more of the Long Terminal repeat retrotransposons and/or MITES may be a marker, and even more preferably a marker for a gene.

(ii) Nucleic Acid Molecules Comprising Regulatory Elements

Another class of agents of the present invention are nucleic acid molecules having promoter regions or partial promoter regions within SEQ ID NO: 1 through SEQ ID NO: 69652 or other nucleic acid molecules of the present invention. Such promoter regions are typically found upstream of the trinucleotide ATG sequence at the start site of a protein coding region.

As used herein, a promoter region is a region of a nucleic acid molecule that is capable, when located in cis to a nucleic acid sequence that encodes for a protein or fragment thereof to function in a way that directs expression of one or more mRNA molecules that encodes for the protein or fragment thereof.

Promoters of the present invention can include between about 300 bp upstream and about 10 kb upstream of the trinucleotide ATG sequence at the start site of a protein coding region. Promoters of the present invention can preferably include between about 300 bp upstream and about 5 kb upstream of the trinucleotide ATG sequence at the start site of a protein coding region. Promoters of the present invention can more preferably include between about 300 bp up-stream and about 2 kb upstream of the trinucleotide ATG sequence at the start site of a protein coding region. Promoters of the present invention can include between about 300 bp upstream and about 1 kb upstream of the trinucleotide ATG sequence at the start site of a protein coding region. While in many circumstances a 300 bp promoter may be sufficient for expression, additional sequences may act to further regulate expression, for example, in response to biochemical, developmental or environmental signals.

It is also preferred that the promoters of the present invention contain a CAAT and a TATA cis element. Moreover, the promoters of the present invention can contain one or more cis elements in addition to a CAAT and a TATA box.

By "regulatory element" it is intended a series of nucleotides that determines if, when, and at what level a particular gene is expressed. The regulatory DNA sequences specifically interact with regulatory or other proteins. Many regulatory elements act in cis ("cis elements") and are believed to affect DNA topology, producing local conformations that selectively allow or restrict access of RNA polymerase to the DNA template or that facilitate selective opening of the double helix at the site of transcriptional initiation. Cis elements occur within, but are not limited to promoters, and promoter modulating sequences (inducible elements). Cis elements can be identified using known cis elements as a target sequence or target motif in the BLAST programs of the present invention.

Promoters of the present invention include homologues of cis elements known to effect gene regulation that show homology with the nucleic acid molecules of the present invention. These cis elements include, but are not limited to, oxygen responsive cis elements (Cowen et al., *J Biol. Chem.* 268(36):26904-26910 (1993) the entirety of which is herein incorporated by reference), light regulatory elements (Bruce et al., *Plant Cell* 2 (11):1081-1089 (1990); Bruce et al., *EMBO J.* 10:3015-3024 (1991); Rocholl et al., *Plant Sci.* 97:189-198 (1994); Block et al., *Proc. Natl. Acad. Sci. USA* 87:5387-5391 (1990); Giuliano et al., *Proc. Natl. Acad. Sci. USA* 85:7089-7093 (1988); Staiger et al., *Proc. Natl. Acad. Sci. USA* 86:6930-6934 (1989); Izawa et al., *Plant Cell* 6:1277-1287 (1994); Menkens et al., *Trends in Biochemistry* 20:506-510 (1995); Foster et al., *FASEB J.* 8:192-200 (1994); Plesse et al., *Mol Gen Gene* 254:258-266 (1997); Green et al., *EMBO J.* 6:2543-2549 (1987); Kuhlemeier et al., *Ann. Rev Plant Physiol.* 38:221-257 (1987); Villain et al., *J. Biol. Chem.* 271:32593-32598 (1996); Lam et al., *Plant Cell* 2:857-866 (1990); Gilmartin et al., *Plant Cell* 2:369-378 (1990); Datta et al., *Plant Cell* 1:1069-1077 (1989); Castresana et al., *EMBO J.* 7:1929-1936 (1988); Ueda et al., *Plant Cell* 1:217-227 (1989); Terzaghi et al., *Annu. Rev. Plant Physiol. Plant Mol. Biol.* 46:445-474 (1995); Tjaden et al., *Plant Cell* 6:107-118 (1994); Tjaden et al., *Plant Physiol.* 108:1109-1117 (1995); Ngai et al., *Plant J.* 12:1021-1234 (1997), all of which are herein incorporated by reference in their entirety), elements responsive to gibberellin, (Muller et al., *J. Plant Physiol.* 145:606-613 (1995); Croissant et al., *Plant Science* 116:27-35 (1996); Lohmer et al., *EMBO J.* 10:617-624 (1991); Rogers et al., *Plant Cell* 4:1443-1451 (1992); Lanahan et al., *Plant Cell* 4:203-211 (1992); Skriver et al., *Proc. Natl. Acad. Sci. USA* 88:7266-7270 (1991); Gilmartin et al., *Plant Cell* 2:369-378 (1990); Huang et al., *Plant Mol. Biol.* 14:655-668 (1990); Gubler et al., *Plant Cell* 7:1879-1891 (1995), all of which are herein incorporated by reference in their entirety), elements responsive to abscisic acid, (Busk et al., *Plant Cell* 9:2261-2270 (1997); Guiltinan et al., *Science* 250:267-270 (1990); Shen et al., *Plant Cell* 7:295-307 (1995); Shen et al., *Plant Cell* 8:1107-1119 (1996); Seo et al., *Plant Mol. Biol.* 27:1119-1131 (1995); Marcotte et al., *Plant Cell* 1:969-976 (1989); Shen et al., *Plant Cell* 7:295-307 (1995); Iwasaki et al., *Mol Gen Genet* 247:391-398 (1995); Hattori et al., *Genes Dev.* 6:609-618 (1992); Thomas et al., *Plant Cell* 5:1401-1410 (1993), all of which are herein incorporated by reference in their entirety), elements similar to abscisic acid responsive elements, (Ellerstrom et al., *Plant Mol. Biol.* 32:1019-1027 (1996), the entirety of which is herein incorporated by reference), auxin responsive elements (Liu et al., *Plant Cell* 6:645-657 (1994); Liu et al., *Plant Physiol.* 115:397-407 (1997); Kosugi et al., *Plant J.* 7:877-886 (1995); Kosugi et al., *Plant Cell* 9:1607-1619 (1997); Ballas et al., *J. Mol. Biol.* 233:580-596 (1993), all of which are herein incorporated by reference in their entirety), a cis element responsive to methyl jasmonate treatment (Beaudoin and Rothstein, *Plant Mol. Biol.* 33:835-846 (1997), the entirety of which is herein incorporated by reference), a cis element responsive to abscisic acid and stress response (Straub et al., *Plant Mol. Biol.* 26:617-630 (1994), the entirety of which is herein incorporated by reference), ethylene responsive cis elements (Itzhaki et al., *Proc. Natl. Acad. Sci. USA* 91:8925-8929 (1994); Montgomery et al., *Proc. Natl. Acad. Sci. USA* 90:5939-5943 (1993); Sessa et al., *Plant Mol. Biol.* 28:145-153 (1995); Shinshi et al., *Plant Mol. Biol.* 27:923-932 (1995), all of which are herein incorporated by reference in their entirety), salicylic acid cis responsive elements, (Strange et al., *Plant J.* 11:1315-1324 (1997); Qin et al., *Plant Cell* 6:863-874 (1994), both of which are herein incorporated by reference in their entirety), a cis element that responds to water stress and abscisic acid (Lam et al., *J. Biol. Chem.* 266:17131-17135 (1991); Thomas et al., *Plant Cell* 5:1401-1410 (1993); Pla et al., *Plant Mol Biol* 21:259-266 (1993), all of which are herein incorporated by reference in their entirety), a cis element essential for M phase-specific expression (Ito et al., *Plant Cell* 10:331-341 (1998), the entirety of which is herein incorporated by reference), sucrose responsive elements (Huang et al., *Plant Mol. Biol.* 14:655-668 (1990); Hwang et al., *Plant Mol Biol* 36:331-341 (1998); Grierson et al., *Plant J.* 5:815-826 (1994), all of which are herein incorporated by reference in their entirety), heat shock response elements (Pelham et al., *Trends Genet.* 1:31-35 (1985), the entirety of which is herein incorporated by reference), elements responsive to auxin and/or salicylic acid and also reported for light regulation (Lam et al., *Proc. Natl. Acad. Sci. USA* 86:7890-7897 (1989); Benfey et al., *Science* 250:959-966 (1990), both of which are herein incorporated by reference in their entirety), elements responsive to ethylene and salicylic acid (Ohme-Takagi et al., *Plant Mol. Biol.* 15:941-946 (1990), the entirety of which is herein incorporated by reference), elements responsive to wounding and abiotic stress (Loake et al., *Proc. Natl. Acad. Sci. USA* 89:9230-9234 (1992); Mhiri et al., *Plant Mol. Biol.* 33:257-266 (1997), both of which are herein incorporated by reference in their entirety), antioxidant response elements (Rushmore et al., *J. Biol. Chem.* 266:11632-11639; Dalton et al., *Nucleic Acids Res.* 22:5016-5023 (1994), both of which are herein incorporated by reference in their entirety), Sph elements (Suzuki et al., *Plant Cell* 9:799-807 1997), the entirety of which is herein incorporated reference), Elicitor responsive elements, (Fukuda et al., *Plant Mol. Biol.* 34:81-87 (1997); Rushton et al., *EMBO J.* 15:5690-5700 (1996), both of which are herein incorporated by reference in their entirety), metal responsive elements (Stuart et al., *Nature* 317:828-831 (1985); Westin et al., *EMBO J.* 7:3763-3770 (1988); Thiele et al., *Nucleic Acids Res.* 20:1183-1191 (1992); Faisst et al., *Nucleic Acids Res.* 20:3-26 (1992), all of which are herein incorporated by reference in their entirety), low temperature responsive elements, (Baker et al., *Plant Mol. Biol.* 24:701-713 (1994); Jiang et al., *Plant Mol. Biol.* 30:679-684 (1996); Nordin et al., *Plant Mol. Biol.* 21:641-653 (1993); Zhou et al., *J. Biol. Chem.* 267:23515-23519 (1992), all of which are herein incorporated by reference in their entirety), drought responsive elements, (Yamaguchi et al., *Plant Cell* 6:251-264 (1994); Wang et al., *Plant Mol. Biol.* 28:605-617 (1995); Bray E A, *Trends in Plant Science* 2:48-54 (1997), all of which are herein incorporated by reference in their entirety); enhancer elements for glutenin, (Colot et al., *EMBO J.* 6:3559-3564 (1987); Thomas et al., *Plant Cell* 2:1171-1180 (1990); Kreis et al., *Philos. Trans. R. Soc. Lond., B* 314:355-365 (1986), all of which are herein incorporated by reference in their entirety), light-independent regulatory elements, (Lagrange et al., *Plant Cell* 9:1469-1479 (1997); Villain et al., *J. Biol. Chem.* 271:32593-32598 (1996), both of which are herein incorporated by reference in their entirety), OCS enhancer elements, (Bouchez et al., *EMBO J.* 8:4197-4204 (1989); Foley et al., *Plant J.* 3:669-679 (1993), both of which are herein incorporated by reference in their entirety), ACGT elements, (Foster et al., *FASEB J.* 8:192-200 (1994); Izawa et al., *Plant Cell* 6:1277-1287 (1994); Izawa et al., *J. Mol. Biol.* 230:1131-1144 (1993), all of which are herein incorporated by reference in their entirety), negative cis elements in plastid related genes, (Zhou et al., *J. Biol. Chem.* 267:23515-23519 (1992); Lagrange et al., *Mol. Cell Biol.* 13:2614-2622 (1993); Lagrange et al., *Plant Cell* 9:1469-1479 (1997); Zhou et al., *J. Biol. Chem.* 267:23515-23519 (1992), all of which are herein incorporated by reference in their entirety), prolamin box elements, (Forde et al., *Nucleic Acids Res.* 13:7327-7339 (1985); Colot et al., *EMBO J.* 6:3559-3564 (1987); Thomas et al., *Plant Cell* 2:1171-1180 (1990); Thompson et al., *Plant Mol. Biol.* 15:755-764 (1990); Vicente et al., *Proc. Natl. Acad. Sci. USA* 94:7685-7690 (1997), all of which are herein incorporated by reference in their entirety), elements in enhancers from the IgM heavy chain gene (Gillies et al., *Cell* 33:717-728 (1983); Whittier et al., *Nucleic Acids Res.* 15:2515-2535 (1987), both of which are herein incorporated by reference in their entirety).

(iii) Nucleic Acid Molecules Comprising Genes or Fragments Thereof

Nucleic acid molecules of the present invention can comprise one or more genes or fragments thereof. Such genes or fragments thereof include homologues of known genes or protein coding regions in other organisms or genes or fragments thereof that elicit only limited or no matches with known genes or protein coding regions.

Genomic sequences can be screened for the presence of protein homologues or genes utilizing one or a number of different search algorithms have that been developed, one example of which are the suite of programs referred to as BLAST programs. Other examples of suitable programs that can be utilized are known in the art, several of which are described above in the Background and under the section titled "Uses of the Agents of the Invention." In addition, unidentified reading frames may be screened for protein coding regions by prediction software such as GenScan, which is located at the website gnomic.standford.edu/GENSCAN-W.html.

In a preferred embodiment of the present invention, the rice protein or fragment thereof of the present invention is a homologue of another plant protein. In another preferred embodiment of the present invention, the rice protein or fragment thereof is a homologue of a plant protein. In another preferred embodiment of the present invention, the rice protein or fragment thereof of the present invention is a homologue of a cereal protein. In another preferred embodiment of the present invention, the rice protein or fragment thereof of the present invention is a homologue of a fungal protein. In another preferred embodiment of the present invention, the rice protein or fragment thereof of the present invention is a homologue of a mammalian protein. In another preferred embodiment of the present invention, the rice protein or fragment thereof of the present invention is a homologue of a bacterial protein. In another preferred embodiment of the present invention, the rice protein or fragment thereof of the present invention is a homologue of an algal protein.

In a preferred embodiment of the present invention, the rice protein or fragments thereof or nucleic acid molecule or fragment thereof has a BLAST score of more than 200, preferably a BLAST score of more than 300, even more preferably a BLAST score of more than 400 with its homologue.

In another preferred embodiment of the present invention, the nucleic acid molecule encoding the rice protein or fragment thereof and/or nucleic acid molecule or fragment thereof exhibits a % identity with its homologue of between about 25% and about 40%, more preferably of between about 40 and about 70%, even more preferably of between about 70% and about 90%, and even more preferably between about 90% and 99%. In another preferred embodiment, of the present invention, the nucleic acid molecule encoding the rice protein or fragment thereof exhibits a % identity with its homologue of 100%.

In a preferred embodiment of the present invention, the rice protein or fragment thereof or nucleic acid molecule or fragment thereof exhibits a % coverage of between about 0% and about 33%, more preferably of between about 34% and about 66%, and even more preferably of between about 67% and about 100%.

Genomic sequences can be screened for the presence of proteins utilizing one or a number of different search algorithms have that been developed, one example of which are the suite of programs referred to as BLAST programs. Other examples of suitable programs that can be utilized are known in the art, several of which are described above in the Background. Nucleic acid molecules of the present invention also include non-rice homologues. Preferred non-rice homologues are selected from the group consisting of alfalfa, *Arabidopsis* barley, *Brassica*, broccoli, cabbage, citrus, cotton, garlic, oat, oilseed rape, onion, canola, flax, an ornamental plant, maize, pea, peanut, pepper, potato, rye, sorghum, soybean, strawberry, sugarcane, sugarbeet, tomato, wheat, poplar, pine, fir, eucalyptus, apple, lettuce, lentils, grape, banana, tea, turf grasses, sunflower, oil palm, and *Phaseolus*.

In a preferred embodiment, nucleic acid molecules having SEQ ID NO: 1 through SEQ ID NO: 69652 or complements and fragments of either or other nucleic acid molecules of the present invention can be utilized to obtain such homologues.

The degeneracy of the genetic code, which allows different nucleic acid sequences to code for the same protein or peptide, is known in the literature. (U.S. Pat. No. 4,757,006, the entirety of which is herein incorporated by reference). As used herein a nucleic acid molecule is degenerate of another nucleic acid molecule when the nucleic acid molecules encode for the same amino acid sequences but comprise different nucleotide sequences. An aspect of the present invention is that the nucleic acid molecules of the present invention include nucleic acid molecules that are degenerate of those set forth in SEQ ID NO: 1 through to SEQ ID NO: 69652 or complements thereof.

In a further aspect of the present invention, one or more of the nucleic acid molecules of the present invention differ in nucleic acid sequence from those encoding a rice protein or fragment thereof in SEQ ID NO: 1 through SEQ ID NO: 69652 or complements thereof due to the degeneracy in the genetic code in that they encode the same protein but differ in nucleic acid sequence. In another further aspect of the present invention, one or more of the nucleic acid molecules of the present invention differ in nucleic acid sequence from those encoding a rice homologue or fragment thereof in SEQ ID NO: 1 through SEQ ID NO: 69652 or complements thereof due to the fact that the different nucleic acid sequence encodes a protein having one or more conservative amino acid residues. In such amino acid sequences, one or more amino acids in the fundamental sequence are substituted with another amino acid(s), the charge and polarity of which are similar to that of the native amino acid, i.e., a conservative amino acid substitution, resulting in a silent change.

Substitutes for an amino acid within the fundamental polypeptide sequence can be selected from other members of the class to which the naturally occurring amino acid belongs. Amino acids can be divided into the following four groups: (1) acidic amino acids, (2) basic amino acids, (3) neutral polar amino acids, and (4) neutral nonpolar amino acids. Representative amino acids within these various groups include, but are not limited to, (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, cystine, tyrosine, asparagine, and glutamine; and (4) neutral nonpolar (hydrophobic) amino acids such as alanine, leucine, isoleucine, valine, proline, phenylalanine, tryptophan, and methionine.

Conservative amino acid changes within the fundamental polypeptides sequence can be made by substituting one amino acid within one of these groups with another amino acid within the same group.

It is also understood that certain amino acids may be substituted for other amino acids in a protein structure without appreciable loss of interactive binding capacity with structures such as, for example, antigen-binding regions of antibodies or binding sites on substrate molecules. Because it is the interactive capacity and nature of a protein that defines that protein's biological functional activity, certain amino acid sequence substitutions can be made in a protein sequence and, of course, its underlying DNA coding sequence and, nevertheless, obtain a protein with like properties.

In making such changes, the hydropathic index of amino acids may be considered. The importance of the hydropathic amino acid index in conferring interactive biological function on a protein is generally understood in the art (Kyte and Doolittle, *J. Mol. Biol.* 157, 105-132 (1982), herein incorporated by reference in its entirety). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

Each amino acid has been assigned a hydropathic index on the basis of its hydrophobicity and charge characteristics (Kyte and Doolittle, *J. Mol. Biol.* 157, 105-132 (1982); these are isoleucine (+4.5), valine (+4.2), leucine (+3.8), phenylalanine (+2.8), cysteine/cystine (+2.5), methionine (+1.9), alanine (+1.8), glycine (−0.4), threonine (−0.7), serine (−0.8), tryptophan (−0.9), tyrosine (−1.3), proline (−1.6), histidine (−3.2), glutamate (−3.5), glutamine (−3.5), aspartate (−3.5), asparagine (−3.5), lysine (−3.9), and arginine (−4.5).

It is known in the art that certain amino acid may be substituted by other amino acids having a similar hydropathic index or score and still result in a protein with similar biological activities, i.e., still obtain a biologically functional equivalent protein. In making such changes, the substitution of amino acids whose hydropathic indices are within ±2 is preferred, those which are within ±1 are particularly preferred, and those within ±0.5 are even more particularly preferred.

It is also understood in the art that the substitution of like amino acids can be made effectively on the basis of hydrophilicity. U.S. Pat. No. 4,554,101, incorporated herein by reference in its entirety, states that the greatest local average hydrophilicity of a protein, as govern by the hydrophilicity of its adjacent amino acids, correlates with a biological property of the protein.

As detailed in U.S. Pat. No. 4,554,101, the following hydrophilicity values have been assigned to amino acid residues: arginine (+3.0), lysine (+3.0), aspartate (+3.0±1), glutamate (+3.0±1), serine (+0.3), asparagine (+0.2), glutamine (+0.2), glycine (0), threonine (−0.4), proline (−0.5±1), alanine (−0.5), histidine (−0.5), cysteine (−1.0), methionine (−1.3), valine (−1.5), leucine (−1.8), isoleucine (−1.8), tyrosine (−2.3), phenylalanine (−2.5), and tryptophan (−3.4).

It is known in the art that certain amino acid may be substituted by other amino acids having a similar hydrophilicity value and still result in a protein with similar biological activities, i.e., still obtain a biologically functional equivalent protein. In making such changes, the substitution of amino acids whose hydrophilicity values are within ±2 is preferred, those which are within ±1 are particularly preferred, and those within ±0.5 are even more particularly preferred.

(iv) Nucleic Acid Molecules Comprising Introns and/or Intron/Exon Junctions

Nucleic acid molecules of the present invention can comprise an intron and/or one or more intron/exon junction. Sequences of the present invention can be screened for introns and intron/exon junctions utilizing one or a number of different search algorithms that have that been developed, one example of which are the suite of programs referred to as BLAST programs. Other examples of suitable programs that can be utilized are known in the art, several of which are described above in the Background and in the section entitled "Uses of the Agents of the Present Invention."

(b) Protein and Peptide Molecules

A class of agents includes one or more of the protein or peptide molecules, including those encoded by nucleic acid molecules disclosed in Table 1 of U.S. application Ser. No. 09/620,392 filed Jul. 19, 2000 (the entirety of which is incorporated by reference herein), fragments thereof or complements thereof or one or more of the proteins encoded by a nucleic acid molecule or fragment thereof or peptide molecules encoded by other nucleic acid agents of the present invention. Protein and peptide molecules can be identified using known protein or peptide molecules as a target sequence or target motif in the BLAST programs of the present invention. In a preferred embodiment, the protein or peptide molecules of the present invention are derived from rice and more preferably *Oryza sativa* L (japonica type), more preferably *Oryza sativa* L (japonica type), cv. Nipponbare.

As used herein, the term "protein molecule" or "peptide molecule" includes any molecule that comprises five or more amino acids. It is well known in the art that proteins or peptides may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, ornithine, homocysteine, and homoserine.

One or more of the protein or fragments of peptide molecules may be produced via chemical synthesis, or more preferably, by expression in a suitable bacterial or eukaryotic host. Suitable methods for expression are described by Sambrook et al., *Molecular Cloning, A Laboratory Manual*, 2nd Edition, Cold Spring Harbor Press, Cold Spring Harbor, N.Y. (1989), or similar texts.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion protein or peptide molecules of the present invention are preferably produced via recombinant means.

Another class of agents comprises protein or peptide molecules encoded by SEQ ID NO: 1 through SEQ ID NO: 69652 or complements thereof or, fragments or fusions thereof in which conservative, non-essential, or not relevant, amino acid residues have been added, replaced, or deleted. An example of such a homologue is the homologue protein of all non-rice plant species, including but not limited to alfalfa, barley, *Brassica*, broccoli, cabbage, citrus, cotton, garlic, oat, oilseed rape, onion, canola, flax, an ornamental plant, pea, peanut, pepper, potato, maize, rye, sorghum, soybean, strawberry, sugarcane, sugarbeet, tomato, wheat, poplar, pine, fir, eucalyptus, apple, lettuce, peas, lentils, grape, banana, wheat, tea, turf grasses, etc. Particularly preferred non-rice plants to utilize for the isolation of homologues would include alfalfa, barley, cotton, oat, oilseed rape, maize, canola, ornamentals, sugarcane, sugarbeet, tomato, potato, wheat, and turf grasses. Such a homologue can be obtained by any of a variety of methods. Most preferably, as indicated above, one or more of the disclosed sequences (SEQ ID NO: 1 through SEQ ID NO: 69652 or complements thereof) will be used to define a pair of primers that may be used to isolate the homologue-encoding nucleic acid molecules from any desired species. Such molecules can be expressed to yield homologues by recombinant means. A homologue can also be generated by molecular evolution or DNA shuffling techniques, so that the molecule retains at least one function or structure characteristic of the original protein (see, for example, U.S. Pat. No. 5,811,238).

(c) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules. In a preferred embodiment the antibodies of the present invention bind to proteins derived from rice and more preferably bind to proteins or fragments thereof of rice In a preferred embodiment the nucleic acid molecules of the present invention are derived from rice and more preferably *Oryza sativa* L (japonica type), more preferably *Oryza sativa* L (japonica type), cv. Nipponbare.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal, and may comprise intact immunoglobulins, or antigen binding portions of immunoglobulins (such as (F(ab'), F(ab')₂ fragments), or single-chain immunoglobulins producible, for example, via recombinant means). It is understood that practitioners are familiar with the standard resource materials which describe specific conditions and procedures for the construction, manipulation and isolation of antibodies (see, for example, Harlow and Lane, *Antibodies: A Laboratory Manual*, Cold Spring Harbor Press, Cold Spring Harbor, N.Y. (1988), the entirety of which is herein incorporated by reference).

Murine monoclonal antibodies are particularly preferred. BALB/c mice are preferred for this purpose, however, equivalent strains may also be used. The animals are preferably immunized with approximately 25 μg of purified protein (or fragment thereof) that has been emulsified in a suitable adjuvant (such as TiterMax adjuvant (Vaxcel, Norcross, Ga.)). Immunization is preferably conducted at two intramuscular sites, one intraperitoneal site, and one subcutaneous site at the base of the tail. An additional i.v. injection of approximately 25 μg of antigen is preferably given in normal saline three weeks later. After approximately 11 days following the second injection, the mice may be bled and the blood screened for the presence of anti-protein or peptide antibodies. Preferably, a direct binding Enzyme-Linked Immunoassay (ELISA) is employed for this purpose.

More preferably, the mouse having the highest antibody titer is given a third i.v. injection of approximately 25 μg of the same protein or fragment. The splenic leukocytes from this animal may be recovered 3 days later, and are then permitted to fuse, most preferably, using polyethylene glycol, with cells of a suitable myeloma cell line (such as, for example, the P3X63Ag8.653 myeloma cell line). Hybridoma cells are selected by culturing the cells under "HAT" (hypoxanthine-aminopterin-thymine) selection for about one week. The resulting clones may then be screened for their capacity to produce monoclonal antibodies ("mAbs"), preferably by direct ELISA.

In one embodiment, anti-protein or peptide monoclonal antibodies are isolated using a fusion of a protein, protein fragment, or peptide of the present invention, or conjugate of a protein, protein fragment, or peptide of the present invention, as immunogens. Thus, for example, a group of mice can be immunized using a fusion protein emulsified in Freund's complete adjuvant (e.g., approximately 50 μg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted, and immune splenocytes are isolated over a ficoll gradient. The isolated splenocytes are fused, using polyethylene glycol with BALB/c-derived HGPRT (hypoxanthine guanine phosphoribosyl transferase) deficient P3x63xAg8.653 plasmacytoma cells. The fused cells are plated into 96-well microtiter plates and screened for hybridoma fusion cells by their capacity to grow in culture medium supplemented with hypothanthine, aminopterin and thymidine for approximately 2-3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbors. Desirably, the fusion plates are screened several times since the rates of hybridoma growth vary. In a preferred sub-embodiment, a different antigenic form of immunogen may be used to screen the hybridoma. Thus, for example, the splenocytes may be immunized with one immunogen, but the resulting hybridomas can be screened using a different immunogen. It is understood that any of the protein or peptide molecules of the present invention may be used to raise antibodies.

As discussed below, such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

It is understood that any of the agents of the present invention can be substantially purified and/or be biologically active and/or recombinant.

Exemplary Uses of the Agents of the Invention

Nucleic acid molecules and fragments thereof of the present invention may be employed for genetic mapping studies using linkage analysis (genetic markers). A genetic linkage map shows the relative locations of specific DNA markers along a chromosome. Maps are used for the identification of genes associated with genetic diseases or phenotypic traits, comparative genomics, and as a guide for physical mapping. Through genetic mapping, a fine scale linkage map can be developed using DNA markers, and, then, a genomic DNA library of large-sized fragments can be screened with molecular markers linked to the desired trait. In a preferred embodiment of the present invention, the genomic library screened with the nucleic acid molecules of the present invention is a genomic library of rice.

Mapping marker locations is based on the observation that two markers located near each other on the same chromosome will tend to be passed together from parent to offspring. During gamete production, DNA strands occasionally break and rejoin in different places on the same chromosome or on the homologous chromosome. The closer the markers are to each other, the more tightly linked and the less likely a recombination event will fall between and separate them. Recombination frequency thus provides an estimate of the distance between two markers.

In segregating populations, target genes have been reported to have been placed within an interval of 5-10 cM with a high degree of certainty (Tanksley et al., *Trends in Genetics* 11(2): 63-68 (1995), the entirety of which is herein incorporated by reference). The markers defining this interval are used to screen a larger segregating population to identify individuals derived from one or more gametes containing a crossover in the given interval. Such individuals are useful in orienting other markers closer to the target gene. Once identified, these individuals can be analyzed in relation to all molecular markers within the region to identify those closest to the target.

Markers of the present invention can be employed to construct linkage maps and to locate genes with qualitative and quantitative effects. The genetic linkage of additional marker molecules can be established by a genetic mapping model such as, without limitation, the flanking marker model reported by Lander and Botstein, *Genetics*, 121:185-199 (1989), and the interval mapping, based on maximum likelihood methods described by Lander and Botstein, *Genetics*, 121:185-199 (1989), the entirety of which is herein incorporated by reference and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990)). Additional software includes Qgene, Version 2.23 (1996), Department of Plant Breeding and Biometry, 266 Emerson Hall, Cornell University, Ithaca, N.Y., the manual of which is herein incorporated by reference in its entirety). Use of the Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics*, 121:185-199 (1989), the entirety of which is herein incorporated by reference and further described by Arús and Moreno-González, *Plant Breeding*, Hayward, Bosemark, Romagosa (eds.) Chapman & Hall, London, pp. 314-331 (1993).

Additional models can be used. Many modifications and alternative approaches to interval mapping have been reported, including the use of non-parametric methods (Kruglyak and Lander, *Genetics*, 139:1421-1428 (1995), the entirety of which is herein incorporated by reference). Multiple regression methods or models can be also be used, in which the trait is regressed on a large number of markers (Jansen, *Biometrics in Plant Breed*, van Oijen, Jansen (eds.) Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994). Procedures combining interval mapping with regression analysis, whereby the phenotype is regressed onto a single putative QTL at a given marker interval, and at the same time onto a number of markers that serve as 'cofactors,' have been reported by Jansen and Stam, *Genetics*, 136:1447-1455 (1994) and Zeng, *Genetics*, 136:1457-1468 (1994). Generally, the use of cofactors reduces the bias and sampling error of the estimated QTL positions (Utz and Melchinger, *Biometrics in Plant Breeding*, van Oijen, Jansen (eds.) Proceedings of the Ninth Meeting of the Eucarpia Section Biometrics in Plant Breeding, The Netherlands, pp. 195-204 (1994), thereby improving the precision and efficiency of QTL mapping (Zeng, *Genetics*, 136:1457-1468 (1994). These models can be extended to multi-environment experiments to analysis genotype-environment interactions (Jansen et al., *Theo. Appl. Genet.* 91:33-37 (1995).

Selection of an appropriate mapping population is important to map construction. The choice of appropriate mapping population depends on the type of marker systems employed (Tanksley et al., J. P. *Gustafson and R. Appels* (eds.), Plenum Press, New York, pp. 157-173 (1988), the entirety of which is herein incorporated by reference). Consideration must be given to the source of parents (adapted vs. exotic) used in the mapping population. Chromosome pairing and recombination rates can be severely disturbed (suppressed) in wide crosses (adapted×exotic) and generally yield greatly reduced linkage distances. Wide crosses will usually provide segregating populations with a relatively large array of polymorphisms when compared to progeny in a narrow cross (adapted×adapted).

An $F_2$ population is the first generation of selfing after the hybrid seed is produced. Usually a single $F_1$ plant is selfed to generate a population segregating for all the genes in Mendelian (1:2:1) fashion. Maximum genetic information is obtained from a completely classified $F_2$ population using a codominant marker system (Mather, Measurement of Linkage in Heredity: Methuen and Co., (1938), the entirety of which is herein incorporated by reference). In the case of dominant markers, progeny tests (e.g., $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g., disease resistance) or where trait expression is controlled by a QTL. Segregation data from progeny test populations (e.g., $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequilibrium).

Recombinant inbred lines (RIL) (genetically related lines; usually $>F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter, *Proc. Natl. Acad. Sci. USA* 89:1477-1481 (1992)). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci. USA* 89:1477-1481 (1992)). Information obtained from backcross populations using either codominant or dominant makers is less than that obtained from $F_2$ populations because one, rather than two, recombinant gametes are sampled per plant. Backcross populations, however, are more informative (at low marker saturation) when compared to RILs as the distance between linked loci increases in RIL populations (i.e., about 0.15% recombination). Increased recombination can be beneficial for resolution of tight linkages, but may be undesirable in the construction of maps with low marker saturation.

Near-isogenic lines (NIL)(created by many backcrosses to produce an array of individuals that are nearly identical in genetic composition except for the trait or genomic region under interrogation) can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., *Proc. Natl. Acad. Sci. USA* 88:9828-9832 (1991)). In BSA, two bulked DNA samples are drawn from a segregating population originating from a single cross. These bulks contain individuals that are identical for a particular trait (resistant or susceptible to particular disease) or genomic region but arbitrary at unlinked regions (i.e., heterozygous). Regions unlinked to the target region will not differ between the bulked samples of many individuals in BSA.

It is understood that one or more of the nucleic acid molecules of the present invention may in one embodiment be used as markers in genetic mapping. In a preferred embodiment, nucleic acid molecules of the present invention may in one embodiment be used as markers with rice.

The nucleic acid molecules of the present invention may be used for physical mapping. Physical mapping, in conjunction with linkage analysis, can enable the isolation of genes. Physical mapping has been reported to identify the markers closest in terms of genetic recombination to a gene target for cloning. Once a DNA marker is linked to a gene of interest, the chromosome walking technique can be used to find the genes via overlapping clones. For chromosome walking, random molecular markers or established molecular linkage maps are used to conduct a search to localize the gene adjacent to one or more markers. A chromosome walk (Bukanov et al., *Mol. Microbiol,* 11:509-523 (1994); Birkenbihl et al., *Nucleic Acids Res.* 17:5057-5069 (1989); Wenzel et al., *Nucleic Acids Res.* 16:8323-8336, (1988), all of which are herein incorporated by reference in their entirety) is then initiated from the closest linked marker. Starting from the selected clones, labeled probes specific for the ends of the insert DNA are synthesized and used as probes in hybridizations against a representative library. Clones hybridizing with one of the probes are picked and serve as templates for the synthesis of new probes; by subsequent analysis, contigs are produced.

The degree of overlap of the hybridizing clones used to produce a contig can be determined by comparative restriction analysis. Comparative restriction analysis can be carried out in different ways all of which exploit the same principle; two clones of a library are very likely to overlap if they contain a limited number of restriction sites for one or more restriction endonucleases located at the same distance from each other. The most frequently used procedures are, finger-printing (Coulson et al., *Proc. Natl. Acad. Sci. USA* 83:7821-7821, (1986); Knott et al., *Nucleic Acids Res.* 16:2601-2612 (1988); Eiglmeier et al., *Mol. Microbiol.* 7(2): 197-206 (1993), all of which are herein incorporated by reference in their entirety), restriction fragment mapping (Smith and Birnstiel, *Nucleic Acids Res.* 3:2387-2398 (1976), the entirety of which is herein incorporated by reference), or the "landmarking" technique (Charlebois et al., *J. Mol. Biol.* 222:509-524 (1991), the entirety of which is herein incorporated by reference).

To generate a physical map of a genome with BACs using the fingerprinting technique, a BAC library containing a number of clones equivalent to 4×-20× haploid genome can be used. (Zhang and Wing, *Plant Mol. Bio.* 35:115-127 (1997)). For example, BAC DNA can be purified with the conventional alkaline lysis procedure as used for plasmid DNA purification, digested with the restriction enzyme used for construction of the BAC libraries and end-labeled with $^{32}$P-dATP, digested with Sau3AI and fractionated on a denaturing polyacrylamide gel. The gel is dried to chromatography paper and exposed to X-ray film. Fingerprints are scanned and then converted into database records, according to the positions of each band relative to the bands of the closest molecular-weight marker on a gel. The incoming database of finger-prints are first compared against each other to assemble contigs if overlapped, and then compared against all existing databases to place the incoming BACs and BAC contigs in established contigs if overlapped. The physical length of a contig in kb is estimated according to the number of restriction sites of the enzyme used for the first digestion prior to fragment end labeling.

Restriction analysis of a certain clone can be carried out, for example, according to a method originally described by Smith and Berstiel, *Nucleic Acids Res.* 3:2387-2398 (1976). First, the number and size of cloned restriction fragments to be mapped are determined by complete digestion and agarose gel electrophoresis. Then, the clone is linearized at a unique restriction site outside of the cloned DNA. Aliquots of the linearized molecules are digested to different extents with the enzyme selected for mapping. These partially cut samples are separated on agarose gels, blotted, and hybridized to a labeled fragment of vector DNA. This probe is derived entirely from one side or the other of the unique site used to linearize the clone.

The results show a ladder of DNA fragments that have the same unique end. By repeating these analyses in pairs with all the neighboring intermediate DNA fragments, the correct order of restriction fragments as well as the orientation of the cloned insert can be deduced. The order of restriction fragments produced by restriction enzymes other than the cloning enzyme can be determined similarly. Fragment data from different enzymes are then combined by a computer program and compared with the alignments of other clones of the library (Kohara et al., *Cell* 50:495-508 (1987), the entirety of which is herein incorporated by reference).

The landmarking technique can be carried out without any labeling and relies on agarose gel analysis. Clones are first digested preferably with a 6 bp specific endonuclease A, if possible with the original clone enzyme. Clones are then digested with a second endonuclease B. Endonuclease B is chosen based on its ability to cut rarely in the genome, for example, on average only once in 30 kbp. Of the fragments generated by digestion of one clone with enzyme A, statistically only a small number (between zero and three fragments) will also be cut by enzyme B. The very specific pattern of those fragments which are produced by double digestion are easily recognized. Any of these fragments which have a restriction site for the rarely cutting endonuclease is called a "landmark" Generally one common landmark is sufficient for defining two overlapping clones.

Alternatively to chromosome walking and the associated comparative restriction analyses methods, chromosome landing also has been reported to be used to locate a gene of interest (Tanksley et al., *Trends in Genetics* 11(2):63-68 (1995), the entirety of which is herein incorporated by reference). For chromosome landing, a DNA marker is isolated at a physical distance from the targeted gene. High resolution linkage analysis is used to identify such a marker that cosegregates with the gene. The marker is isolated at a distance that is less than the average insert size of the genomic library used for clone isolation. The DNA marker is then used to screen the library and isolate (or "land" on) the clone containing the gene without chromosome walking. Genome coverage of a library can also be determined by cross-hybridization of individual large insert clones by screening a BAC library with single copy RFLP markers distributed randomly across the genome by hybridization. To assure accuracy of the physical map, the markers should be single-copy or of single-locus origin, if multiple-copy.

Chromosome landing of large-insert clones using chromosome-specific DNA markers such as STSs microsatellites, RFLPs, or other markers can correlate physical and genetic maps (Zwick et al., *Genetics* 148:1983-1992 (1998), the entirety of which is herein incorporated by reference). These strategies include chromosome landing of BACs containing markers or BAC contigs by BAC-FISH (Fluorescent In Situ Hybridization), a technique that involves tagging the DNA marker with an observable label. BAC clones giving positive hybridization signals are individually analyzed by FISH to metaphase chromosome spreads. The location of the labeled probe can be detected after it binds to its complementary DNA strand in an intact chromosome. The FISH of a BAC selected from a BAC contig will directly place the BAC contig to a specific chromosome region and establish a linkage relationships of the BAC contig to another BAC contig.

Markers have been used in physical mapping studies with BAC libraries made from plant genomes. Such mapping studies have been carried out in rice (Kim et al., *Genomics* 34:213-218 (1996); Hang, *Plant Mol. Biol.* 35:129-133 (1997); Zhang and Wing, *Plant Mol. Bio.* 35:115-127 (1997); Chen et al., *Proc. Natl. Acad. Sci. USA* 94:3431-3435 (1997); Wang et al., *Plant J.* 7:525-533 (1995), all of which are herein incorporated by reference in their entirety), sorghum (Zwick et al., *Genetics* 148:1983-1992 (1998); Zhang, et al., *Molecular Breeding* 2:11-24 (1996), both of which are herein incorporated by reference in their entirety) maize, (Chen, et al., *Proc. Natl. Acad. Sci. USA* 94:3431-3435 (1997)), and *Arabidopsis* (Kim, et al., *Genomics* 34:213-218 (1996), the entirety of which is herein incorporated by reference).

Repetitive elements have been used in physical mapping in cereals (Ananiev, et al., *Proc. Natl. Acad. Sci. USA* 95:13073-8 (1998); McLean et al., *Mol Gen Genet* 253:687-694 (1997), both of which are herein incorporated by reference in their entirety).

It is understood that the nucleic acid molecules of the present invention may in one embodiment be used in physical mapping. In a preferred embodiment, nucleic acid molecules of the present invention may in one embodiment be used in the physical mapping of rice.

Nucleic acid molecules of the present invention can be used in comparative mapping (physical and genetic) and to isolate molecules from other cereals based on the syntenic relationship between cereals. Comparative mapping within families provides a method to the degree of sequence conservation, gene order, ploidy of species, ancestral relationships and the rates at which individual genomes are evolving. Comparative mapping has been carried out by cross-hybridizing molecular markers across species within a given family.

In a preferred embodiment, the nucleic acid molecules of the present invention can be utilized to isolate corresponding syntenic regions in non-rice plants (Bennetzen and Freeling, *Trends in Genet.,* 9(8):259-261 (1993); Ahn et al., *Mol. Gen. Genet.,* 241(5-6):483-490 (1993); Schwarzacher, *Cur. Opin. Genet. & Devel.,* 4(6): 868-874 (1994); Kurata et al., *Bio/Technology,* 12:276-278 (1994); Kilian et al., *Nucl. Acids Res.,* 23(14):2729-2733 (1995); Bennett, *Symp. Soc. Exp. Biol.,* 50:45-52 (1996); Hu et al., *Genetics,* 142(3):1021-1031 (1996); Kilian, *Plant Mol. Biol.,* 35:187-195 (1997); Bennetzen and Freeling, *Genome Res.,* 7(4):301-306 (1997); Foote et al., *Genetics,* 147(2):801-807 (1997); Gallego et al., *Genome,* 41(3):328-336 (1998)). Gale and Devos, *Proc. Natl. Acad. Sci. USA* 95:1971-1974 (1998); Bennetzen et al., *Proc. Natl. Acad. Sci. USA,* 95:1975-1978 (1998); Messing and Llaca, *Proc. Natl. Acad. Sci. USA* 95:2017-2020 (1998); McCouch, *Proc. Natl. Acad. Sci. USA,* 95:1983-1985 (1998); Goff, *Curr. Opin. Plant Biol.* 2:85-89 (1999); Bailey et al., *Theor. Appl. Genet.,* 98:281-284 (1999); Zhang et al., *Proc. Natl. Acad. Sci. USA,* 91:8675-8679 (1994); Yano and Sasaki, *Plant Mol. Biol.,* 35:145-153 (1997); Leister et al., *Proc. Natl. Acad. Sci. USA,* 95:370-375 (1998); Lin et al., *Phytopathology* 86(11):1156-1159 (1996); Havukkala, *Curr. Opin. Genet. Dev.,* 96:711-713 (1996); and Lee, *The Society for*

*Experimental Biology*, pp. 31-38 (1996), all of which are herein incorporated by reference in their entirety). Synteny between rice and barley has recently been reported in the genomic region carrying malting quality Quantitative Trait Loci (QTL) (Kleinhofs et al., *Genome* 41:373-380 (1998), the entirety of which is herein incorporated by reference). Likewise, mapping of the liguless region of sorghum, a region containing a developmental control gene, was facilitated using molecular markers from a syntenic region of the rice genome (Christou et al., *Genetics* 148:1983-1992 (1998), the entirety of which is herein incorporated by reference).

In a particularly preferred embodiment, the nucleic acid molecules of the present invention that define a genomic region in rice plants associated with a desirable phenotype are utilized to obtain corresponding syntenic regions in non-rice plants. A region can be defined either physically or genetically. In an even more preferred embodiment, the nucleic acid molecules of the present invention that define a genomic region in rice plants associated with a desirable phenotype are utilized to obtain corresponding syntenic regions in rice plants. A region can be defined either physically or genetically.

One or more of the nucleic acids molecules may be used to define a physical genomic region. For example, two nucleic acid molecules of the present invention can act to define a physical genomic region that lies between them. Moreover, for example, a physical genomic region may be defined by a distance relative to a nucleic acid molecule. In a preferred embodiment of the present invention, the defined physical genomic region is less than about 1,000 kb, more preferably less than about 500 kb, even more preferably less than about 100 kb or less than about 50 kb.

One or more of the nucleic acids molecules may be used to define a genomic region by its genetic distance from one or more nucleic acid molecules. In a preferred embodiment of the present invention, the genomic region is defined by its linkage to a nucleic acid molecule of the present invention. In such a preferred embodiment, the genomic region that is defined by one or more nucleic acid molecules of the present invention is located within about 50 centimorgans, more preferably within about 20 centimorgans, even more preferably with about 10, about 5 or about 2 centimorgans of the trait or marker at issue.

In another particularly preferred embodiment, two or more nucleic acid molecules of the present invention derived from rice plants that flank a genomic region of interest in rice plants are used to isolate the syntenic region in another cereal, more preferably maize, sorghum, barley, or wheat. Regions of interest in rice include, without limitation, those regions that are associated with a commercially desirable phenotype in rice. In another particularly preferred embodiment the desirable phenotype in rice is the result of a quantitative trait locus (QTL) present in the region.

One exemplary approach to isolate syntenic genomic regions is as follows. Nucleic acid molecules derived from rice of the present invention can be used to select large insert clones from a total genomic DNA library of a related species such as maize, sorghum, barley, or wheat. Any appropriate method to screen the genomic library with a nucleic acid molecule of the present invention may be used to select the required clones (See, for example, Birren et al., *Detecting Genes: A Laboratory Manual*, Cold Spring Harbor, New York, N.Y. (1998). For example, direct hybridization of a nucleic acid molecule of the present invention to mapping filters comprising the genomic DNA of the syntenic species can be used to select large insert clones from a total genomic DNA library of a related species. The selected clones can then be used to physically map the region in the target species. An advantage of this method for comparative mapping is that no mapping population or linkage map of the target species is needed and the clones may also be used in other closely related species. By comparing the results obtained by genetic mapping in model plants, with those from other species, similarities of genomic structure among plants species can be established. Cross-hybridization of RFLP markers have been reported and conserved gene order has been established in many studies. Such macroscopic synteny is utilized for the estimation of correspondence of loci among these crops. These loci include not only Mendelian genes but also Quantitative Trait Loci (QTL) (Mohan et al., *Molecular Breeding* 3:87-103 (1997), the entirety of which is herein incorporated by reference). Other methods to isolate syntenic nucleic acid molecules may be used.

It is understood that markers of the present invention may be used in comparative mapping. In a preferred embodiment the markers of present invention may be used in the comparative mapping of cereals, more preferably maize, barley, sorghum, and wheat.

It is understood that markers of the present invention may be used to isolate nucleic acid molecules from other cereals based on the syntenic relationship between such cereals. In a preferred embodiment the cereal is selected from the group of maize, sorghum, barley, and wheat.

The nucleic acid molecules of the present invention can be used to identify polymorphisms. In one embodiment, one or more of the nucleic acid molecules or a BAC nucleic acid molecule (or a sub-fragment of either) may be employed as a marker nucleic acid molecule to identify such polymorphism(s). Alternatively, such polymorphisms can be detected through the use of a marker nucleic acid molecule or a marker protein that is genetically linked to (i.e., a polynucleotide that co-segregates with) such polymorphism(s). In a preferred embodiment, the plant is selected from the group consisting of cereals, and more preferably rice, maize, barley, sorghum, and wheat.

In an alternative embodiment, such polymorphisms can be detected through the use of a marker nucleic acid molecule that is physically linked to such polymorphism(s). For this purpose, marker nucleic acid molecules comprising a nucleotide sequence of a polynucleotide located within 1 mb of the polymorphism(s), and more preferably within 100 kb of the polymorphism(s), and most preferably within 10 kb of the polymorphism(s) can be employed.

The genomes of animals and plants naturally undergo spontaneous mutation in the course of their continuing evolution (Gusella, *Ann. Rev. Biochem.* 55:831-854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members of a species may have the original sequence (i.e., the original "allele") whereas other members may have the variant sequence (i.e., the variant "allele"). In the simplest case, only one variant sequence may exist, and the polymorphism is thus said to be diallelic. In other cases, the species' population may contain multiple alleles, and the polymorphism is termed tri-allelic, etc. A single gene may have multiple different unrelated polymorphisms. For example, it may have a di-allelic polymorphism at one site, and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("VNTR") polymorphisms. VNTRs have been used in identity analysis (Weber, U.S. Pat. No. 5,075,217; Armour et al., *FEBS Lett.* 307:113-115 (1992); Jones et al., *Eur. J. Haematol.* 39:144-147 (1987); Horn et al., PCT Application WO91/14003; Jeffreys, European Patent Application 370,719; Jeffreys, U.S. Pat. No. 5,175,082; Jeffreys et al., *Amer. J. Hum. Genet.* 39:11-24 (1986); Jeffreys et al., *Nature* 316:76-79 (1985); Gray et al., *Proc. R. Acad. Soc. Lond.* 243:241-253 (1991); Moore et al., *Genomics* 10:654-660 (1991); Jeffreys et al., *Anim. Genet.* 18:1-15 (1987); Hillel et al., *Anim. Genet.* 20:145-155 (1989); Hillel et al., *Genet.* 124:783-789 (1990), all of which are herein incorporated by reference in their entirety).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis et al., *Cold Spring Harbor Symp. Quant. Biol.* 51:263-273 (1986); Erlich et al., European Patent Appln. 50,424; European Patent Appln. 84,796, European Patent Application 258,017, European Patent Appln. 237,362; Mullis, European Patent Appln. 201,184; Mullis, et al., U.S. Pat. No. 4,683,202; Erlich., U.S. Pat. No. 4,582,788; and Saiki et al., U.S. Pat. No. 4,683,194, all of which are herein incorporated by reference), using primer pairs that are capable of hybridizing to the proximal sequences that define a polymorphism in its double-stranded form.

In lieu of PCR, alternative methods, such as the "Ligase Chain Reaction" ("LCR") may be used (Barany, *Proc. Natl. Acad. Sci. USA* 88:189-193 (1991), the entirety of which is herein incorporated by reference). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069, the entirety of which is herein incorporated by reference).

The "Oligonucleotide Ligation Assay" ("OLA") may alternatively be employed (Landegren et al., *Science* 241:1077-1080 (1988), the entirety of which is herein incorporated by reference). The OLA protocol uses two oligonucleotides which are designed to be capable of hybridizing to abutting sequences of a single strand of a target. OLA, like LCR, is particularly suited for the detection of point mutations. Unlike LCR, however, OLA results in "linear" rather than exponential amplification of the target sequence.

Nickerson et al. have described a nucleic acid detection assay that combines attributes of PCR and OLA (Nickerson et al., *Proc. Natl. Acad. Sci. USA* 87:8923-8927 (1990), the entirety of which is herein incorporated by reference). In this method, PCR is used to achieve the exponential amplification of target DNA, which is then detected using OLA. In addition to requiring multiple, and separate, processing steps, one problem associated with such combinations is that they inherit all of the problems associated with PCR and OLA.

Schemes based on ligation of two (or more) oligonucleotides in the presence of nucleic acid having the sequence of the resulting "di-oligonucleotide", thereby amplifying the di-oligonucleotide, are also known (Wu et al., *Genomics* 4:560 (1989), the entirety of which is herein incorporated by reference), and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek et al., U.S. Pat. No. 5,130,238; Davey et al., European Patent Application 329,822; Schuster et al., U.S. Pat. No. 5,169,766; Miller et al., PCT Application WO 89/06700; Kwoh et al., *Proc. Natl. Acad. Sci. USA* 86:1173-1177 (1989); Gingeras et al., PCT Application WO 88/10315; Walker et al., *Proc. Natl. Acad. Sci. USA* 89:392-396 (1992), all of which are herein incorporated by reference in their entirety).

The identification of a polymorphism can be determined in a variety of ways. By correlating the presence or absence of it in an plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick et al., *Cytogen. Cell Genet.* 32:58-67 (1982); Botstein et al., *Ann. J. Hum. Genet.* 32:314-331 (1980); Fischer et al. PCT Application WO90/13668; Uhlen, PCT Application WO90/11369).

Polymorphisms can also be identified by Single Strand Conformation Polymorphism (SSCP) analysis. The SSCP technique is a method capable of identifying most sequence variations in a single strand of DNA, typically between 150 and 250 nucleotides in length (Elles, *Methods in Molecular Medicine: Molecular Diagnosis of Genetic Diseases*, Humana Press (1996); Orita et al., *Genomics* 5:874-879 (1989), both of which are herein incorporated by reference in their entirety). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to Lee et al., *Anal. Biochem.* 205:289-293 (1992); Suzuki et al., *Anal. Biochem.* 192:82-84 (1991); Lo et al., *Nucleic Acids Research* 20:1005-1009 (1992); Sarkar et al., *Genomics* 13:441-443 (1992), all of which are herein incorporated by reference in their entirety). It is understood that one or more of the nucleic acids of the present invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA. Vos et al., *Nucleic Acids Res.* 23:4407-4414 (1995), the entirety of which is herein incorporated by reference. This method allows for the specific co-amplification of high numbers of restriction fragments, which can be visualized by PCR without knowledge of the nucleic acid sequence.

AFLP employs basically three steps. Initially, a sample of genomic DNA is cut with restriction enzymes and oligonucleotide adapters are ligated to the restriction fragments of the DNA. The restriction fragments are then amplified using PCR by using the adapter and restriction sequence as target sites for primer annealing. The selective amplification is achieved by the use of primers that extend into the restriction fragments, amplifying only those fragments in which the primer extensions match the nucleotide flanking the restriction sites. These amplified fragments are then visualized on a denaturing polyacrylamide gel.

AFLP analysis has been performed on *Salix* (Beismann et al., *Mol. Ecol.* 6:989-993 (1997), the entirety of which is herein incorporated by reference); *Acinetobacter* (Janssen et al., *Int. J. Syst. Bacteriol* 47:1179-1187 (1997), the entirety of which is herein incorporated by reference), *Aeromonas popoffi* (Huys et al., *Int. J. Syst. Bacteriol.* 47:1165-1171 (1997), the entirety of which is herein incorporated by reference), rice (McCouch et al., *Plant Mol. Biol.* 35:89-99 (1997); Nandi et al., *Mol. Gen. Genet.* 255:1-8 (1997); Cho et al., *Genome* 39:373-378 (1996), all of which are herein incorporated by reference in their entirety), barley (*Hordeum vulgare*) (Simons et al., *Genomics* 44:61-70 (1997); Waugh et al., *Mol. Gen. Genet.* 255:311-321 (1997); Qi et al., *Mol. Gen. Genet.* 254:330-336 (1997); Becker et al., *Mol. Gen. Genet.* 249:65-73 (1995), all of which are herein incorporated by reference in their entirety), potato (Van der Voort et al., *Mol. Gen. Genet.* 255:438-447 (1997); Meksem et al., *Mol. Gen. Genet.* 249:74-81 (1995), both of which are herein incorporated by reference in their entirety), *Phytophthora infestans* (Van der Lee et al., *Fungal Genet. Biol.* 21:278-291 (1997), the entirety of which is herein incorporated by reference), *Bacillus anthracis* (Keim et al., *J. Bacteriol.* 179:818-824 (1997)), *Astragalus cremnophylax* (Travis et al., *Mol. Ecol.* 5:735-745 (1996), the entirety of which is herein incorporated by reference), *Arabidopsis* (Cnops et al., *Mol. Gen. Genet.* 253:32-41 (1996), the entirety of which is herein incorporated by reference), *Escherichia coli* (Lin et al., *Nucleic Acids Res.* 24:3649-3650 (1996), the entirety of which is herein incorporated by reference), *Aeromonas* (Huys et al., *Int. J. Syst. Bacteriol.* 46:572-580 (1996), the entirety of which is herein incorporated by reference), nematode (Folkertsma et al., *Mol. Plant Microbe Interact.* 9:47-54 (1996), the entirety of which is herein incorporated by reference), tomato (Thomas et al., *Plant J.* 8:785-794 (1995), the entirety of which is herein incorporated by reference), and human (Latorra et al., *PCR Methods Appl.* 3:351-358 (1994) the entirety of which is herein incorporated by reference). AFLP analysis has also been used for fingerprinting mRNA (Money et al., *Nucleic Acids Res.* 24:2616-2617 (1996); Bachem, et al., *Plant J.* 9:745-753 (1996), both of which are herein incorporated by reference in their entirety). It is understood that one or more of the nucleic acid molecules of the present invention, may be utilized as markers or probes to detect polymorphisms by AFLP analysis for fingerprinting mRNA.

Polymorphisms may also be found using random amplified polymorphic DNA (RAPD) (Williams et al., *Nucl. Acids Res.* 18:6531-6535 (1990), the entirety of which is herein incorporated by reference) and cleavable amplified polymorphic sequences (CAPS) (Lyamichev et al., *Science* 260:778-783 (1993), the entirety of which is herein incorporated by reference). It is understood that one or more of the nucleic acid molecules of the present invention, may be utilized as markers or probes to detect polymorphisms by RAPD or CAPS analysis.

Nucleic acid molecules of the present invention can be used to monitor expression. A microarray-based method for high-throughput monitoring of plant gene expression may be utilized to measure gene-specific hybridization targets. This 'chip'-based approach involves using microarrays of nucleic acid molecules as gene-specific hybridization targets to quantitatively measure expression of the corresponding plant genes (Schena et al., *Science* 270:467-470 (1995); Shalon, Ph.D. Thesis. Stanford University (1996), both of which are herein incorporated by reference in their entirety). Every nucleotide in a large sequence can be queried at the same time. Hybridization can be used to efficiently analyze nucleotide sequences.

Several microarray methods have been described. One method compares the sequences to be analyzed by hybridization to a set of oligonucleotides or cDNA molecules representing all possible subsequences (Bains and Smith, *J. Theor. Biol.* 135:303 (1989), the entirety of which is herein incorporated by reference). A second method hybridizes the sample to an array of oligonucleotide or cDNA probes. An array consisting of oligonucleotides or cDNA molecules complementary to subsequences of a target sequence can be used to determine the identity of a target sequence, measure its amount, and detect differences between the target and a reference sequence. Nucleic acid molecule microarrays may also be screened with protein molecules or fragments thereof to determine nucleic acid molecules that specifically bind protein molecules or fragments thereof.

Additionally, microarrays of BACs may be prepared to sufficiently cover 3× of an entire genome. Such microarrays can be used in a variety of genomics experiments including gene mapping, DNA fingerprinting and promoter identification. Microarrays of genomic DNA can also be used for parallel analysis of genomes at single gene resolution (Lemieux et al., *Molecular Breeding* 277-289 (1988), the entirety of which is herein incorporated by reference). It is understood that one or more of the molecules of the present invention, preferably one or more of the nucleic acid molecules or protein molecules or fragments thereof of the present invention may be utilized in a genomic microarray based method. In a preferred embodiment of the present invention, one or more of the rice nucleic acid molecules or protein molecules or fragments thereof of the present invention may be utilized in a genomic microarray based method. For example, Genomic Mismatch Scanning (GMS), a hybridization-based method of linkage analysis that allows rapid identification of regions of identity-by-descent between two related individuals, can be carried out with microarrays. GMS is reported to have been used to identify genetically common chromosomal segments based on the ability of these DNA sequences to form extensive regions of mismatch-free heteroduplexes. A series of enzymatic steps, coupled with filter binding, is used to selectively remove heteroduplexes that contain mismatches (i.e., chromosomal regions that do not share identity-by-descent.). Fragments of chromosomal DNA representing inherited regions are hybridized to a microarray of ordered genomic clones and positive hybridization signals pinpoint regions of identity-by-descent at high resolution (Lemieux et al., *Molecular Breeding* 277-289 (1988)).

It is understood that one or more of the molecules of the present invention, preferably one or more of the nucleic acid molecules or protein molecules or fragments thereof of the present invention may be utilized in a GMS microarray based method to locate regions of identity-by-descent between related individuals. In a preferred embodiment of the present invention, one or more of the rice nucleic acid molecules or protein molecules or fragments thereof of the present invention may be utilized in a GMS microarray based method to locate regions of identity-by-descent between related individuals. The GMS microarray approach can also be used as a tool to map multigenic traits. For example, in yeast, the entire genomic sequence is known and it has been reported that the genes responsible for growth at elevated temperature, a trait required for the pathogenicity of certain yeast strains, may be determined using GMS (Lemieux et al., *Molecular Breeding* 277-289 (1988)). By analyzing the inheritance of large numbers of tetrads derived from crosses of pathogenic and wild type strains, all the genes responsible for a yeast strain's ability to grow at 42° C., for example, could be identified.

It is understood that one or more of the molecules of the present invention, preferably one or more of the nucleic acid molecules or protein molecules or fragments thereof of the present invention may be utilized in a GMS microarray based method to map multigenic traits. In a preferred embodiment of the present invention, one or more of the rice nucleic acid molecules or protein molecules or fragments thereof of the present invention may be utilized in a GMS microarray based method to map multigenic traits.

Plant repeat elements may be used with GMS microarraying to identify species specific chromosomes in another species background. For example, the maize genome contains moderately repetitive DNA sequences (ZLRS) representing about 2500 copies per haploid genome; these sequences are present in the genus *Zea* and absent in other graminaceous species. Ananiev et al., *Proc. Natl. Acad. Sci. USA* 94:3526-3529 (1997), the entirety of which is herein incorporated by reference, have reported unusual plants with individual maize chromosomes added to a complete oat genome generated by embryo rescue from oat (*Avena sativa*)×*Zea mays* crosses. By using highly repetitive maize-specific sequences as probes, Ananiev et al., *Proc. Natl. Acad. Sci. USA* 94:3526-3529 (1997) were able to selectively isolate cosmid clones containing maize genomic DNA.

It is understood that one or more of the molecules of the present invention, preferably one or more of the nucleic acid molecules or protein molecules or fragments thereof of the present invention may be utilized in a GMS microarray based method using repeat elements to selectively isolate clones containing species specific DNA. In a preferred embodiment of the present invention, one or more of the rice nucleic acid molecules or protein molecules or fragments thereof of the present invention may be utilized in a GMS microarray based method to selectively isolate clones containing species specific DNA. A particularly preferred microarray embodiment of the present invention is a microarray comprising nucleic acid molecules encoding genes that are homologues of known genes or nucleic acid molecules that comprise genes or fragments thereof that elicit only limited or no matches to known genes. A further preferred microarray embodiment of the present invention is a microarray comprising nucleic acid molecules encoding genes or fragments thereof that are homologues of known genes and nucleic acid molecules that comprise genes or fragments thereof that elicit only limited or no matches to known genes. A further preferred microarray embodiment of the present invention is a microarray comprising nucleic acid molecules encoding genes or fragments thereof that elicit only limited or no matches to known genes.

It is understood that one or more of the molecules of the present invention, preferably one or more of the nucleic acid molecules or protein molecules or fragments thereof of the present invention may be utilized in a microarray based method.

In a preferred embodiment of the present invention, one or more of the nucleic acid molecules or protein molecules or fragments thereof or other agents of the present invention may be utilized in a microarray based method.

Nucleic acid molecules of the present invention may be used in site directed mutagenesis. Site-directed mutagenesis may be utilized to modify nucleic acid sequences, particularly as it is a technique that allows one or more of the amino acids encoded by a nucleic acid molecule to be altered (e.g., a threonine to be replaced by a methionine). Three basic methods for site-directed mutagenesis are often employed. These are cassette mutagenesis (Wells et al., *Gene* 34:315-23 (1985), the entirety of which is herein incorporated by reference), primer extension (Gilliam et al., *Gene* 12:129-137 (1980); Zoller and Smith, *Methods Enzymol.* 100:468-500 (1983); and Dalbadie-McFarland et al., *Proc. Natl. Acad. Sci. USA* 79:6409-6413 (1982), all of which are herein incorporated by reference in their entirety) and methods based upon PCR (Scharf et al., *Science* 233:1076-1078 (1986); Higuchi et al., *Nucleic Acids Res.* 16:7351-7367 (1988), both of which are herein incorporated by reference in their entirety). Site-directed mutagenesis approaches are also described in European Patent 0 385 962, European Patent 0 359 472, and PCT Patent Application WO 93/07278, all of which are herein incorporated by reference in their entirety.

Site-directed mutagenesis strategies have been applied to plants for both in vitro as well as in vivo site-directed mutagenesis (Lanz et al., *J. Biol. Chem.* 266:9971-6 (1991); Kovgan and Zhdanov, *Biotekhnologiya* 5:148-154, No. 207160n, Chemical Abstracts 110:225 (1989); Ge et al., *Proc. Natl. Acad. Sci. USA* 86:4037-4041 (1989); Zhu et al., *J. Biol. Chem.* 271:18494-18498 (1996), Chu et al., *Biochemistry* 33:6150-6157 (1994); Small et al., *EMBO J.* 11:1291-1296 (1992); Cho et al., *Mol. Biotechnol.* 8:13-16 (1997), Kita et al., *J. Biol. Chem.* 271:26529-26535 (1996); Jin et al., *Mol. Microbiol.* 7:555-562 (1993); Hatfield and Vierstra, *J. Biol. Chem.* 267:14799-14803 (1992); Zhao et al., *Biochemistry* 31:5093-5099 (1992), all of which are herein incorporated by reference in their entirety).

Any of the nucleic acid molecules of the present invention may either be modified by site-directed mutagenesis or used as, for example, nucleic acid molecules that are used to target other nucleic acid molecules for modification. It is understood that mutants with more than one altered nucleotide can be constructed using techniques that practitioners skilled in the art are familiar with such as isolating restriction fragments and ligating such fragments into an expression vector (see, for example, Sambrook et al., *Molecular Cloning: A Laboratory Manual*, Cold Spring Harbor Press (1989)). In a preferred embodiment of the present invention, one or more of the rice nucleic acid molecules or fragments thereof of the present invention may be modified by site-directed mutagenesis.

Nucleic acid molecules of the present invention may be used in transformation. Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. In a preferred embodiment of the present invention the exogenous genetic material can include rice genetic material. A particularly preferred embodiment is exogenous genetic material that comprises a nucleic acid molecule of the present invention. Such genetic material may be transferred into either monocotyledons and dicotyledons including but not limited to the plants, maize and *Arabidopsis thaliana* and rice (See specifically, Chistou, *Particle Bombardment for Genetic Engineering of plants*, pp. 63-69 (maize), pp 50-60 (rice), Biotechnology Intelligence Unit, Academic Press, San Diego, Calif. (1996), the entirety of which is herein incorporated by reference and generally Chistou, *Particle Bombardment for Genetic Engineering of Plants*, Biotechnology Intelligence Unit, Academic Press, San Diego, Calif. (1996), the entirety of which is herein incorporated by reference).

Transfer of a nucleic acid that encodes for a protein can result in overexpression of that protein in a transformed cell or transgenic plant. One or more of the proteins or fragments thereof encoded by nucleic acid molecules of the present invention may be overexpressed in a transformed cell or transformed plant. Such overexpression may be the result of transient or stable transfer of the exogenous material.

Exogenous genetic material may be transferred into a plant cell by the use of a DNA vector or construct designed for such a purpose. Preferred exogenous genetic material comprise a nucleic acid molecule of the present invention. Vectors have been engineered for transformation of large DNA inserts into plant genomes. Vectors have been designed to replicate in both *E. coli* and *A. tumefaciens* and have all of the features required for transferring large inserts of DNA into plant chromosomes (Choi and Wing, at the website genome.clemson-.edu/protocols2-nj.html July, 1998). ApBACwich system has been developed to achieve site-directed integration of DNA into the genome. A 150 kb cotton BAC DNA is reported to have been transferred into a specific lox site in tobacco by biolistic bombardment and Cre-lox site specific recombination.

A construct or vector may include a plant promoter to express the protein or protein fragment of choice. A number of promoters which are active in plant cells have been described in the literature. These include the nopaline synthase (NOS) promoter (Ebert et al., *Proc. Natl. Acad. Sci. USA* 84:5745-5749 (1987), the entirety of which is herein incorporated by reference), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al., *Plant Mol. Biol.* 9:315-324 (1987), the entirety of which is herein incorporated by reference) and the CaMV 35S promoter (Odell et al., *Nature* 313:810-812 (1985), the entirety of which is herein incorporated by reference), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci. USA* 84:6624-6628 (1987), the entirety of which is herein incorporated by reference), the sucrose synthase promoter (Yang et al., *Proc. Natl. Acad. Sci. USA* 87:4144-4148 (1990), the entirety of which is herein incorporated by reference), the R gene complex promoter (Chandler et al., *The Plant Cell* 1:1175-1183 (1989), the entirety of which is herein incorporated by reference), and the chlorophyll a/b binding protein gene promoter, etc. These promoters have been used to create DNA constructs which have been expressed in plants; see, e.g., PCT publication WO 84/02913, herein incorporated by reference in its entirety.

Promoters which are known or are found to cause transcription of DNA in plant cells can be used in the present invention. Such promoters may be obtained from a variety of sources such as plants and plant viruses. It is preferred that the particular promoter selected should be capable of causing sufficient expression to result in the production of an effective amount of protein to cause the desired phenotype. In addition to promoters which are known to cause transcription of DNA in plant cells, other promoters may be identified for use in the current invention by screening a plant cDNA library for genes which are selectively or preferably expressed in the target tissues or cells.

For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea (Edwards et al., *Proc. Natl. Acad. Sci. USA* 87:3459-3463 (1990), herein incorporated by reference in its entirety), the chloroplast fructose-1,6-biphosphatase (FBPase) promoter from wheat (Lloyd et al., *Mol. Gen. Genet.* 225:209-216 (1991), herein incorporated by reference in its entirety), the nuclear photosynthetic ST-LS1 promoter from potato (Stockhaus et al., *EMBO J.* 8:2445-2451 (1989), herein incorporated by reference in its entirety), the phenylalanine ammonia-lyase (PAL) promoter and the chalcone synthase (CHS) promoter from *Arabidopsis thaliana*. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773-778 (1994), herein incorporated by reference in its entirety), the promoter for the Cab-1 gene from wheat (Fejes et al., *Plant Mol. Biol.* 15:921-932 (1990), herein incorporated by reference in its entirety), the promoter for the CAB-1 gene from spinach (Lubberstedt et al., *Plant Physiol.* 104:997-1006 (1994), herein incorporated by reference in its entirety), the promoter for the cab1R gene from rice (Luan et al., *Plant Cell.* 4:971-981 (1992), the entirety of which is herein incorporated by reference), the pyruvate, orthophosphate dikinase (PPDK) promoter from maize (Matsuoka et al., *Proc. Natl. Acad. Sci. USA* 90:9586-9590 (1993), herein incorporated by reference in its entirety), the promoter for the tobacco Lhcb1*2 gene (Cerdan et al., *Plant Mol Biol.* 33:245-255. (1997), herein incorporated by reference in its entirety), the *Arabidopsis thaliana* SUC2 sucrose-H+ symporter promoter (Truernit et al., *Planta.* 196:564-570 (1995), herein incorporated by reference in its entirety), and the promoter for the thylacoid membrane proteins from spinach (psaD, psaF, psaE, PC, FNR, atpC, atpD, cab, rbcS). Other promoters for the chlorophyll a/b-binding proteins may also be utilized in the present invention, such as the promoters for LhcB gene and PsbP gene from white mustard (Sinapis alba; Kretsch et al., *Plant Mol. Biol.* 28:219-229 (1995), the entirety of which is herein incorporated by reference).

For the purpose of expression in sink tissues of the plant, such as the tuber of the potato plant, the fruit of tomato, or the seed of maize, wheat, rice, and barley, it is preferred that the promoters utilized in the present invention have relatively high expression in these specific tissues. A number of promoters for genes with tuber-specific or -enhanced expression are known, including the class I patatin promoter (Bevan et al., *EMBO J.* 8:1899-1906 (1986); Jefferson et al., *Plant Mol. Biol.* 14995-1006 (1990), both of which are herein incorporated by reference in its entirety), the promoter for the potato tuber ADPGPP genes, both the large and small subunits, the sucrose synthase promoter (Salanoubat and Belliard, *Gene.* 60:47-56 (1987), Salanoubat and Belliard, *Gene.* 84:181-185 (1989), both of which are incorporated by reference in their entirety), the promoter for the major tuber proteins including the 22 kd protein complexes and proteinase inhibitors (Hannapel, *Plant Physiol.* 101:703-704 (1993), herein incorporated by reference in its entirety), the promoter for the granule bound starch synthase gene (GBSS) (Visser et al., *Plant Mol. Biol.* 17:691-699 (1991), herein incorporated by reference in its entirety), and other class I and II patatins promoters (Koster-Topfer et al., *Mol. Gen. Genet.* 219:390-396 (1989); Mignery et al., *Gene.* 62:27-44 (1988), both of which are herein incorporated by reference in their entirety).

Other promoters can also be used to express a fructose 1,6 bisphosphate aldolase gene in specific tissues, such as seeds or fruits. The promoter for β-conglycinin (Chen et al., *Dev. Genet.* 10:112-122 (1989), herein incorporated by reference in its entirety) or other seed-specific promoters such as the napin and phaseolin promoters, can be used. The zeins are a group of storage proteins found in maize endosperm. Genomic clones for zein genes have been isolated (Pedersen et al., *Cell* 29:1015-1026 (1982), herein incorporated by reference in its entirety), and the promoters from these clones, including the 15 kD, 16 kD, 19 kD, 22 kD, 27 kD, and gamma genes, could also be used. Other promoters known to function, for example, in maize, include the promoters for the following genes: waxy, *Brittle, Shrunken* 2, Branching enzymes I and II, starch synthases, debranching enzymes, oleosins, glutelins, and sucrose synthases. A particularly preferred promoter for maize endosperm expression is the promoter for the glutelin gene from rice, more particularly the Osgt-1 promoter (Zheng et al., *Mol. Cell Biol.* 13:5829-5842 (1993), herein incorporated by reference in its entirety). Examples of promoters suitable for expression in wheat include those promoters for the ADPglucose pyrophosphorylase (ADPGPP) subunits, the granule bound and other starch synthases, the branching and debranching enzymes, the embryogenesis-abundant proteins, the gliadins, and the glutenins. Examples of such promoters in rice include those promoters for the ADPGPP subunits, the granule bound and other starch synthases, the branching enzymes, the debranching enzymes, sucrose synthases, and the glutelins. A particularly preferred promoter is the promoter for rice glutelin, Osgt-1. Examples of such promoters for barley include those for the ADPGPP subunits, the granule bound and other starch synthases, the branching enzymes, the debranching enzymes, sucrose synthases, the hordeins, the embryo globulins, and the aleurone specific proteins.

Root specific promoters may also be used. An example of such a promoter is the promoter for the acid chitinase gene (Samac et al., *Plant Mol. Biol* 25:587-596 (1994), the entirety of which is herein incorporated by reference). Expression in root tissue could also be accomplished by utilizing the root specific subdomains of the CaMV35S promoter that have been identified (Lam et al., *Proc. Natl. Acad. Sci. USA* 86:7890-7894 (1989), herein incorporated by reference in its entirety). Other root cell specific promoters include those reported by Conkling et al. (Conkling et al., *Plant Physiol.* 93:1203-1211 (1990), the entirety of which is herein incorporated by reference).

Additional promoters that may be utilized are described, for example, in U.S. Pat. Nos. 5,378,619, 5,391,725, 5,428,147, 5,447,858, 5,608,144, 5,608,144, 5,614,399, 5,633,441, 5,633,435, and 4,633,436, all of which are herein incorporated in their entirety. In addition, a tissue specific enhancer may be used (Fromm et al., *The Plant Cell* 1:977-984 (1989), the entirety of which is herein incorporated by reference).

Constructs or vectors may also include, with the coding region of interest, a nucleic acid sequence that acts, in whole or in part, to terminate transcription of that region. For example, such sequences have been isolated including the Tr7 3' sequence and the nos 3' sequence (Ingelbrecht et al., *The Plant Cell* 1:671-680 (1989); Bevan et al., *Nucleic Acids Res.* 11:369-385 (1983), both of which are herein incorporated by reference in their entirety), or the like.

A vector or construct may also include regulatory elements. Examples of such include the Adh intron 1 (Callis et al., *Genes and Develop.* 1:1183-1200 (1987), the entirety of which is herein incorporated by reference), the sucrose synthase intron (Vasil et al., *Plant Physiol.* 91:1575-1579 (1989), the entirety of which is herein incorporated by reference) and the TMV omega element (Gallie et al., *The Plant Cell* 1:301-311 (1989), the entirety of which is herein incorporated by reference). These and other regulatory elements may be included when appropriate.

A vector or construct may also include a selectable marker. Selectable markers may also be used to select for plants or plant cells that contain the exogenous genetic material. Examples of such include, but are not limited to, a neo gene (Potrykus et al., *Mol. Gen. Genet.* 199:183-188 (1985), the entirety of which is herein incorporated by reference) which codes for kanamycin resistance and can be selected for using kanamycin, G418, etc.; a bar gene which codes for bialaphos resistance; a mutant EPSP synthase gene (Hinchee et al., *Bio/Technology* 6:915-922 (1988), the entirety of which is herein incorporated by reference) which encodes glyphosate resistance; a nitrilase gene which confers resistance to bromoxynil (Stalker et al., *J. Biol. Chem.* 263:6310-6314 (1988), the entirety of which is herein incorporated by reference); a mutant acetolactate synthase gene (ALS) which confers imidazolinone or sulphonylurea resistance (European Patent Application 154,204 (Sep. 11, 1985), the entirety of which is herein incorporated by reference); and a methotrexate resistant DHFR gene (Thillet et al., *J. Biol. Chem.* 263:12500-12508 (1988), the entirety of which is herein incorporated by reference).

A vector or construct may also include a transit peptide. Incorporation of a suitable chloroplast transit peptide may also be employed (European Patent Application Publication Number 0218571, the entirety of which is herein incorporated by reference). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393-405 (1996), the entirety of which is herein incorporated by reference.

A vector or construct may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5:387-405 (1987); Jefferson et al., *EMBO J.* 6:3901-3907 (1987), both of which are herein incorporated by reference in their entirety); an R-locus gene, which encodes a product that regulates the production of anthocyanin pigments (red color) in plant tissues ((Dellaporta et al., Stadler Symposium 11:263-282 (1988), the entirety of which is herein incorporated by reference); a β-lactamase gene (Sutcliffe et al., *Proc. Natl. Acad. Sci. USA* 75:3737-3741 (1978), the entirety of which is herein incorporated by reference), a gene which encodes an enzyme for which various chromogenic substrates are known (e.g., PADAC, a chromogenic cephalosporin); a luciferase gene (Ow et al., *Science* 234: 856-859 (1986), the entirety of which is herein incorporated by reference) a xylE gene (Zukowsky et al., *Proc. Natl. Acad. Sci. USA* 80:1101-1105 (1983), the entirety of which is herein incorporated by reference) which encodes a catechol dioxygenase that can convert chromogenic catechols; an α-amylase gene (Ikatu et al., *Bio/Technol.* 8:241-242 (1990), the entirety of which is herein incorporated by reference); a tyrosinase gene (Katz et al., *J. Gen. Microbiol.* 129:2703-2714 (1983), the entirety of which is herein incorporated by reference) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins detectable, e.g., by ELISA, small active enzymes detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

Methods and compositions for transforming a bacteria and other microorganisms are known in the art (see for example Sambrook et al., *Molecular Cloning: A Laboratory Manual*, Second Edition, Cold Spring Harbor Laboratory Press, Cold Spring Harbor, N.Y., (1989), the entirety of which is herein incorporated by reference).

There are many methods for introducing transforming nucleic acid molecules into plant cells. Suitable methods are believed to include virtually any method by which nucleic acid molecules may be introduced into a cell, such as by *Agrobacterium* infection or direct delivery of nucleic acid molecules such as, for example, by PEG-mediated transformation, by electroporation or by acceleration of DNA coated particles, etc. (Pottykus, *Ann. Rev. Plant Physiol. Plant Mol. Biol.* 42:205-225 (1991); Vasil, *Plant Mol. Biol.* 25:925-937 (1994), both of which are herein incorporated by reference in their entirety). For example, electroporation has been used to transform maize protoplasts (Fromm et al., *Nature* 312:791-793 (1986), the entirety of which is herein incorporated by reference).

Technology for introduction of DNA into cells is well known to those of skill in the art. Four general methods for delivering a gene into cells have been described: (1) chemical methods (Graham and van der Eb, *Virology*, 54:536-539 (1973), the entirety of which is herein incorporated by reference); (2) physical methods such as microinjection (Capecchi, *Cell* 22:479-488 (1980), electroporation (Wong and Neumann, *Biochem. Biophys. Res. Commun.*, 107:584-587 (1982); Fromm et al., *Proc. Natl. Acad. Sci. USA*, 82:5824-5828 (1985); U.S. Pat. No. 5,384,253; and the gene gun (Johnston and Tang, *Methods Cell Biol.* 43:353-365 (1994), all of which are herein incorporated by reference in their entirety; (3) viral vectors (Clapp, *Clin. Perinatol.*, 20:155-168 (1993); Lu et al., *J. Exp. Med.*, 178:2089-2096 (1993); Eglitis and Anderson, *Biotechniques*, 6:608-614 (1988), all of which are herein incorporated by reference in their entirety); and (4) receptor-mediated mechanisms (Curiel et al., *Hum. Gen. Ther.*, 3:147-154 (1992); Wagner et al., *Proc. Natl. Acad. Sci. USA*, 89:6099-6103 (1992), all of are herein incorporated by reference in their entirety).

Acceleration methods that may be used include, for example, microprojectile bombardment and the like. One example of a method for delivering transforming nucleic acid molecules to plant cells is microprojectile bombardment. This method has been reviewed by Yang and Christou, eds., *Particle Bombardment Technology for Gene Transfer*, Oxford Press, Oxford, England (1994), the entirety of which is herein incorporated by reference). Non-biological particles (microprojectiles) that may be coated with nucleic acids and delivered into cells by a propelling force. Exemplary particles include those comprised of tungsten, gold, platinum, and the like.

A particular advantage of microprojectile bombardment, in addition to it being an effective means of reproducibly, and stably transforming monocotyledons, is that neither the isolation of protoplasts (Cristou et al., *Plant Physiol.* 87:671-674 (1988), the entirety of which is herein incorporated by reference) nor the susceptibility of *Agrobacterium* infection is required. An illustrative embodiment of a method for delivering DNA into maize cells by acceleration is a biolistics-particle delivery system, which can be used to propel particles coated with DNA through a screen, such as a stainless steel or Nytex screen, onto a filter surface covered with corn cells cultured in suspension. Gordon-Kamm et al., describes the basic procedure for coating tungsten particles with DNA (Gordon-Kamm et al., *Plant Cell* 2:603-618 (1990), the entirety of which is herein incorporated by reference). The screen disperses the tungsten nucleic acid particles so that they are not delivered to the recipient cells in large aggregates. A particle delivery system suitable for use with the present invention is the helium acceleration PDS-1000/He gun which is available from Bio-Rad Laboratories (Bio-Rad, Hercules, Calif. et al., *Technique* 3:3-16 (1991), the entirety of which is herein incorporated by reference).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the macroprojectile stopping plate. If desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In bombardment transformation, one may optimize the prebombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment, and also the nature of the transforming DNA, such as linearized DNA or intact supercoiled plasmids. It is believed that pre-bombardment manipulations are especially important for successful transformation of immature embryos.

In another alternative embodiment, plastids can be stably transformed. Methods disclosed for plastid transformation in higher plants include particle gun delivery of DNA containing a selectable marker and targeting of the DNA to the plastid genome through homologous recombination (Svab et al. *Proc. Natl. Acad. Sci. USA* 87:8526-8530 (1990); Svab and Maliga *Proc. Natl. Acad. Sci. USA* 90:913-917 (1993)); Staub, J. M. and Maliga, P. *EMBO J.* 12:601-606 (1993), U.S. Pat. Nos. 5,451,513 and 5,545,818, all of which are herein incorporated by reference in their entirety).

Accordingly, it is contemplated that one may wish to adjust various aspects of the bombardment parameters in small scale studies to fully optimize the conditions. One may particularly wish to adjust physical parameters such as gap distance, flight distance, tissue distance, and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

*Agrobacterium*-mediated transfer is a widely applicable system for introducing genes into plant cells because the DNA can be introduced into whole plant tissues, thereby bypassing the need for regeneration of an intact plant from a protoplast. The use of *Agrobacterium*-mediated plant integrating vectors to introduce DNA into plant cells is well known in the art. See, for example the methods described (Fraley et al., *Biotechnology* 3:629-635 (1985); Rogers et al., *Meth. In Enzymol*, 153:253-277 (1987), both of which are herein incorporated by reference in their entirety). Further, the integration of the Ti-DNA is a relatively precise process resulting in few rearrangements. The region of DNA to be transferred is defined by the border sequences, and intervening DNA is usually inserted into the plant genome as described (Spielmann et al., *Mol. Gen. Genet.*, 205:34 (1986), the entirety of which is herein incorporated by reference).

Modern *Agrobacterium* transformation vectors are capable of replication in *E. coli* as well as *Agrobacterium*, allowing for convenient manipulations as described (Klee et al., In: *Plant DNA Infectious Agents*, T. Hohn and J. Schell, eds., Springer-Verlag, New York, pp. 179-203 (1985), the entirety of which is herein incorporated by reference). Moreover, recent technological advances in vectors for *Agrobacterium*-mediated gene transfer have improved the arrangement of genes and restriction sites in the vectors to facilitate construction of vectors capable of expressing various polypeptide coding genes. The vectors described have convenient multi-linker regions flanked by a promoter and a polyadenylation site for direct expression of inserted polypeptide coding genes and are suitable for present purposes (Rogers et al., *Meth. In Enzymol.*, 153:253-277 (1987), the entirety of which is herein incorporated by reference). In addition, *Agrobacterium* containing both armed and disarmed Ti genes can be used for the transformations. In those plant strains where *Agrobacterium*-mediated transformation is efficient, it is the method of choice because of the facile and defined nature of the gene transfer.

A transgenic plant formed using *Agrobacterium* transformation methods typically contains a single gene on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and out-crossing with a non-transgenic plant are also contemplated, as is vegetative propagation.

Transformation of plant protoplasts can be achieved using methods based on calcium phosphate precipitation, polyethylene glycol treatment, electroporation, and combinations of these treatments. See for example (Potrykus et al., *Mol. Gen. Genet.*, 205:193-200 (1986); Lorz et al., *Mol. Gen. Genet.*, 199:178, (1985); Fromm et al., *Nature*, 319:791, (1986); Uchimiya et al., *Mol. Gen. Genet.:*204:204, (1986); Callis et al., *Genes and Development*, 1183, (1987); Marcotte et al., *Nature*, 335:454, (1988), all of which the entirety is herein incorporated by reference).

Application of these systems to different plant strains depends upon the ability to regenerate that particular plant strain from protoplasts. Illustrative methods for the regeneration of cereals from protoplasts are described (Fujimura et al., *Plant Tissue Culture Letters*, 2:74, (1985); Toriyama et al., *Theor Appl. Genet.* 205:34. (1986); Yamada et al., *Plant Cell Rep.*, 4:85, (1986); Abdullah et al., *Biotechnology*, 4:1087, (1986), all of which the entirety is herein incorporated by reference).

To transform plant strains that cannot be successfully regenerated from protoplasts, other ways to introduce DNA into intact cells or tissues can be utilized. For example, regeneration of cereals from immature embryos or explants can be effected as described (Vasil, *Biotechnology*, 6:397, (1988), the entirety of which is herein incorporated by reference). In addition, "particle gun" or high-velocity microprojectile technology can be utilized (Vasil et al., *Bio/Technology* 10:667, (1992), the entirety of which is herein incorporated by reference).

Using the latter technology, DNA is carried through the cell wall and into the cytoplasm on the surface of small metal particles as described (Klein et al., *Nature*, 328:70, (1987); Klein et al., *Proc. Natl. Acad. Sci. USA*, 85:8502-8505, (1988); McCabe et al., *Biotechnology*, 6:923, (1988), all of which the entirety is herein incorporated by reference). The metal particles penetrate through several layers of cells and thus allow the transformation of cells within tissue explants.

Other methods of cell transformation can also be used and include but are not limited to introduction of DNA into plants by direct DNA transfer into pollen (Hess et al., *Intern Rev. Cytol.*, 107:367, (1987); Luo et al., *Plant Mol. Biol. Reporter*, 6:165, (1988), all of which the entirety is herein incorporated by reference), by direct injection of DNA into reproductive organs of a plant (Pena et al., *Nature*, 325:274, (1987), the entirety of which is herein incorporated by reference), or by direct injection of DNA into the cells of immature embryos followed by the rehydration of desiccated embryos (Neuhaus et al., *Theor. Appl. Genet.*, 75:30, (1987), the entirety of which is herein incorporated by reference).

The regeneration, development, and cultivation of plants from single plant protoplast transformants or from various transformed explants is well known in the art (Weissbach and Weissbach, In: *Methods for Plant Molecular Biology*, (Eds.), Academic Press, Inc., San Diego, Calif., (1988), the entirety of which is herein incorporated by reference). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants, as discussed before. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens*, and obtaining transgenic plants have been published for cotton (U.S. Pat. No. 5,004,863, U.S. Pat. No. 5,159,135, U.S. Pat. No. 5,518,908, all of which the entirety is herein incorporated by reference); rice (U.S. Pat. No. 5,569,834, U.S. Pat. No. 5,416,011, McCabe et al., *Biotechnology* 6:923, (1988), Christou et al., *Plant Physiol.*, 87:671-674 (1988), all of which the entirety is herein incorporated by reference); *Brassica* (U.S. Pat. No. 5,463,174, the entirety of which is herein incorporated by reference); peanut (Cheng et al., *Plant Cell Rep.* 15:653-657 (1996), McKently et al., *Plant Cell Rep.* 14:699-703 (1995), all of which the entirety is herein incorporated by reference); papaya (Yang et al., (1996), the entirety of which is herein incorporated by reference); pea (Grant et al., *Plant Cell Rep.* 15:254-258, (1995), the entirety of which is herein incorporated by reference).

Transformation of monocotyledons using electroporation, particle bombardment, and *Agrobacterium* have also been reported. Transformation and plant regeneration have been achieved in asparagus (Bytebier et al., *Proc. Natl. Acad. Sci. USA* 84:5345, (1987), the entirety of which is herein incorporated by reference); barley (Wan and Lemaux, *Plant Physiol* 104:37, (1994), the entirety of which is herein incorporated by reference); maize (Rhodes et al., *Science* 240:204, (1988), Gordon-Kamm et al., *Plant Cell*, 2:603, (1990), Fromm et al., *Bio/Technology* 8:833, (1990), Koziel et al., *Bio/Technology* 11:194, (1993), Armstrong et al., *Crop Science* 35:550-557, (1995), all of which the entirety is herein incorporated by reference); oat (Somers et al., *Bio/Technology*, 10:1589, (1992), the entirety of which is herein incorporated by reference); orchardgrass (Horn et al., *Plant Cell Rep.* 7:469, (1988), the entirety of which is herein incorporated by reference); rice (Toriyama et al., *Theor Appl. Genet.* 205:34, (1986); Park et al., *Plant Mol. Biol.*, 32:1135-1148, (1996); Abedinia et al., *Aust. J. Plant Physiol.* 24:133-141, (1997); Zhang and Wu, *Theor. Appl. Genet.* 76:835, (1988); Zhang et al., *Plant Cell Rep.* 7:379, (1988); Battraw and Hall, *Plant Sci.* 86:191-202, (1992); Christou et al., *Bio/Technology* 9:957, (1991), all of which the entirety is herein incorporated by reference); sugarcane (Bower and Birch, *Plant J.* 2:409, (1992), the entirety of which is herein incorporated by reference); tall fescue (Wang et al., *Bio/Technology* 10:691, (1992), the entirety of which is herein incorporated by reference), and wheat (Vasil et al., Bio/Technology 10:667, (1992), the entirety of which is herein incorporated by reference; U.S. Pat. No. 5,631,152, the entirety of which is herein incorporated by reference.

Assays for gene expression based on the transient expression of cloned nucleic acid constructs have been developed by introducing the nucleic acid molecules into plant cells by polyethylene glycol treatment, electroporation, or particle bombardment (Marcotte, et al., *Nature*, 335:454-457 (1988); Marcotte, et al., *Plant Cell*, 1:523-532 (1989); McCarty, et al., *Cell* 66:895-905 (1991); Hattori, et al., *Genes Dev.* 6:609-618 (1992); Goff, et al., *EMBO J.* 9:2517-2522 (1990), all of which are herein incorporated by reference in their entirety). Transient expression systems may be used to functionally dissect gene constructs (See generally, Mailga et al., *Methods in Plant Molecular Biology*, Cold Spring Harbor Press (1995)).

Any of the nucleic acid molecules of the present invention may be introduced into a plant cell in a permanent or transient manner in combination with other genetic elements such as vectors, promoters enhancers etc. Further any of the nucleic acid molecules of the present invention may be introduced into a plant cell in a manner that allows for over expression of the protein or fragment thereof encoded by the nucleic acid molecule.

Nucleic acid molecules of the present invention may be used in cosuppression. Cosuppression is the reduction in expression levels, usually at the level of RNA, of a particular endogenous gene or gene family by the expression of a homologous sense construct that is capable of transcribing mRNA of the same strandedness as the transcript of the endogenous gene (Napoli et al., *Plant Cell* 2:279-289 (1990); van der Krol et al., *Plant Cell* 2:291-299 (1990), both of which are herein incorporated by reference in their entirety). Cosuppression may result from stable transformation with a single copy nucleic acid molecule that is homologous to a nucleic acid sequence found with the cell (Prolls and Meyer, *Plant J.* 2:465-475 (1992), the entirety of which is herein incorporated by reference) or with multiple copies of a nucleic acid molecule that is homologous to a nucleic acid sequence found with the cell (Mittlesten et al., *Mol. Gen. Genet.* 244: 325-330 (1994), the entirety of which is herein incorporated by reference). Genes, even though different, linked to homologous promoters may result in the cosuppression of the linked genes (Vaucheret, C R. *Acad. Sci. III* 316: 1471-1483 (1993), the entirety of which is herein incorporated by reference).

This technique has, for example been applied to generate white flowers from red petunia and tomatoes that do not ripen on the vine. Up to 50% of petunia transformants that contained a sense copy of the chalcone synthase (CHS) gene produced white flowers or floral sectors; this was as a result of the post-transcriptional loss of mRNA encoding CHS (Flavell, *Proc. Natl. Acad. Sci. USA* 91:3490-3496 (1994)), the entirety of which is herein incorporated by reference). Cosuppression may require the coordinate transcription of the transgene and the endogenous gene, and can be reset by a developmental control mechanism (Jorgensen, *Trends Biotechnol,* 8:340344 (1990); Meins and Kunz, In: *Gene Inactivation and Homologous Recombination in Plants* (Paszkowski, J., ed.), pp. 335-348. Kluwer Academic, Netherlands (1994), both of which are herein incorporated by reference in their entirety).

It is understood that one or more of the nucleic acids of the present invention comprising SEQ ID NO:1 or complement thereof through SEQ ID NO: 69652 or complement thereof or fragment thereof or other nucleic acid molecules of the present invention, may be introduced into a plant cell and transcribed using an appropriate promoter with such transcription resulting in the co-suppression of an endogenous protein.

Nucleic acid molecules of the present invention may be used to reduce gene function. Antisense approaches are a way of preventing or reducing gene function by targeting the genetic material (Mol et al., *FEBS Lett.* 268:427-430 (1990), the entirety of which is herein incorporated by reference). The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., *In Genetic Engineering*, Setlow (ed.), Vol. 11, New York: Plenum 49-63 (1989), the entirety of which is herein incorporated by reference).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55:569-597 (1986), the entirety of which is herein incorporated by reference). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25:155-184 (1990), the entirety of which is herein incorporated by reference). An antisense vector is constructed by standard procedures and introduced into cells by transformation, transfection, electroporation, microinjection, or by infection, etc. The type of transformation and choice of vector will determine whether expression is transient or stable. The promoter used for the antisense gene may influence the level, timing, tissue, specificity, or inducibility of the antisense inhibition.

It is understood that protein synthesis activity in a plant cell may be reduced or depressed by growing a transformed plant cell containing a nucleic acid molecule of the present invention.

Antibodies have been expressed in plants (Hiatt et al., *Nature* 342:76-78 (1989); Conrad and Fielder, *Plant Mol. Biol.* 26:1023-1030 (1994), both of which are herein incorporated by reference in their entirety). Cytoplasmic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16:4489-4496 (1997); Marion-Poll, *Trends in Plant Science* 2:447-448 (1997), both of which are herein incorporated by reference in their entirety). For example, expressed anti-abscisic antibodies reportedly result in a general perturbation of seed development (Philips et al., *EMBO J.* 16:4489-4496 (1997)).

Nucleic acid molecules of the present invention may be used as antibodies. Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997); Baca et al., *Ann. Rev. Biophys. Biomol. Struct.* 26:461-493 (1997), both of which are herein incorporated by reference in their entirety). The catalytic abilities of abzymes may be enhanced by site directed mutagenesis. Examples of abzymes are, for example, set forth in U.S. Pat. No. 5,658,753; U.S. Pat. No. 5,632,990; U.S. Pat. No. 5,631,137; U.S. Pat. No. 5,602,015; U.S. Pat. No. 5,559,538; U.S. Pat. No. 5,576,174; U.S. Pat. No. 5,500,358; U.S. Pat. No. 5,318,897; U.S. Pat. No. 5,298,409; U.S. Pat. No. 5,258,289 and U.S. Pat. No. 5,194,585, all of which are herein incorporated in their entirety.

It is understood that any of the antibodies of the present invention may be expressed in plants and that such expression can result in a physiological effect. It is also understood that any of the expressed antibodies may be catalytic.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995); Birren et al., *Genome Analysis: Analyzing DNA,* 1, Cold Spring Harbor, N.Y. (1998), both of which are herein incorporated by reference in their entirety).

The nucleotide sequence provided in SEQ ID NO:1, through SEQ ID NO: 69652 or fragment thereof, or complement thereof, or a nucleotide sequence at least 90% identical, preferably 95%, identical even more preferably 99% or 100% identical to the sequence provided in SEQ ID NO:1 through SEQ ID NO: 69652 or fragment thereof, or complement thereof, can be "provided" in a variety of mediums to facilitate use fragment thereof. Such a medium can also provide a subset thereof in a form that allows a skilled artisan to examine the sequences.

In a preferred embodiment, 20, preferably 50, more preferably 100, even more preferably 1,000, 2,000, 3,000, or 4,000 of the nucleic acid sequences of the present invention can be provided in a variety of mediums.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g., text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990)) and BLAZE (Brutlag et al., *Comp. Chem.* 17:203-207 (1993), the entirety of which is herein incorporated by reference) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available and can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above, and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention.

Having now generally described the invention, the same will be more readily understood through reference to the following examples which are provided by way of illustration, and are not intended to be limiting of the present invention, unless specified.

Example 1

BACs are stable, non-chimeric cloning systems having genomic fragment inserts (100-300 kb) and their DNA can be prepared for most types of experiments including DNA sequencing. BAC vector, pBeloBAC11, is derived from the endogenous *E. coli* F-factor plasmid, which contains genes for strict copy number control and unidirectional origin of DNA replication. Additionally, pBeloBAC11 has three unique restriction enzyme sites (Hind III, Bam HI and Sph I) located within the LacZ gene which can be used as cloning sites for megabase-size plant DNA. Indigo, another BAC vector contains Hind III and Eco RI cloning sites. This vector also contains a random mutation in the LacZ gene that allows for darker blue colonies.

As an alternative, the P1-derived artificial chromosome (PAC) can be used as a large DNA fragment cloning vector (Ioannou, et al., *Nature Genet.* 6:84-89 (1994); Suzuki, et al., *Gene* 199:133-137 (1997), both of which are herein incorporated by reference in their entirety). The PAC vector has most of the features of the BAC system, but also contains some of the elements of the bacteriophage P1 cloning system.

BAC libraries are generated by ligating size-selected restriction digested DNA with pBeloBAC11 followed by electroporation into *E. coli*. BAC library construction and characterization is extremely efficient when compared to YAC (yeast artificial chromosome) library construction and analysis, particularly because of the chimerism associated with YACs and difficulties associated with extracting YAC DNA.

There are general methods for preparing megabase-size DNA from plants. For example, the protoplast method yields megabase-size DNA of high quality with minimal breakage. The process involves preparing young leaves which are manually feathered with a razor-blade before being incubated for four to five hours with cell-wall-degrading enzymes. The second method developed by Zhange et al., *Plant J.* 7:175-184 (1995), the entirety of which is herein incorporated by reference, is a universal nuclei method that works well for several divergent plant taxa. Fresh or frozen tissue is homogenized with a blender or mortar and pestle. Nuclei are then isolated and embedded. DNA prepared by the nucleic method is often more concentrated and is reported to contain lower amounts of chloroplast DNA than the protoplast method.

Once protoplasts or nuclei are produced, they are embedded in an agarose matrix as plugs or microbeads. The agarose provides a support matrix to prevent shearing of the DNA while allowing enzymes and buffers to diffuse into the DNA. The DNA is purified and manipulated in the agarose and is stable for more than one year at 4° C.

Once high molecular weight DNA has been prepared, it is fragmented to the desired size range. In general, DNA fragmentation utilizes two general approaches, 1) physical shearing and 2) partial digestion with a restriction enzyme that cuts relatively frequently within the genome. Since physical shearing is not dependent upon the frequency and distribution of particular restriction enzymes sites, this method should yield the most random distribution of DNA fragments. However, the ends of the sheared DNA fragments must be repaired and cloned directly or restriction enzyme sites added by the addition of synthetic linkers. Because of the subsequent steps required to clone DNA fragmented by shearing, most protocols fragment DNA by partial restriction enzyme digestion. The advantage of partial restriction enzyme digestion is that no further enzymatic modification of the ends of the restriction fragments are necessary. Four common techniques that can be used to achieve reproducible partial digestion of megabase-size DNA are 1) varying the concentration of the restriction enzyme, 2) varying the time of incubation with the restriction enzyme 3) varying the concentration of an enzyme cofactor (e.g., $Mg^{2+}$) and 4) varying the ratio of endonuclease to methylase.

There are three cloning sites in pBeloBAC11, but only Hind III and Bam HI produce 5' overhangs for easy vector dephosphorylation. These two restriction enzymes are primarily used to construct BAC libraries. The optimal partial digestion conditions for megabase-size DNA are determined by wide and narrow window digestions. To optimize the optimum amount of Hind III, 1, 2, 3, 10, and 5-units of enzyme are each added to 50 ml aliquots of microbeads and incubated at 37° C. for 20 minutes.

After partial digestion of megabase-size DNA, the DNA is run on a pulsed-field gel, and DNA in a size range of 100-500 kb is excised from the gel. This DNA is ligated to the BAC vector or subjected to a second size selection on a pulsed field gel under different running conditions. Studies have previously reported that two rounds of size selection can eliminate small DNA fragments co-migrating with the selected range in the first pulse-field fractionation. Such a strategy results in an increase in insert sizes and a more uniform insert size distribution. A practical approach to performing size selections is to first test for the number of clones/microliter of ligation and insert size from the first size selected material. If the numbers are good (500 to 2000 white colony/microliter of ligation) and the size range is also good (50 to 300 kb) then a second size selection is practical. When performing a second size selection one expects a 80 to 95% decrease in the number of recombinant clones per transformation.

Twenty to two hundred nanograms of the size-selected DNA is ligated to dephosphorylated BAC vector (molar ratio of 10 to 1 in BAC vector excess). Most BAC libraries use a molar ratio of 5 to 15:1 (size selected DNA:BAC vector).

Transformation is carried out by electroporation and the transformation efficiency for BACs is about 40 to 1,500 transformants from one microliter of ligation product or 20 to 1000 transformants/ng DNA.

Several tests can be carried out to determine the quality of a BAC library. Three basic tests to evaluate the quality include: the genome coverage of a BAC library-average insert size, average number of clones hybridizing with single copy probes and chloroplast DNA content.

The determination of the average insert size of the library is assessed in two ways. First, during library construction every ligation is tested to determine the average insert size by assaying 20-50 BAC clones per ligation. DNA is isolated from recombinant clones using a standard mini preparation protocol, digested with Not I to free the insert from the BAC vector and then sized using pulsed field gel electrophoresis (Maule, *Molecular Biotechnology* 9:107-126 (1998), the entirety of which is herein incorporated by reference).

To determine the genome coverage of the library, it is screened with single copy RFLP markers distributed randomly across the genome by hybridization. Microtiter plates containing BAC clones are spotted onto Hybond membranes. Bacteria from 48 or 72 plates are spotted twice onto one membrane resulting in 18,000 to 27,648 unique clones on each membrane in either a 4×4 or 5×5 orientation. Since each clone is present twice, false positives are easily eliminated and true positives are easily recognized and identified.

Finally, the chloroplast DNA content in the BAC library is estimated by hybridizing three chloroplast genes spaced evenly across the chloroplast genome to the library on high density hybridization filters.

There are strategies for isolating rare sequences within the genome. For example, higher plant genomes can range in size from 100 Mb/1 C (*Arabidopsis*) to 15,966 Mb/C (*Triticum aestivum*), (Arumuganathan and Earle, *Plant Mol Bio Rep.* 9:208-219 (1991), the entirety of which is herein incorporated by reference). The number of clones required to achieve a given probability that any DNA sequence will be represented in a genomic library is $N=(\ln(1-P))/(\ln(1-L/G))$ where N is the number of clones required, P is the probability desired to get the target sequence, L is the length of the average clone insert in base pairs and G is the haploid genome length in base pairs (Clarke et al., *Cell* 9:91-100 (1976) the entirety of which is herein incorporated by reference).

The rice BAC library of the present invention is constructed in the pBeloBAC11 or similar vector. Inserts are generated by partial Eco RI or other enzymatic digestion of DNA. The 25× library provides 4-5× coverage sequence from BAC clones across genome.

Example 2

Two basic methods can be used for DNA sequencing, the chain termination method of Sanger et al., *Proc. Natl. Acad. Sci. USA* 74:5463-5467 (1977), the entirety of which is herein incorporated by reference and the chemical degradation method of Maxam and Gilbert, *Proc. Natl. Acad. Sci. USA* 74:560-564 (1977), the entirety of which is herein incorporated by reference. Automation and advances in technology such as the replacement of radioisotopes with fluorescence-based sequencing have reduced the effort required to sequence DNA (Craxton, *Methods*, 2:20-26 (1991); Ju et al., *Proc. Natl. Acad. Sci. USA* 92:4347-4351 (1995); Tabor and Richardson, *Proc. Natl. Acad. Sci. USA* 92:6339-6343 (1995), all of which are herein incorporated by reference in their entirety). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415-1419 (1990); Smith, *Nature* 349:812-813 (1991); Luckey et al., *Methods Enzymol.* 218:154-172 (1993); Lu et al., *J. Chromatog. A.* 680:497-501 (1994); Carson et al., *Anal. Chem.* 65:3219-3226 (1993); Huang et al., *Anal. Chem.* 64:2149-2154 (1992); Kheterpal et al., *Electrophoresis* 17:1852-1859 (1996); Quesada and Zhang, *Electrophoresis* 17:1841-1851 (1996); Baba, Yakugaku Zasshi 117: 265-281 (1997), all of which are herein incorporated by reference in their entirety).

A number of sequencing techniques are known in the art, including fluorescence-based sequencing methodologies. These methods have the detection, automation and instrumentation capability necessary for the analysis of large volumes of sequence data. Currently, the 377 DNA Sequencer (Perkin-Elmer Corp., Applied Biosystems Div., Foster City, Calif.) allows the most rapid electrophoresis and data collection. With these types of automated systems, fluorescent dye-labeled sequence reaction products are detected and data entered directly into the computer, producing a chromatogram that is subsequently viewed, stored, and analyzed using the corresponding software programs. These methods are known to those of skill in the art and have been described and reviewed (Birren et al., *Genome Analysis: Analyzing DNA*, 1, Cold Spring Harbor, N.Y. (1999), the entirety of which is herein incorporated by reference).

PHRED is used to call the bases from the sequence trace files (on the Worldwide web at mbt.washington.edu). Phred uses Fourier methods to examine the four base traces in the region surrounding each point in the data set in order to predict a series of evenly spaced predicted locations. That is, it determines where the peaks would be centered if there were no compressions, dropouts, or other factors shifting the peaks from their "true" locations. Next, PHRED examines each trace to find the centers of the actual, or observed peaks and the areas of these peaks relative to their neighbors. The peaks are detected independently along each of the four traces so many peaks overlap. A dynamic programming algorithm is used to match the observed peaks detected in the second step with the predicted peak locations found in the first step.

After the base calling is completed, contaminating sequences (*E. coli*, BAC vector sequences>50 bases and sub-cloning vector are removed and constraints are made for the assembler. Contigs are assembled using CAP3 (Huang, et al., *Genomics* 46: 37-45 (1997) the entirety of which is herein incorporated by reference).

Example 3

This example illustrates the identification of combigenes within the rice genomic contig library as assembled in Example 2. The genes and partial genes embedded in such contigs are identified through a series of informatic analyses. The tools to define genes fall into two categories: homology-based and predictive-based methods. Homology-based searches (e.g., GAP2, BLASTX supplemented by NAP and TBLASTX) detect conserved sequences during comparisons of DNA sequences or hypothetically translated protein sequences to public and/or proprietary DNA and protein databases. Existence of an *Oryza sativa* gene is inferred if significant sequence similarity extends over the majority of the target gene. Since homology-based methods may overlook genes unique to *Oryza sativa*, for which homologous nucleic acid molecules have not yet been identified in databases, gene prediction programs are also used. Predictive methods employed in the definition of the *Oryza sativa* genes included the use of the GenScan gene predictive software program which is available from Stanford University (e.g. at the web site gnomic/stanford.edu/GENSCANW.html). GenScan, in general terms, infers the presence and extent of a gene through a search for "gene-like" grammar.

The homology-based methods used to define the *Oryza sativa* gene set included GAP2, BLASTX supplemented by NAP and TBLASTX. For a description of BLASTX and TBLASTX see Coulson, *Trends in Biotechnology* 12:76-80 (1994) and Birren et al., *Genome Analysis*, 1:543-559 (1997). GAP2 and NAP are part of the Analysis and Annotation Tool (AAT) for Finding Genes in Genomic Sequences which was developed by Xiaoqiu Huang at Michigan Tech University and is available at the web site genome.cs.mtu.edu/. The AAT package includes two sets of programs, one set DPS/NAP (referred to as "NAP") for comparing the query sequence with a protein database, and the other set DDS/GAP2 (referred to as "GAP2") for comparing the query sequence with a cDNA database. Each set contains a fast database search program and a rigorous alignment program. The database search program quickly identifies regions of the query sequence that are similar to a database sequence. Then the alignment program constructs an optimal alignment for each region and the database sequence. The alignment program also reports the coordinates of exons in the query sequence. See Huang, et al., *Genomics* 46: 37-45 (1997).

The GAP2 program computes an optimal global alignment of a genomic sequence and a cDNA sequence without penalizing terminal gaps. A long gap in the cDNA sequence is given a constant penalty. The DNA-DNA alignment by GAP2 adjusts penalties to accommodate introns. The GAP2 program makes use of splice site consensuses in alignment computation. GAP2 delivers the alignment in linear space, so long sequences can be aligned. See Huang, *Computer Applications in the Biosciences* 10 227-235 (1994). The GAP2 program aligned the *Oryza sativa* contigs with a library of *Oryza sativa* 25,384 cDNAs.

The NAP program computes a global alignment of a DNA sequence and a protein sequence without penalizing terminal gaps. NAP handles frameshifts and long introns in the DNA sequence. The program delivers the alignment in linear space, so long sequences can be aligned. It makes use of splice site consensuses in alignment computation. Both strands of the DNA sequence are compared with the protein sequence and one of the two alignments with the larger score is reported. See Huang, and Zhang, "*Computer Applications in the Biosciences* 12(6), 497-506 (1996).

NAP takes a nucleotide sequence, translates it in three forward reading frames and three reverse complement reading frames, and then compares the six translations against a protein sequence database (e.g. the non-redundant protein (i.e., nr-aa) database maintained by the National Center for Biotechnology Information as part of GenBank and available on the Worldwide web at ncbi.nlm.nih.gov).

The first homology-based search for genes in the *Oryza sativa* contigs is effected using the GAP2 program and the *Oryza sativa* library of clustered *Oryza sativa* cDNA. The *Oryza sativa* clusters are mapped onto an assembly of *Oryza sativa* contigs represented by SEQ ID NO. 1 through SEQ ID NO. 69652 using the GAP2 program. GAP2 standards for selecting a DNA-DNA match were ≧82% sequence identity with the following parameters:

gap extension penalty=1
match score=2
gap open penalty=6
gap length for constant penalty=20
mismatch penalty=−2
minimum exon length=21

When a particular *Oryza sativa* cDNA aligns to more than one *Oryza sativa* contig, the alignment with the highest identity is selected and alignments with lower levels of identity are filtered out as surreptitious alignments. *Oryza sativa* cDNA sequences aligning to *Oryza sativa* contigs with exceptionally low complexity were filtered out when the basis for alignment included a high number of cDNAs with poly A tails aligning to genomic regions with extended repeats of A or T.

The second homology-based method used for gene discovery is BLASTX hits extended with the NAP software package. BLASTX is run with the *Oryza sativa* genomic contigs represented by SEQ ID NO. 1 through SEQ ID NO. 69652 as queries against the GenBank non-redundant protein data library identified as "nr-aa". NAP is used to better align the amino acid sequences as compared to the genomic sequence. NAP extends the match in regions where BLASTX has identified high-scoring-pairs (HSPs), predicts introns, and then links the exons into a single ORF prediction. Experience suggests that NAP tends to mis-predict the first exon. The NAP parameters are:

gap extension penalty=1
gap open penalty=15
gap length for constant penalty=25
min exon length (in aa)=7
homology>30%

The NAP alignment score and GenBank reference number for best match are reported for each contig for which there is a NAP hit.

In the final homology-based method, TBLASTX, is used with cDNA information from three plant sequencing projects: 12,217 sequences from *Triticum aestivum*, 101,574 sequences from *Glycine max*, 113,242 sequences from *Zea mays* and 56,754 sequences from *Arabidopsis thaliana*. Conservative standards for inclusion of TBLASTX hits into the gene set are utilized. These standards are a minimal E value of 1E-20, and for terminal exons, a minimal match of 200 bp within the 1000 most 5' and 3' ends of an *Oryza sativa* contig.

The GenScan program is "trained" with *Arabidopsis thaliana* characteristics. Though better than the "off-the-shelf" version, the GenScan trained to identify *Oryza sativa* genes proved more proficient at predicting exons than predicting full-length genes. Predicting full-length genes is compromised by point mutations in the unfinished contigs, as well as by the short length of the contigs relative to the typical length of a gene. Due to the errors found in the full-length gene predictions by GenScan, inclusion of GenScan-predicted genes is limited to those genes and exons whose probabilities are above a conservative probability threshold. The GenScan parameters are:

weighted mean GenScan P value>0.4
mean GenScan T value>0
mean GenScan Coding score>50
length>200 bp
minimum TBLASTX E value<1E-20

The weighted mean GenScan P value is a probability for correctly predicting ORFs or partial ORFs and is defined as the $(1/\Sigma l_i)(\Sigma l_i P_i)$, where "l" is the length of a exon and "P" is the probability or correctness for the exon.

The gene predictions from these programs are stored in a database and then combigenes are derived from these predictions. A combigene is a cluster of putative genes which satisfy the following criteria: 1) all genes making up a single combigene are located on the same strand of a contig 2) individual genes have at least 100 bp overlap with each other 3) if an individual gene is predicted by NAP it has at least 30% sequence identity to its hit 4) if an individual gene is predicted by GAP2 it has at least 85% sequence identity to its hit 5) if an individual gene is predicted by Genscan the weighted average of the probabilities calculated for all of its exons is not less than 0.4. The gene boundaries of a Genscan-predicted gene are determined while taking into account only exons. Since TBLASTX-predicted genes are standless the combigene which is made up of such genes can be assigned a strand only if there is a gene in the cluster that was predicted by a strand-defining gene-predicting program.

TABLE 1

The data in Table 1 of U.S. application Ser. No. 09/620,392 filed Jul. 19, 2000, now abandoned, (the entirety of which is incorporated by reference herein) are ordered by contigs. The combination genes are grouped by DNA strand location and sorted by their start position. The putative genes that make up a separate combigene are sorted by their start position.

*Column Headings:
  Seq num
    Provides the SEQ ID NO. for the listed sequences.
  Seq id
    Arbitrarily assigned name for each contig.
  Gene No.
    Arbitrarily assigned number for a combigene.
  Start
    Indicates the start position of the combigene gene.
  End
    Indicates the end position of the combigene gene.
  Strand
    Indicates the strand location of the gene (+/−).
  Name
    Indicates an arbitrarily assigned gene name based on the method used to predict the gene.
  Method
    Indicates the gene-predicting program used. These programs are GenScan, AAT/NAP, AAT/GAP or TBLASTX.
  Start
    The start position of the putative gene making up a combigene as predicted by the particular gene-predicting program used.
  End
    The end position of the putative gene making up a combigene as predicted by the particular gene-predicting program used.
  Exons
    The location of the exons found within the gene as determined by the gene-predicting program (Method).
  Score
    The aat_nap score is reported by the NAP program in the AAT package. It is an alignment score in which each match and mismatch is scored based on the BLOSUM62 scoring matrix.
  GI
    Each sequence in the GENBANK public database is arbitrarily assigned a unique NCBI gi (National Center for Biotechnology Information GenBank Identifier) number. In this table, the NCBI gi number which is associated (in the same row) with a given contig or singleton refers to the particular GENBANK sequence which is the best match for that sequence.
  Description
    The Description column provides a description of the NCBI gi referenced in the "GI" column.

| | | | |
|---|---|---|---|
| Seq. No. | 60151 | Seq. ID | OJ000330_03.0419.C31 |
| Gene No. | 125363 | Strand | + |
| Start | 235 | End | 338 |
| Name | OJ000330_03.0419.C31.o1.gs | Method | GENSCAN |
| Start | 235 | End | 338 |
| GI | none | Score | .83 |
| Exons | 235 . . . 338 | | |
| Seq. No. | 60151 | Seq. ID | OJ000330_03.0419.C31 |
| Gene No. | 125364 | Strand | + |
| Start | 1044 | End | 3133 |
| Name | OJ000330_03.0419.C31.o1.np | Method | AAT/NAP |
| Start | 1044 | End | 3096 |
| GI | 1935918 | Score | 1050 |
| Exons | 1044 . . . 1113, 1824 . . . 3096 | | |
| GI Descrip. | (U93559) putative serine/threonine protein kinase [*Brassica rapa*] | | |
| Seq. No. | 60151 | Seq. ID | OJ000330_03.0419.C31 |
| Gene No. | 125364 | Strand | + |
| Start | 1044 | End | 3133 |
| Name | OJ000330_03.0419.C31.o2.gs | Method | GENSCAN |
| Start | 1679 | End | 3133 |
| GI | none | Score | .98 |
| Exons | 1679 . . . 3133 | | |
| Seq. No. | 60151 | Seq. ID | OJ000330_03.0419.C31 |
| Name | OJ000330_03.0419.C31.o1.tc | Method | TBLASTX:Cress |
| Start | 1994 | End | 2986 |
| GI | none | Score | 73 |

-continued

| | | | |
|---|---|---|---|
| Exons | 1994 ... 2077, 2008 ... 2058, 2095 ... 2229, 2096 ... 2230, 2230 ... 2481, 2234 ... 2497, 2629 ... 2826, 2630 ... 2827, 2894 ... 2986 | | |
| Seq. No. | 60151 | Seq. ID | OJ000330_03.0419.C31 |
| Gene No. | 125365 | Strand | – |
| Start | 4825 | End | 5019 |
| Name | OJ000330_03.0419.C31.o1.tm | Method | TBLASTX:Maize |
| Start | 2008 | End | 2992 |
| GI | none | Score | 129 |
| Exons | 2008 ... 2058, 2102 ... 2257, 2104 ... 2280, 2249 ... 2518, 2266 ... 2469, 2635 ... 2802, 2636 ... 2830, 2894 ... 2992 | | |
| Seq. No. | 60151 | Seq. ID | OJ000330_03.0419.C31 |
| Gene No. | 125365 | Strand | – |
| Start | 4825 | End | 5019 |
| Name | OJ000330_03.0419.C31.o1.ts | Method | TBLASTX:Soybean |
| Start | 2167 | End | 2527 |
| GI | none | Score | 89 |
| Exons | 2167 ... 2232, 2168 ... 2236, 2240 ... 2527, 2329 ... 2469 | | |
| Seq. No. | 60151 | Seq. ID | OJ000330_03.0419.C31 |
| Gene No. | 125365 | Strand | – |
| Start | 4825 | End | 5019 |
| Name | OJ000330_03.0419.C31.o2.ts | Method | TBLASTX:Soybean |
| Start | 2626 | End | 2986 |
| GI | none | Score | 261 |
| Exons | 2626 ... 2826, 2627 ... 2827, 2894 ... 2986 | | |
| Seq. No. | 60151 | Seq. ID | OJ000330_03.0419.C31 |
| Gene No. | 125365 | Strand | – |
| Start | 4825 | End | 5019 |
| Name | OJ0003330_03.0419.C31.01.tw | Method | TBLASTX:Wheat |
| Start | 2663 | End | 2992 |
| GI | none | Score | 192 |
| Exons | 2663 ... 2827, 2668 ... 2805, 2894 ... 2992 | | |
| Seq. No. | 60151 | Seq. ID | OJ000330_03.0419.C31 |
| Gene No. | 125365 | Strand | – |
| Start | 4825 | End | 5019 |
| Name | OJ000330_03.0419.C31.o3.gs | Method | GENSCAN |
| Start | 4825 | End | 5019 |
| GI | none | Score | .81 |
| Exons | 4825 ... 5019 -- | | |

SEQUENCE LISTING (69652 sequences)

SEQ ID NO: 1 - DNA, 1906 bp, Oryza sativa
  unsure (1)..(1906): unsure at all n locations
cattaacggcctgaatacttattgtattccgtggaaatntactaattatatttgaaagtgaagcacactgcaatctcttatgtacatgttttancataanctcccccccccccnncccatgggnntttgattgattgattnacgcattgnaagnannccancanagggacttaaaaatcaagaacaagaacaatgataacaaaactgaagagccagtacatgacacttgatacacattgactccctggaaacaaaaccgtgaaacagaatatcacatacgctggtcatcctcaagagtaatgatatgccttcactgcaccattgatgctggcatggcatgaacccttctctagcataaaaaccgcgttatagccactccctggacatggcaattgctcagggttgtgtttcgccttggtggtggatttcgcgaggaagcctgtctttgcaagttatgcgcagctcctccaccaaatccacttctgctcgcctttctgctgcctttcgcctcggcgttgatcttcgcaatccaactcctttccttgtccttgaacttatcatgggctcaagttccttttttcgatcatgccactttagccatgaagacagaataagtacttcaagttaatgtcaattcaggtagcagcatattaaagcatgtggaagattgcaagaaacaaagtcaaaacagtgaatgggaaccacatctgggactttatttgggaacgatattgctttgaattattatgacactagtgcccaaattgttgccttagctatgcgaagaagagtagcacaaatattagcaataggatgcaaatttctgcatatgtgggcttgttcatgcagtgcaatcaattttagggcatggccgttaccttggttaatctctccttgagttttggtcttgtagatactaccactcgtgtcggctgagcatctgattttcgcagaaccaacttctgatgttgcagcttttttatccctctagtttgtagtttacttctctctgctgcctgaagcttcttggctacaattttcgcctctgccttttcaagcttcttcattattctttccctctctttattccataggaacattgatatcatctcaaactttatcctgtcatagctatcccaatccagcttatcttggcagtagtcaccatattttgctgcttctgcaatgctatttgaccatatgcgaagaacctcctgtcttgctttgacagccaccattcgccttttcccagatctttctcaatgcagcacctattttgtctttgcttgcttgtctgaaacaggatcagccatcgattgcttcagagtatgcatagacatgttttatatgcatccatctaggtagcagaaacacgcatttacctatgcaattgtcgatgtcctagcattttcttcctaacctgggaatattaaagaaaacaaaataacttgaattgaatttatgtagacaattcacagtccatagccaagtaggcctttggcagatacaagtgtcatgtgaaggtttcttacatgacatcaccttgggatctctaagagcctcggtagtccttcgcttgatgagttccttgtgctctacaggtgaatgagagactctcattgtattgtaataagagactgcgtatccactcattctaatgttaaatgtactgaggcaaaaaggacagaaagagcttggtcatacctttgcttagtttcctcccctgaggccagggaaaataaaaaccctcacctttgggcgtgaaccaaggttccggcttcctttaatttccttcattcgccaaccacttgtataagcattatcctgtcaaagttgaggcctgacaaggtgaaatgtttttgcactagcttcttaacatcctcttttttggcgatgggtgcgaacg

SEQ ID NO: 2 - DNA, 7600 bp, Oryza sativa
caaggtagtataaatgttacaggcttagagtaagtgttcataggccaaatgcgttattgattagggccaatttctcgaaaacgctcacctgagctatgccacattaccacattggacaaaaataggcgaaaaaaagagatgacattagaaagccatgggcattacctagcacaatggacggccgccgccatggttttgcggccttgcaccgcagcactctgttgctgtttcgaatcacctgggatgggaagatgcttcaaaaagaacaaaagaacaaatcaagtgagggcgggagagatgcgggatgaagcgagcagggaggagaggaggagagcagccacatcgtcgaccaagaaagaaggtgcgcgagtgcgaatggggatgagaggacgatgaccttatcccttctcctcgttcgtgtgctcgtctaagcccacgagatgatggtcctactagctacattgtcggcccacaagaggatgggcctccttgctacattgtcggcccacaagaggatgggcctactacaaaggcggcccactggatcggatttgctgaaacaggagctcaccggcgtcactgctcgtgttttgtggtgttgagttcgttcagcacacaaaaattcacaagacaaaaaacgaggagtttcagcaacaattaatcctatatatacatgcatgatgcatcaatggcgcatcgacaatggagaagaagagatgatctcaggatcgaagcgaggtccaggaggcaaagaggagaaggttccacgtgtcaggcagcccgggcaggcaccagtggctgcagtcggcgtacgatcccggctgccgcctttgctccggcgtcagcagcttccctcccctgaccgtgaacactgacgggtgcgcgtctcgccggagctccgacagccgggtgatgtccaggtaccccaccgccgtcctcgccctcctcacgttcctctccacgatcgacaccatccctctcgggaacgcctccacgtactcctccgccctcgccatcggagccgtctcgttgtagcaccagttcttgctgtgccaatgccaatcatgtcattgttttccaatgttaagatcaagtaattaagctgataatcagttgaaattcgatcgagtttacgaacttcttgtgctcgggggagatgctgcggaagaacaccatggtcttgtgagagtccacgtttcgatcgagccaccgcgtccatgtccggagcgcgcggttgaaggcttcctccgctcccatctccaccttctttccgttcctctccaggtgatcccacctgcaatgcagtagtcgtcaagtctgtgtcaagccatggacgcggatgattttgatgaggtctggagctgagaagccttacgccctgaacttgccggtgtgcgtccaccagtggcccgtgttgaacaccagcacgtcggcggcggcgagccggcgatacgtcgtcgccgggaggcggtccagcttcagcaccctggtctggtcgtcgaggtccaccaggaacgggctccagtagaactccaccgtgcagttgtaatcctgtccgtgatcgcaaaaaaagttcaactgaatttcggtttgatttgctgatgagtagtagtaaaatgcaaaagttttttttttttggtttgtctttagttaccaatgcttggaagatcttgtggtcggcgctggcgtcgtcgacggtggcgcgtgagcggtcgggcgccgcggcgtagaggatgcaggcgagcgactcccacatgttgcggttgagcgagtcgccgacgagcaccactcgcttgtcccggcactgctccagcatctccccaccacgcagcctgataaaaaagtgaagcattattcagtgcgacgtgtgcgatttgcagaggattactcatggagaatcaacacgattattccggtcggaatgatgcaccggaggaatcaggaacagtgaccggggttggttgtcatgtgtgcaactagtgtcaactatgtgtttcaaagtgaaaaataattaattactgccataacactagtagtactatgcacagggcactgtcagagctgtgttcccaactcaaaagcaacgcacatcgtcacaagttgacaactttacccacttttcatttaccttttgtatccaagaacgggccctgagacagtgcgacttgcacgggcttgttcattttagccatcgattacgactgtgtcacaggggatacacacacacaacggagagcattcatgaacgattcatgcgcatttcaaaaacaaatcagattcagaatctactaaagagaccagctttagtttgtctgtccaggatttaaaacaaaatgaagagaaatttcaaaaaggcagaagagatgcaaggtaggtagcagtggccacgcacctgagagcggcggcgcaccgcctgggctgccaccgccagtgctcgtagccggagtccggccggccgttcctccggcaggtgacctggtcgctcaagaaggggcactccccggcgtcgtagagcggatagccggccgggtcgtacacccagctgccgtcgaacaggtcgcaccggacttcatcctgggccggcgccggcgagccatcggaagcagcagcagtagctgggctcggcgcaggtgcagcagcaataatggcaatgcggtcgggcggcaatgagattgaggacgcctcgtccggtcgcttgacgggctccgggtcgtcttgggagaagaggagggcgcgggagaggagaaagagcgagaggcagccgagggcggcgccggcgaggcgcttgcgggtggccatggagggtggtttcagcttcaggggatccattgctagcttagctccaactgctacttcaccggttgctctgcctctgccactgcacttttcactgggatggatgtacacatctgcaactcggtagtagcagtgtatatactggagtggtactactaaaccataaaaagaaaaggaaaactcaaaactgaaaaacaaaatttggaatgtgttggttgagttgttgctacatggaggatgaagccaagcccccaagcagtgcattgtttggttggttttgcatctatttttatgtagttatgaactagtatgtggagtggacgagtggttgcgtttgggggcttgctgctgtctgtttgttccctcttcctttgccactgacactgtgtgtgtggatcttatctgagcttagctctgggacttgccatgtgccagcaaactgaaatcaaatgtattactccagcagctagtatccaattcaacagattgtttcaaactcaacttttttaaaaaaaactaaaccggcaggagaactgctaattatatttttaataagtaggagcaaagaccctagacgggttacaagagaagagtttcaaactcaactttgtagtacatatcttcctcttattcttaaaaaaaaagtgaactttgtacagattggaatcgtgcaaatcaggaatgggccgaaagtcattgtgggccaagcccctggtccaaagttcaccctccggccctggctggctaaggaataacgggcagcccaaactaaaatttaattcgctcgaaaaatagaagaaaaaaaaagaggaaaaagagagaggaaaggaaacccgagaccctcctcctcgacggcgtcggcagggagagggaggggcagagcggcggggaagagggagcgggatggcggcgtggtttaagctcggtggctccgctgtgcgcgccatgggcgctctccggggatcgccgccggcgatggtgcggtaacgccccccatttcccctttcttctcttctctagccggattgcacatcacaagcgcctctccacgatcgtgttcttccgttccgtgattctgcggcctcaacgttgctcccttaggacagcctactcatgcccatgagcccactcctctcctcaaggaagcaccccccagtcaccggcgcgcaaaaattgctccttttttgtttgaggaaattggggatatatttcgacgaaacccagtttcgaggatggcatatgtccaattttctcccttttggatagatggatggatggatagaaatctgtacatggctcaggaagccagaaacaacagcatctcaaaggcccaagaacatgtgggaaaaaaaatcacatcttctcttcaaaaaaaaattaaaaaatcacatctcgcaaatttctttcagttttgacggcccagcatctgagcatctctctagcaaattctctgcggttcccacaattcatcttaatcgtcagcttgttgttatgatcccagctcatcctcctgaattaaggaggatataacagtgggaaatagttaaaagccccccttaattcagcacgtttacacccaacagcatataacagttcacaacaatcaactcaagtacttggatacaaagtgtagcagagtggaattggggaattggggataagcaatataggatgggaattagataaaatagacagggaattggagaaacagatgtgggggttcaggtaagagcaaagaaggggatagagcccgcggccattcagttctttcaaaatgatcgatgatatccatcctagtggcgcctgtttccctttttgtagtggctgctcgatgccagcccattgggcctaacaagccatagcctatcttgtacactggcccagcccatatccatgacattcctccctctttaaggttcagcttgtccccaagctgatgcaattgagctacccaagccttgcctccagggtcccaagaaatcactatcattgtggttaagtcatcctgaatagcagccgactctttgaccacgaggtgcattggcaacactgacagacacaaggcaatgctgaaaagttggtaggatagttgcatcaccacaacaccatctatgtgaggaatagccaacccagaatcacaggtagtgtcaacctgcacctccatctttccagaattgtagtgattcaattggatctctgtaacaaactctcaaatattccaaggttctttccttaggaagtctaaacgagctggaaaatgttgaatcggagtaatgttggttctggattgaattccttcttgatgccataatggtctccagcaatgttgatgatgcctccatcacaccaacagaatagggaatggaaaatgattgtaattgtgattgctgtcgcatatttccccccagcagtagagggatctaaatgatgctgaatattcatagaagtctcccaggatttgcagcgcatccctctacatcttctctccagggagaatgcttacacgtacaacttacttgctgtaacttggagttggagttatactctacacttgactgcacttacacctacaatctttttgcagcatgaattgtaatattttccctttgtttcgtttgtatcaggcatcagtgttcaccggtggatggctcctggggtcttccatctccagctggcagacgctgaaggttgcggagcagcagatcgacgccctggcgagggagcaagaggagtacctcaacaagtttgaggccaagtgggtcgaggaacttaacaggctgaagctcgagatgatgaatgagctcgaggagtcggaggaacggcttaacagggagattgacgtcctcaagatgatggcgaggatagcgatggaggagaaggagatgaggatggcgatggaggaggaggctgcttctccaggtcctctccagggtgagtccggggacctcggtgacgtgtgactgatggcgaggatcatcggaggaggcttgcctgcgccagatgtggatgtgggtgatcgatatgtatctactagtatctaatctatcattgagcaatataacttgactactagccagatgtagaaagttgaggattacaacaacagtaaaagtaagctgtcttgcctgagacccagaaactaggaaccagcacagtcaactgctactagctctactcattactacatgatgagaaattgccagcttccatattatggtggtctcctccttgatgtttttttccaactaattgcatgctgaggaggcttcgacctctgctcaaatcccctctcttttcaagttagctaatagaccatcatgtacaatagtccatctactgcttaattcaggactagcaaaaatgcctgtgcgttacaacaggtgaaaattttttaatgataatatacgctttccatgcataatcatgtcaatgataataattgtatcgatcgttgtagctaagacatattataaagaaaattgaaacatcttcaatatactgatcttcaatataatgacccaatctcgacgatggcaaccttaccaatgcatgttttacccaaacgaattggattatttacgtagctggacacatgtaatctaaaatactctttcaatctcatttttgctattaataataggatcaatcaaatcctacattgtctcatattgtcaactatagacaaataaagcctcaatgcactcttctcttaataacaattaaaaatatgttatttattatctatacttaccagtagtctgataattacatacatagatatgtagggtctccaatacaggagaatataatcgtggaacacgagccatgtaggagatggaaaaatcgaggatcctatccaacccaaagcctcgatcaatttgatctcgttccaagaaaaccaagcctaagcaagacttcttttagatccgcacgtctgaacattcgatgacgctttggaaaacccaaaactaccaagacgatggacgatacaaatgatatgaatctttttcatgaaatcagatttttttttttgaaatcagacaatttttcgcattgcacagtactgaaccggaaatttttataaacgcaggtttttttctcacgttgggtcggtttattcggagcagtctattttatatatggcggttttttcttgtgtggagtcagacaatttttttagatcttttttctcgtgtggattcagatggtttttttggatcccctttttataacaatttttatttgacagtttatttcagagtggttttttatttcacgttgagtcggatattctttcgaacctttttttttaaatgatgcctttttctttggttgagtcgggtggtttgtttgaatcggtttcttttataaagaggattttttataaactacagtttttttcctccattttgagtcatacatttttttcttttttttttggacaagacgactttttttccttttttacggaagtcagacctatttcttttttacggatgagtcgtttttttcctttatttatgggaatcggacatgaaaagtttttttttcctttttagggagtcggacttttttttcgttttctttactggcgatattttttttccttttcttcagcagtcggaatttttttaccgatgggtttttttcctttttttacgggagtaccggagtaggacgtgagagttttttttttcttttttacaggactcggattattttttgtacggacaagttttttccccttttttacgggaattacggtagtcggtgatgaaatactgtaaatcatttgtcaaacccg

SEQ ID NO: 3 - DNA, 6040 bp, Oryza sativa
  unsure (1)..(6040): unsure at all n locations
cgcgggttatgacccttgtgaagacgtgagacccctttgttttacaccgactggctggtttttttcttctgcatcacgtagaatcggattcatttttttccttttttttcaccctttattttattttgacggacagcgaaaacatctttttaagtagtagagatagagatagagatatacctggagaccacctgaatttcgtttcaaacgtgaaacaactcagccatcccgaaggtttagagtacaactagtataatgaaaaattgtctcttcttcttcctcctcatcccggcgaacgatcagcctgattcgaccgtgagcgcgaggatcgccttgcctaaatagatttgtctcatcgattcttcttctttgattcaggtgttcttctcttgctcatctccgccttgcatgtactacgtagattgattccagattaattacttggattatattgttgtgggcaatatgtaggcactagctagtgtcatctcctgtccgattaatccatacatggctgtcgttgcaacttttttatattcatcaatgatcaattcttagtttgcattaaagaggatatatgcatcagtccatgcacctccatagaacagaacatagcaactttagttttcagatagagaaactattaaactctcgaggatacgttaccctctctgcagatatagatatatccctgtcccatattgtagttagtatatggacatactatcatcctctcaacattgtacttgtggttgctagctttgcacaggctaattaatctatctctgctctaattaagcatggcaaacaatcaggagcggccaaaatgcagctgcgtccagtccagctgcacccagctgtaagtacatacattaccgtctattgtgacgttagttagttagttaattagctaattgctcttactgctcaccgtctacttcttattttgccgtgcctaatttatctgcagatattgccggtgtttccgctcgcgttacttttgttcagacaactgcaattgttctggctgctacaacattaaatattacgaggatgcgatagaggagatttccgacatgatccagatgaaaaacccgaatgcatttgatcccaggattattgttagtgttcaagatgcaacggcagctgatccccagagctctactagtgctatttcagacccaaaaaacacctccgatgcaatgccggtaatatacctgtttctaatttcttattggagcaccaaacttaactgattccatgctattctagtctagctatttaattaattttgatgatgcatggttttaagtggcttgagaactcacgcatattcagtaaaatttcacggcaatgaacaacggaagcatgccaaagggtgcagctgcaggaagtccaagtgcaacaaactctactgtgaatgcttcaaggtgtgtatatactagtacttcgttttttacataaaacctatatttattagtattatgattagatggctgccttttatttccctcttcaagaacagtgtggggtgcactgcaaaatgcaagtgcctagagtgcagtaacagcttcggagtaaaaaatagtgagtgttcttctaaactgttatttccttgtctttcagatcagaagtgtgcgctcaattcgtttggaggccctgaagaatctcattttgctcttcacccgtgtcaatggttttgtcttgcctgtgttttttatctgacctattttatacaaaacaggtgaatcaagcaacaaaccagatccagatgataagagtgctactgacggcctgacacatgaagaaacaactacggaaaacatcacgctacctggggaaacctggaactctgatccaaacaaacgcccaagatattttgtaagtttttcgccctttaacttctttaatatagtttaccaatagaaactgtaaacttaattacaatgtgttaaacttgtcataacctgttcaaactgaaactctgacgatatgctcttttgttcagtgacaaactgacaacaactttcatatcatgatgatttaccgtcctccaggcagtgatcactttctgccaaaaaaaacgcaactgtaaacacaaccaggtttcagtatcgaggggtatctatacattaattcttctctagtatgaggtttttaagtcatgcaaaagtttgttcggctttagtagtatgtaagaatatatatataaacatgattgcaaggacacttgtacataatatacaaggcagctgccttgccttctttagaaaaaaaaaacagacaaacaaaaatgattgcaaggaaaggagcctcaactgcattattggcacttggtgacatatgctcaaaatccttaataagtaacagagcacaatcaagccttggcctccacatagttaacaccattccattccacgtactgttgcgactgtgtagtgcacaagtttacttccataaagctttattcggttaatccccgtatgggagagattgagggggattaattccacacctcaataggtgtgaaattattcatctccaaattctcctcaatccccttgtgagtgggattaaccgaactagtccttagcgggatctgtcgaggccaagccttgagctgagccacttgccaacgtcgtccatctcttcagggatggtatagtggcctagcctgcatcataagaaactttgtcaatctttgctaaaagaattctgttttgtactctgctgtgcaaatgcatgaatatgtacccattgtaggatttgaaatgcagatataagaaccccgaggatcgcagagtgtcagatgacctctcagcattcctgtaggatacaacctcatccgctgcaacaacacacagaattgagaacagactgacgcatgatgcattgactggtaatgactagttatactgtttctggagggaaggctacatgaatcgacagctttgttacctcttccatggctaagtaagataggcaaggaggcagctcttcttgcagctatgtgtgagctctccatcttgcccctcagggtcctaaaattacagtgcattagcaacactaggattcaggaacaagtgacactagtaagtagcaagtgtttgacagattaatttctgcctaggatggcaaactggcacctggagcaagggagccatccactcaagctgatgaccgcgctaagtgtgattgggtaggggatgccacttgcgaatttgccatgagcatagcacgcagctgagtagagggaagcagcagcacccatgctgaaaccaccaatcccaagcttcactgcactcgcaaagtgtggaaatcagtggaatgagtgtcacaggagtgagtggtcaccagcatacatctgaagaacatatcatagttagtgctagttttgtatatatactggctcgcatttgatcacctaattaacatatgcatttaccggtgccactaataaggatcactttgaaaaattaaaagaaaaagaatctggtaagaccataatatatgttacattgatgtggtcctggaactagtaccatcaggcggctctgacgacagcaagtttgcaatgtgcgcagctgaagcatccagtccttcaatgtcgtcacggccatccactgaagtatcctccacatcaaaccctatttcagttccatacaaaagctaataagtcagagagaaatggcagtacccctaagttttcaaacttcagagagatggtagcatagtagtcctgaatacagggtattctgccaagttccaatggagaagaagaagcttacatgcagtgcaagggaatccaccaaatgctgtgacaggctgggttgctgcggtggggcaaatccacttgatctacaccatcataagcttcaaggtgaataaaccatggtgcaacaaaaatagactgctagttgctactgaacatgataagctacactgatctggagatagaccggtggagagagaccggtgtgtgttaataggggaataaggaacggtgtgtgtatgtatctatcatctgtgtatgtgtgtctgaagtacaagcatcgacacttacatttggcaatgaaagagaatccaggagttgggaccagctgaaaacagaatgaacaaaacagagaaaaggaaacggatcagtgcagaaaagcattgtggatgcaactagtataggtattctgtttcatattctctgagaacttatgattaacacatcatatatgtataaacaacaggcgtcgtctaaaagtatcagtgaagatataagaacatctggaactacaaattggaatccatcagatcagactaaagagagaacatttacagtactggacagaatttttacagcaagttgagcaactagcctgaatttcttagcttatcttaagagaataaacaattatcttatcaacaaaaaacgtaacatgtaagtagctgagttgctgatctttttagttactggagacaatagggaaatgaatgaaaaagaacaggaaatgaacatctgccgcagagcttaacttggcaaatgtgtactgaactcttaaaagaaattgtgacacatgcatcataccaaactgaaaggcggccaagcttactttttaccttctttgctcccggagttgatactggccattaaaaactctatttaatggagccaagatactctaatttagtggcttatcataaattatgctgttctttagatgctttgtgcagacatggaataggaaattaggaatctttcataagctaccttacatttatgcaattttaatatgccattagcccacatcaattagaagtatttgacattcctctccatttctgaatggaaagtgagatgcattatctatgtccttggtggcgcagaaggttgtcaggtgtgcagaaggacaagagaaacatttactccctccgtcccaaaataagtgcagttttgcactattcacgttcaacgtttcaccgttcgtcttatttgaaaattttttatgattagtattttacttgctattagatgataaaacatgaatagtactttatgtgtgactaaatatttttaaataagacggacggtcaaatgttgggcacggatatccacggctgcacttattttgggacggaggtagtacttttgagtaaagcaatactaggaatatatgcatgcacggacacagaaaggacaacacttcagtcatttctggcagaaagatgcaaagggactgattaaagcgttgcatctacattgccatgatctagtcccataaaccataaaccattggttgaaaagtgtagtgtatttgcacttctattaaatttgaagaagatagtattgcttgaaaggggagcatctgagtaagcaagaaaagtttgtggaacaggcaaatctatatcaaaccagcagcatacagctagtaccttgcaccattgtcacctaggccatgaagccacacaatggtggcttggtgccttccctttggcctcaccacataggtcctcccgtactcaactctctgaccaccccgtccacctgaatcaccatttaaatcgtgctcagaattgttcttttgcagctatatagattattataatgggcaaataagttttcgagaaaaaaatgtataatggagtagacagattaccagaagaactgcttccatagtaactcatgatgttttctgcagcaagtctgtactgatgctactcagctatagtactatactactatttctgtatgatgtgcactgaacgtccgaacgtatggaagggtatgaagagcacagccccagttggcatgtatttatagtgaaggttatctgaagagggaatattatatgtgtgtgtgtgtgtgtgttggacactcctttgaatctgcatctcaggacagtgcggttttccgcagcaaagctgtcataggaggagcatctggagtctggaatactcaagggatggtagggtaaaaaagattgaagccctttgctctagagtgaagaatcctgtatgatgggctactacggagtagttcatcgttnaacgg

SEQ ID NO: 4 - DNA, 6416 bp, Oryza sativa
  unsure (1)..(6416): unsure at all n locations
ttaaattaattgccaggaattagcatccggaaccantttggcagtcaatgagcttcctttcccactcaacctccaagttatggatagtagaacctcaagttgtcctgttgaaggtccatttcaaaaaacggaagttcaaattcgtattttgggtattcaagtttttttaagcagataccaacacagaagattttttttttcttggaatgtccaaaagacttgtcgcctttgcattattttaagaagaaagcaaaccaaaaggatttgtatgccacactttgttttggcataccatcaagatatagtgaagagtccaaaaaggatgattacattggtagaaatatctatcaagtgtcgacaccaaatcaacatggatatgggaaccaaatcagacacaagtgcaattacacttgcagattgcctcataaacgtggtgcaatcttcatgaaggtacagatgcttgcaacagaaacatgacatattgttgctacaattacgtcaactgttaactgtagccattcaattagttaaagggtcatatcaaactagacagtagtttgccataacatttagctgttgttgactttatgcaacacaagttttaattttcttttagactggaaattgtctcaaccttgatgcaataattctagtgaaatttatcctgtttacactgttgactatgcgaatgttactaaataaataggacaactacagcctttttttttacctttgatgagctagctttatcttaccctagatttgcttgccaagaaaggtggacaactttaccaatatgcctcagaaatggagctgagttgatccaccctcaacaataaagattaaagatgaaccaaaagtcaaataaaaactgaccttgaatgaaattttggtaattcggtagcagaatgatgcaaaaggtctgcatatcttctttcagagaaaaaaaggttcacatctggtttttccatgtgttagcccactacacacaggaaggatcatattctgttctcctttttattttctaatgattggtacaggtaatgtggggggcagcccaagccagaatatgtgatttatatgtcattcttgtctctcttagcaccagaggtttgagtctacagtgagcaagaatgaggatgggacattagccacctgatctcactttttctcacactggaaattatagactatgattttgttgtgccctagtactataagcctgcatattcctccctacgcacatcattaattttctttattgcacatgttcctgtgaagagttaagttttctgtgaagtcagaaaaatattctaaaaaggccatggagaagatattggatttgtcattactaaaacatataattaaggaagatatgaccacaggaaaagatatattcttctttaaatgttctctattctgtccatggttaaccaagttcttattcatcagtattctcattccagtccatttctgctgctaaaaggatgaaacacaagggcagtgacaatatgataaattgatatatgcctgtagtgatgtagtataatgcgattaccgatacacaaggaattcttgtgattgcaattccttgcaagcaaattgctgattgcagatgccgcctgaatcagctcccaccagagccaaatcactgaataaaacaggaaaaatattacctttggccaaaccactgaatagtggatacaacaggcaaaatattactcacagtaataagaagtctacatcaaggcttaacagaagtcaacttccaggatgcaagagggaatgttgcaacatgaaagatccacggccaccattagacgaggaattatgccttataaagtactggggcattatgcatgcttctaattacattgcttgatcgcccagaaattcttcagtaaaatctcctctcatttctatttcatactttattgagagaatcctttctactcatactgttgatagttcatgagctaatactttcttctagagtgttttcctatatacatgctctcctattctcttttaacttttagacttataaaaattactttgggcgagagaaaatataagaaaggcaaagtgaagttgacatcactaagtgcagaatttatcctattatcactttatcaaccttaggcaatccaaaacaaagcgaatatttattttcctatgtgtttgaagttgtgcgataggacatatataatcagttgatggtaggaaaaatgagttataagttgcatcatgtctataggcttaaagaatcgcacctgaacttttcgacatatgatctcccatagatcaacccgaanttctttttattgcccagccattttctatttctaatgtggtagccagtaatcatagtatttgttctcatcaggaaaaggaaaagagaaagctatggtgattagttcggcgatcgatcgattgcaaaagtatttccttaaatcaatgatactaaaaatttttgtttcacactaatataaaattttaaatattggtgactaaatcatatattggaaaccatgaaatgtcaacaaatgtcaagtaaaaagagtatctatcaaaattcaaggtgttacaaagcatactaaaggttaatatatagtagaagaaccagatcattattgcctagatgtggcctataaatgtagagtaactagtttgtaaatgtcaatgcataccttcaaaattcaaacagtggaaggctcggaaagaacatccaacagtctataatgtggggtctggtttatctagctttcacatagacaaaaaggcatcggacataaccagaccatctctagttttttttttctagtacattcaacactaaaacgcagagagtctagagtctaatagaagtgaatatggatatttagtcggcgcgcaaaaggaaacagcaatgaacaaataaagcatagccatctttaaaagaagaaagaaatggcaaagctaaacaaaagtacacgagtaaagtatctgggaagtaaacatagctagcattgcgcttgatttgggacaatcaatttagcaggacatttaacagtgattgctatataagtagactttgtttctctttttccatctagttaagatcaaaagactgcctgctgacccaacgcaatcaggagcctttgaggagtcgcaactcacaactaagcagaagcatcaggattctctctgacacagagtattaatggtctaaaaatactacgtaacaatatagcaaccacaaggataaagaagctgtgcacaggcttccgcaggcagtcagtccgcccagttgattcagtccatagctcaggttcacaatcaccttctgcctgccaaatcaagaaacgatctcagtacatggaattgtaaaactgacaaacaagaatacatggaggcagcatcgagacattaagccctagtatccaagggaaaaggaaagtgttcagctaacaagaactacaatgtatttctttatgagcttgcaagtgaaaggctgatgatatccaccactgaagactacttaggatttagtcataacaatgttacctcttttcctgactttcaactataaagcccacctatatctaaacatgccaattaagcatgcaaatcataagattcttatattattgaaagggaacactccaaaacacacaattgaacaaactgaatcatataatcttccctcagttgtgcatgtgactttcctctggtaaatgtggtacggtgtgagccagaccgtaggaatttacatcacaaaacaaatgaaaatataacatataagtaaaattgaagaagtttcgaggtggatatacactatcagtctatcaccatgaatcagtttctgtacttgccccaaaaacaattcacacagcaataaagagaagtgatacattgacagttttattttatcagaaaaaaatgaaggtgttaaaatagtaactaaagtaaatcaattgaactacttaagtcaagcaggtggaacatacctgtaactagttaattttagggcttaagtagtactgcggatctctgaagaacctgacaattgtctctgccttatccgtggaaaggtcagtgttttctagaataaatttcttggatgcttttgcaattgcttcaatagacccaatagcttgggcaagcttgaaaatcaagtgtgacatcaatatcagcatggcattatatgaacagtaaaatgttatctcatgttaagcatgaggattgaccatatatatctactgggtaggctataggagaaaaggaataaatgctaacagattagtacataaatatatcaggaatagaaaacgatcaattctcatcatgaaaagttccaaaaggtcagcactttgcatggagaaggtccaataactgtgtttaagctcagttataccctgaattagctgtggagtaatgctaagcttatcctttagaacgatttagtagaatgagtacacaaagatggtacttatatatgcaaacaatgtctctaatacattttccctaaagaaagaactatcaattaagtatgcggacttataattaacatttttatgcaagcaagcaaaagaccatctggtcatacataaggctaaaataattgagtgcataccgcattggcgtcatgattgtcaataccaggaatagaggtgagcacacgtagaaaggaatcagtgcactgaactgcttgctcccgctacagacaagcaggaaatcattaggctccatttcaattatagaccaagaaatagagcactgtgtatctggaaacatgtgaaagcacctcattcttcagtcttgagataatgtcttgctgcttgcatactgaataagaaaggagtgtcgatcaatgtcagcttacaattcagaatttgaataggactgagagaattgctaaatgaagtttgagatttacctccaagtgcatgagctatcttcacgattttctcgaaccccatctccggatcagtaacaggcacaaacgtaggaaagccaagcttcataccataccttgaataagaaatacatgaaaatcaatagctcaactaaaatattctggcattaacattatgataggtgcatacttgtgatatgatcgattaaatgattcgttttgctcttttgtaggaacagcaacaacaacatatagatgttttaactgcctcttcagcatattcaccctgaaaaggcatatcgaaactgaagtcattatcatagtcgttagggtggattggaataggagtctcgcacctgctaaagacagcaccttcattttgacaatcccagtttgtctcaaagataaatgcaacagatagctccccattgttgaatataaagtcctgggaaacacttgctcaggttacagaaaggcgccacagaaacagttgtgtgacgttgaagcaggaagaggtgcttacaggagatattgacaggaagtttaggcggtatgagtttgcagctaagaatgcagcaataaagttgatgaggcttggctgttgtttatccctccatgaagtgctcattgcgcatactccacgacctgcaggacggtgcccaaaaccccaaatagagtaaccaaaaatgtgctcagtgtaggataagctaaaagcagcctgctgcttctttgcttcaggcttcctgtactggtctaacattggagattccatatgaaagaattctagagtgcaaactgaatttctaagtgctcctgagtcctaacatactgaaattgaacagcagagtactgcagactgattggtttaaatgaaataggacatgaacatgaacatgccattagcaagtaagacgtgtccacaagtagcaacaggctggtgcttccggaaacaagcagccattcctagaactagaagtaagaaatgccgaaattgaacaggtgaacactgcaaagtgacggccttagctccttaagtaggagatgaacatggccacgcgcccatgccatataagcaagtaaaacatatccacaagcagcactagcctgatgcttccagagaggcagccattcctagaactagtaggattgagaaatgtaactcgtaccgtactgaactcatgattttgcgacattgcgggcttgattgatccagtatggggcgatgccctagcgcgtgcgtgagagggggagagagagagagcgagaggcgagggagtggatgacctggagcagcgggttcgggcggcggcggtgggaggcaggtccagccggtggagtgggtggagcgctccatcggatcggaggaggacggcgagacgaggcggcgccgcgacggggatcgagcggaagagccagccaactcgccgccggtttgccgtcgactcggctagtgcggtttcgcgncggcttttgctcncnctgtgntngnttnctgtaacggtanatcgaggagcacgct

SEQ ID NO: 5 - DNA, 12276 bp, Oryza sativa
aatggccaaattttcctggatttgaacaaaactcttttcttgtgtgtgcgctggatttttcatcttttttgtccttttagaaaacttattttacagatatcttttttttaaaaaaaaacttattttagaaatggaccatttttcatggcatcaatgaattggcgtcatctctattgtccccggtgaaaactaagtcactaatataaagggaaaaggcgccaatgtataataagtttttcaaaaggtgaaaaatcgggagggggtgtaattgctgaatggctgttaaattattggcgcatttcatcaagtagtaagtatatattatattccccttatgtaagtattgcgtcatgtttgaacattgtttaatcgtgcttttccggtatttctgggcactgacagaaccatatggcgttgctttatatttctcttcttttcttttcggactgaaaggatatcactgagtttgaagcctgatcgtgtcgtgtaattctgcactgtacctcaatttggcgagttaattctagtattgatcatctgtaagctaacggttgggcaaatgaagagcagcacgcaccgtgaaaaatgatgatgcagctacatggtagtatctcttttgagcttcacgccgtggagactagttataattcagctccaatgatgctgcccccgcgaggcacatggcgaattcgcccaacggccggccaaacaacaccatcagtaaaatctttttttaagaggctcgctagctagcggcagctaacaaaatgatcaaccacaaagcgaagcgactgaagaagtcttcttaagtttcagtttcagtttcagggcgtccagttgcgtgcgtgctactgaaacaaccacgagttcagaccacggtttacatcaccagtttaccactaaattttgagccccatcaatatcacgatttttgataaattttgatcggttttcgataaatttcaactgaatttcgatcaaatctattgtttaacctttaaaatttcaatcgaaacttaatttcgagtcgtgtcaaaacatcgaaatttcacgaaattcgaccggttttcatcggaactgtgaacctgattcagacttgagagttcagacatcgacacggctggctactgaatgatagtatatagtagtagtagtacttacatatccgtggcgaatgcgatcgattgaaaactgaatttgagaggccattattcagagagaaaaaaaaaagggtgagcagcagcatttgctcctatcctaatcggtcaccatgattgcccgatggagcgggcatcatgacatgagccggcttcagtactccgaaaaggatatcagggtaaaggactgattaaaaagcgacaacgtacacaagcatgcatgtccaagtagtagtagtattagtttgaactagagaaagagcaagcaaagcgccgtcggggcggggcatcgtgttcgcagttgcaaatgttcagtgagatggggaggtatatgatgcatgtccattcgatccattgcttgtgatccacgtacaaatcgaatccgaggtgctcgcaattcgttcgtaaggcctcatcaattcggatcctcatgatcgaacgcaatgcgattccgagtgtcgatggcatgatgatactttgcttcctccttccgcgctccaattcgccttattactccctccgtcccacaatataagggattttgagtttttacttgcaacgtttgattattcgtcttattcaattttttattataaatataaaaaataaaaagttgtgtttaaagtactgtagatgataaagtacgtcataaataaaataaataataattttaaaaaaaattgaataagacgattggtcaaacgttgcaagcaaaaactcaaaatgcctaatattatgggacgaagggagtagcatttagcagtaattcctctctatgtctgtgtcggcggcggcgagtggtgactgctgagcccctaatccactgtaaactatcactagcaaaggacgctaatgtcagtcgatcacactgtttgaccagaaaataggagtactcagctttctttctgcatgctctgtttcttcgaggtttatgtcagtcgaagattcttcactgctactgctctcggtttctagtgtacagtagcagaagttccacgttaaaattgaaagtttaaagaaattagaacgatgcgacggaaaaattgaaaggttgtatgtgtaggaaagttcgatgtgatggaaagttggaaatttgaagaaaaaaaaattggaatctaaacaatgcctggattatttgaaactctcgaagggacgttcactcattgtttatatcattgtatgtcacttaaatagctatgaaaaaaatataaattaatatgtgatagatcacatgaacatttcataaatatacaagttactcattccgtctgtaaatataagggattttttgttggatatagtagtagtagtatatcatatgaatgaatgtggacaattcaatcaaaatctcttatatttagggacggaaggagtataatttaacttctatatgttacagtgaaaaaaaacaaattttattataaatatacgtttaactaacttagtttaatatgtttccttttacaacttacgaaagtgaattttaagttacatgggaagtgtataaatgtaaatatatcttgttatttcttaaaaaaaatcttgagagtttaaaattcctactacgtagaagtagacagcagtggaggccagaaagagaagatctgggccgtttattttaggcgatacggacggaagcaggacgtgtcccatctggcacggcacggtacaatcctccaattcccattcccattcccattcccaatcccaagcataaataaaaccaaaactccctcttcatattcccacccatgactccgactccgacactgacccatgcccatggccgcgctccgcctcctgcttctcgcgctcgccgtcgcctgctgcgccgttgccgagccgccgcagcaggagcgctcggctctgcgtgccttcctcgccggcacgccgcacgagcgggcgctcgcctggaacgcctccacgcccgcctgcgcctgggtgggcgtcacctgcgatgccgccaacgccaccgtcgtcgcgctccgcctccccggcgtcggcctcatcggccgcgtcccgcagggcactctcggcgcgctccgcggcctccgggtgctctccctccgatccaaccgcctcttcggcgacgtccccggcgacctcttctccctccccgacctccgctccctcttcctccagggcaacctcttctccggctccgtcccgcccgacgtcgccaagctcacggcgctccagcacctcgcgctctcgcacaacaacctcaccggcgccatccccttcgcgctcaacggcctcgccaacctccgctcgctccgcctggacggcaaccgcttctccggcagcctcccgagcttgactctcccgctcctcgaggacttcaacgtctcctacaaccagctcaacggctccatccccgcctcgctcgcgcgctttccgcctgagtcctttgccggcaacctccagctctgcggcaagcccctgagccgcccatgcgagcccttcttcccgtctcctgctggcgcgccgacgccgacggatggacgaggcagcggaggcggttccgtgccagtgtccgagaagaagaagaagaagctgtccggcgcggcggtcgcggccattgccgtggccggcggggcggcggcactgctggccctggtgctactcgtggtctgcaccgcggcctcccggcgccgcgcggcgaacggcgaggtcgggaaaacagcggcggcgaggggcctgacgccgccgtcgacggcgtcgggggagctgggcgaggtgacgtcgtcgacgtcgaaggagatcgctctggcggcggcggcggcgacggcggagaggagccggctggtgttcgtggggaagggggcggcgtacagcttcgacctggaggagctcctgcgggcgtcggcggaggtgctggggaaggggagcgtggggacgtcgtacaaggcggtgctggaggagggcgccacggtggtggtgaagcgcctcaaggaggtggcggcgtcgcggcgagaattctcggcgcacctcgactcgctgggcaaggtggaccaccgcaacctcctccccgtccgaggctactacttctccaaggacgagaagctcctcgtctgcgactacctccccgccggcagcctctccgccacgctccacggtcagtcgctctaaccactcctccattcgaccggaattcgcgcggtttttgcttgcaagtacgcgcccaactccagtccaactaaaacgctaggaattgtcgctgcatatgcattgcagtatagtacgataaacagtgtgggtgtcatgctgtaaagcgaaagccattggggcacacctacacacacgacacactgactatgagtacgatacacgcaatgctaatctcatcaagcgagtgtcgtctgtgatttcaatttcgatcggagatgctgttgcgatatcaactacgaacaggtgaaaactgtagctactgaattcgtcggccaagtgcgtgctagtacttcagaatgcagtccagcaattgagcaaaattatcaagtacatttccacgcatgaaacattctctgtgttggcgattactgtttggagctacatattcagttattactactactttaacggtacagctactttggtacggggtttttctttagaatgtttcatggcatggaggtacgtatgtttgctctaacaaaagcaacagtacggcacatagtacatatcactgtagagtgtaggttaagcattgttttagacaacatcgtcgtttgatttgcatcaacatcactgcaaacttcctcagtagtaaaccttcagtctaattcaggaggtggttggtaggaggtgtaaggtgaattttgggtcaagctgtagataattagtcacagtgcaatccaatgattcgagatgctacaactacgagtagtcagcaaggggcatgtacaagagatgtggactctagcttctttccagcggcgcatgggcttgaggttccaaacctaggaaagtgattgagagggtagcgtttgcatttgaccagcgttcttcagattccaaatggcttatgtccaaatcatccgaaagggattgaaagataaatgtaaggttcagtacccatcttctgctatccatgatgccgccctgaattttaaaattttctgaacgactggccatgctagtttgtttctttcgattttatgcaagtagtagcaaaatttaattactgctgttcatcagttaccagagggcaactttgctttattttgggtatcactcaaatgtcaattgcctgtcacaagcgaagcatttagtaccaaatccttaattctgagatttctctgattgcttagttgttatattctttttcaataagtcaaggttttttattaactgtaaacgtcacatgttctgtcatacgcgtatgctaattactacctactacagcttatccagcatgttgatctttcatacaagcaacgtatgtagcatgcataatctgtgtgttttacatcacaattgttatatttagaagtccacgaacacgtacggcatagttttttgcttcttaatttcgaaagagaatccattatttctctaacttttttttttgctgggctttctctaaccaatctctcattctctctaccaactcgaccaacctgagtacaggttttgtattctggtttcaataatagaagatgcttgccttcttgctgtccagtagtagtgcctaccaaaaaaaatcaggtttactactctgtagtgtatgcaccaatggaaacaaaattggaggcgcgattctgtatcactaataattcagccgatagagacaggctcatgcgatctttatcccgtttaagaactgtcttttcatcacttcacttgtaaaactagcatgtagaaatcacagaaatgataaaaattttcatgcaaaactaattgtagcataattgtaaattgtacttgtttatgttcataatgaaaagtgtgcgcgtccgtattgtgttaaaacaacactcccttcttcccacaatataagatgctcactcatttcaagatttcagatttaaaacattttgaccaacatttaatacaacatttagttttactgtgcattgctttgctgctctgtgttttgtggctggaaatggctgacagtgaattgacctcagggagccggggcaccgggaggaggacgatggactgggacgcgcggatgcgcgccgcgctgtcggccgcgcgcggcgtggcgcacttgcacgccgcgcacagcctcgcccacggcaacctcaagtcgtccaacctcctgctccgcccggaccccgacgccaccgcgctctccgactactgcctccaccagctcttcgccccgctgtcggcgcgccccaacgccggcgggtaccgggcgccggagctggtggacgcgcggcggccgacgttcaagtccgacgtgtactcgctgggggtgctgttcctggagctcctcaccggcaagtcacccgggaacgcgtccgtggacggcgacggagcggtggacctcccgcggtgggtgcagtcggtggtgcgggaggagtggaccccggaggtgttcgacgtggagctggtgcggctcggcgggagcgcgaagaagaaaatggtggcgctgctgcaggtggccatggcgtgcgtcgccaccgcgccggacgcccgcccggacaccgccgacgtggtcaagatgatagaggagatcggcagcggccacgggcggacaacgacggaggagagcgaggaccggtcgagggggacgccgccggcaggcacgacgccgtgaacactctactctctctactggtgtcgtaatgcagcagcacatgtcagggtaaattgatgcatgaacagcttcgttcgttcgttcgtggcgaagttctctcactctgtttttttttttgtcctccatttcttcagtttatagcctctcttgacttgatctagtaattcttccattgtttcgtcgatcaaatgagttgttactacctgttcgttcctcttcagccaagtgtaatttttcagtccgtatctactaccaccattgtagctcttcgtatatgcatcttcattttgatgctgtgaagtatatgtaggagtatgacacatgaataaacagaaaacctgtgaagttctgtaccatttgacaaagctgggcgctacctgaatctgaagacccaagaaaaagacaaacatgcattgaggctcatgctgtatcgcaaaaaaatcaggaaaaaaacaatccatctcatccagaaagaaaaaaacgtgccctcagccttgttgacacgaagtactagtagtacgtacagtaggttgtttgattggagtcagcacgtcagaatgtgggatgtcatcttgctgaagaatctgcatttttgcagctgtggatgtcccagcagaagtaacatcgtcaggttagatttacaggtgctctgctccaaccctcgctatccgggccagaagggggaggctgcggcctgcgggcgagtaggccgtagtgaattgggcttttgtaagttgggcctttgcggtgcgcgcgcgagtgggccgcggccttttgacttgttcctccaactccaactccaactaaatcggtggaacctttcgtcgcgcgggcgcggcggcatgcgcgcgctaatcttcatctcctcgtgaatcaccactgcagctgcagctaatagtagtaaattccatccatggccgtcgcctacactagtgaccaccggcaccaccaccaccaccacgacgtcgtgggcaggctgagcagcctcgtcgccttgtgcggccgcggcctctcgcgcgtcagccgccgcctcctcctcctcgaccgccgctgctacggtggcgggaggtccgcgccggccaagcaggacggcggcggcggcgaggccatctggcagcggacgatcctgatgggggagcggtgccagccactggacttcgacggcgccgtccactacgacagcttcggccgccgcatggccgccccgcgatccgcctcctccctctcctcctgctgctcctccgatagcctcggcgccgccacctccgaggcaagctacatcacctccacctccacttgtgacgatggcgtactctgaatgtatcaccatgccatgcatctagctctagcttcatgcgtttaattgccttcaattagtatttttgtcaccgatgatatattctgcattagttgctttatacatgtgcatgcaccgtacccttcagtttaattagcctccctcatgcattacaagagcgaggccgccccagctcatccaaagcttaacaacctactccctcgatccatttctaaatatttaacgtagttgatttttttaaatatgtttgatcgttcgtcttattaaaaaatttaagtaattattatttttttttcttatcatttggttcatcgttaaatatacttatatgtatgtatatagttttacatattttatataagtttttgaataagacgaacagtcaaacatgtgtatcgatctcattgcatttgggggccttttgctcacatatacctgcctcttgcatagttggatatgtacacacacaaagaagctgcctgcatgcacgggcgaattcagtgggtccaaacagaagagcagctgcattgcctgcatccatgatccatatccatccaacagatcgattataacccgtcacagttacatgcacgcgcgcgtggtgcgtgcagatccaagcatgcgtacgttgtgatactgcatgtgtgatgtgcatatatgctgcatggtttgtgttagcttcgatcttgtggttctttgcatggcaagatatatagcatatgtagctacacagcggaggagtcgccgtccttgggcagctcgagggcgcccttgttcttggccgtcgacccgtcgtagtagcagaagtagaggatcaactgcgccgcgcccagcagcgtccccatgccgttcggtatctatttatttattaattatgatacattaatatatagtactattagctagaattactctatgattataataacaactatactacttactgatcctagtaattatttatgagataattgaaagcatatatatatatatgcatgcataatatgtataccgtgatgaggatgtcaaagcggatgaacgcgtatattgtccagcatatgccgttgatgaagctcaccagcgacaacgtgaagggcatgtactccacgctctttgtcgcgatcacttgtttctacattcattccatgtagtaattacatcattttgccacacacatataaatcaaataattaatcatcagatcagattcatgcaaaaaattaataatcgacagatatatatacacataccatgatggtgagcggcgcggcgtacatgagggtgccgaagaagacgcagagggtgccaacgatgagcgagcgcttgtcgtaggtgtgggcgccgaggagcacgccggcggcgacggcggcgaggaagacgagctccacggtgaggacgccgagcatcctgcaccgcttgggcttgggggcgtaggcgaagtagatggcgaggtaggcgatctcgatgaggagtccggtgccgttgatggtgacgacgaggatgctgttggggtggatgaagggtaggccgtagaacacccacagcgcgcagttgaggaacgtcgccaggtacggatccggcacgaactcctccacgtccttctttttcacgatcgtcacgaacgtcgagaatggcgacaagaacaacccgaacgatatcaagttacctagtacaattaatcaattattagtcaattactaagtggtcgggcaatatatatatatatatatatatatatatatatatatatatatatatatatatatatatatatatatatatatatatatatatatatatatgaagcatctacaagcaggttcaattcgagacgacgtaccgatgattccaacgacattgcggacggcgtcagggttcatcaccatcttgcctgctcctctttgctgctacttttcgatattttctcaggcgaatagatgggagtatgtattagtacagtggcagctagcgagagcgtgtagctgatagcaactaatcaaccagcaagagattaattaactgtcaggccagcaactgtaacctgatcaaatagttaacttagcagctagctagctagtgtgctgctaagttaaaattgggggttaaattaaatatataaaatgcgtggattttatttccactgattaaaatggcggcctctgccctccaattcctccccccttaatcttacgagagtcggaataatggagaggcagagcacggattcagattggccatggccgcccttatatacacgacctatggctaaaaaaaaacacatacaattaacctgattaattaaagtggtgctagctagcttgaggtgcagagacaatctagctagttttggcttaattacgtggggccaaaaaatggacaagccagggtggagagcttactggagctccgaaatgcatgcacagccgtctgctcagttttactcttttccgtcacaaaataaattaattttgccatgtctatagcattttccaaaataatcatccaaaacagtctggatagtagactgtaaaaccagaaattgacaaaaccaagtctattactcgctcattaccgcctctctaagaggatctaggacgccataagcacatgatcgcagctacataacaaaccaatagagttgacgaactgtacaacaatgtagcagtggtgggtgaaaaccacctccgtgcaaaacatgccaaagaaagtactcaagtcgatgattatcctagtctcctgggagttgtgaaaggagattaactcttttccctcttttgttagggccgactctaactctcaaatgatgtacatatttgaggatctcctaactctatcaatataaaagataattcttttgccttctttttcaaacaaataaatcaaaataaatatgtttgtaccactcaagttctctaccgctcgtctcaactaactacaaccattttacatttaatttttcacttactttcttttatcaaccaaacatcaatttgtacctagcttttaatatccgtatatagcttcaagatacttatattttaaaatggaaggaactgtactcacaaattaataattattggtcatttgactgacacgtggcacgcaattggcgttagataggcatccgtaccgatccgatccgaattattaaccgtacacttgcgggattgcaggagagcatgcgatttgcatggcaagtgaagtgattgatgatggttcgaggttttgcttgcattggcatgccgatagcatgaataacgttcgatccatcaaacaatacaccaagcattttgaaagcacgggctttcttcttagccgattcagcccaacgcgttggtgcggttagttagtttcagttgggctgatttccaaattctgatgggccgatcgagttggacccgatgaatagtaagtttacctcgtgtccctcaactttacaccaagtttgtttgacatccattatcctcaataccagaaatattcacccctaaactatactccctccgtccctaaatatttggggccattgactttttaaagcatgtttgactgttcgtatacataaatgtttaaaacttttgtgaaatatgtaaaactatacgtatacataaatgtatatttaagaagaaaaggaattaataattacttaaattttttttgaataagatgaatggtcaaacatgtttaaaagagtcaacgggacggagagagtatacaaaaccggataatctgatttcgttgacgtggcaccctaccagccacattagcacggcccaccccctctccctctccccagcaattggactcggatcgccgcctcataaccgcatccgactcatgagagcgttgcagcgttatatatgtaggatggacgttacgatcgatgtgatacgtgtatccaaatagcggtagcgaattgaaggaagatatatcgatcggttgaaagtgatgatggacgatgtgatgagcgagatccttgttcgtcttgcgtccaagttcgtgggtccgtaccgcgccgtcttgccggagtt

SEQ ID NO: 6 - DNA, 1502 bp, Oryza sativa
  unsure (1)..(1502): unsure at all n locations
aaaagtcacgggacggaagaagtaaacaaaccggattattttatttggtgagtgtgcaccctacaaccaacatgagcggggccaaccccttctccttntcnacaagaattggactggggatcgccgcttcaataccggcatccgacttatgagacgcgtgcaagcgttatatatgtaggatgaccgtacggttcaatggtaaaccgtgtatccaaaatagcggtagcgaattgaaggaagattatatcgatcgggttaaaagtgatgatggccgatgtaatgagcgagatcntgctccgtctgccgtcaaagtcgttggtccggtaccgcgccgtctgcagaagttgcggcgggatcacaagctgcccttatttcttggccgccngagatgctggtgggatcctgcgacggcttcttggtgctggagcaggaccacggcctgtacggatgctggtacactgtagcatttggacggctaggttcgtgtgtgtagaggagagggatgatgtgatggtggtgtgcgagtccgcccatgacaagaaacttaatacccaacatgctgctggcctttaccatctccgtgacaacaagtttttggagcccgcacttgatcttggggaatgctccctctcagagtttcggttcaaggaaaagcctcgtccgacatgccttcttcgacttgccccgctctcccgacttcaaattcatacccttcgatctaccccccccaccaatttccccttttctcacatataattataggccctatttagatcccctggcaaaattctacacgctgtcagatcggatatttgctcacatgcatggagtattaaatatagacgaaaaaataactgattacacacattgcgtgtaaattgcgagacaaatcttttaagtctaattgcaccatgatttgacaatatggtgctacagtaaacatttgctaataccggattaattaggcttaataaattcgtgtcgcggtttacaggcggattcattattagactacgtttaatactttaaatgtgtgtccgtatattcgatgtgacacatcaaaacttgacacctctggatctaatcacagccatatatcatgatgcaacactgtaaatatatatatattgatgatgaatggaatgcctggagataagggatgtggggctctgttttcgtctgtttcacaagctatatgaaaacttagaggcatctgctttttatttttctgaaataatttatgtgtcacaatacatcacgccatgtacattcactagatctatagaggggggggggggggggtgtatgtacagatttacaaagttacagggtttggagaactagcccaaaaggatcaatttacagggctttggccaagtccgctacccaggttgagaagatagagagttactacaggagagcgggaggttgcagagctctctgccttgatgaactactgtacaatatgttaggtccatcgaaaanttcaaaannncacacgc

SEQ ID NO: 7 - DNA, 28645 bp, Oryza sativa
  unsure (1)..(28645): unsure at all n locations
ccgcnaatgattaatctatgtacagcagttcatcatttgataaaaacatgattcggtggggtaactattagtagtggtattgatcaatttgattatagtagccaaaatatgatgtttatgttgttggaattaatgaatgggccttagcccactcgaagattaattctttggaaaatcataaaagcccacctcatgggatggcatgcatgtggagtttagtaccaccttgcttattctaggagagggggaccttattaaaagggaggatgccctcctagtcacttgaagcatgtgtggtggagagaagaggggaaacgcgcgcgctcgcctcgcctcgcctggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcagcacacgcaaaatcaatctagggtttgcctcctactctgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcaccttggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctaaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgcttacgagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttaccccgacaaatttgtggccgggtgcattattgcaaaactaccttcatcttggaggagtttcggtactgcactcaaacacaagagacaggaatactccggtgaggggttgattgcgtctcttgatgttgaggagaaagctcgggaaaaagatgccgcgtctaaggacgatggtgggcaatccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgttcacagcgcaaggggatgaaagcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctaaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcctgagtctaatgggattgctaaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcacaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaagaaggctgtccgtagtgaaatggattccattatcgctaacgggacttgggaggtgacagagcgaccctatgggtgtaaacctgtggggtgcaagtgggtgttcaagaagaagcttaggctgacggtactattaaaagtacaaggctcggcttgttgctaagggctatactcagaaagaaggcgaagatttctttgacacttactcacctgttgctagattgaccacaaatcgtgtgctactttcctagcagccctcacatggtcttctcgttcatcaaatggacgttaagacagcttttcttaatggagagctggatgaggagatctatatggatcaacctgatgggtttgtagttgatggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactaggtatcctgcggtactagagggttatagtgattctaactggatctctgatgtggatgagatcaaagccactagtggatatgttttcacactgggtggtggtgctgtttcatggaggtcttgcaaacagacaattttgacaaggtcaaccatggaagcagagctaacggcactggatactgctactgttgaggcagaatggctgcgtgatctattaatggatctgcctgttgttgaaaaactggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcactaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttgactttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctctacccgaggggtagtctacagacggtctagtaccagataagactttgagtgaaacttgcttgcacaagacttgcaattcaaggcgtagtccattgttcaagttgtgagtaagtgtagcttggaattctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacacgcgcgcgctcgctcgcctcgcctcgcctggcctggcagggcagggcagggcagggcaggcggcgcgcgtgcactacgtacgcgttgaatggtccgaaaaattggctcctcacccttgcgcagatgcagcctccttttgcagttttggtttgctgcaaattcggatacgtttttgttttggaaccgttacgaaaaatacggtgcgtgcaaacggcgtggagtccggataagttacgcgcgacttatccggtttcggttacgcgcagtagagatcgtgcgggcgccctgatcaagcgacccttttctatataaaccgacttgcggttttcacgcagcacacgcaaaatcaatctagggtttgcctcctactctgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcttcttcgctcgcgtgtttcgtgccttcgtagacacctgcgaaaagtttcgaccaagcagccggtcttttcgtcaccttggtacgtgttcaatatgttgcgcatatttgatctgttcatgttatactgtgtagtttacatgtgtagatcttatgatgcgattatactagttttcatctgtaatgtcatgatttatttatggaatagattaaatcattatatgtatataatctcaacatatgtatgcatatctcctaagcatgttactaatatggtgttaatatgaaatttcatcaatttaaaactagcctcgcatatgattacaaatgcgctatcatagcccatctaggcctgttaagaacatgacagtccattaagtatgtgattagtggcaacagcccgcccattatgacggcccataacacgtactgagtattgtccattggactattgggcctagagacatccggcccatcacgcccaacgccccccaccccccaacccacgctccccttggaggcgcatccaccggcctccgccacggggagagcgcaccgggaggcggaacggcgccgcgcggtgggcataggttgccggcccgacgtggagaccgcgggcgagccgcccgactcgacggaggggacgtgcgcgactgactggtgactggtggtgggtgagaacatcgcttggtcacttcctcagatccattcgggtaaaccaaacccatttttcgcgatattttaatggctacgagcagcggaggggcgtggggatttgattgcggggtaggattctactcataatgatctagtaccactgccgattccgattgaaggaattggtgaattgattgaccatgattgtagcaggtgcgactttcactagtttaacttgtgtaaattgtgtggtcctttgatatgatcgattgttgttgctccatcctccagccatcatggatgttgtggtgatgtttcaccaattgacctaaataggatcctaaatcgccctgtgccttgttcaatcgaaagtcaatttactcaaagttgagtattatcaagggttaatacggcaacacaacttcctccattttctgtatataactaagaataactcctatgcatttagctttagcatttggatttccaaagtaaaatgtatctgtcatgtgtgtagccgacccatccactaaggttgtatggttcccctcttagaaaaggtgcttcaaatcttatgttgcataattgtattggcaaaacaagtcttttttaatataagggattttggctatagaattgcttgcatagccaaaatcccttatattatgggacggaggtagtattttgctaagtcagtatgggaactgcagcattagcacttaatacattgttgtactgcctatataggtcaagccagtatctttgtacaattggctgaagaaactggttttatcttaggatgaagtctaaggaaaatgggagcattcagaaggcaggaaaagttgatcactcccaaagaggcagaccaaactgggttcttgttgcaggaggagttttacttagcacactgtcagtcagacttgggtgcaaattaaagcaaatgttcgatgcaaagaagcaaaacagtatgcccaaaggtttaatgtgcccatttacagctgtaacattgaccgctttgtccatattctttatgtgtgctgctgactctgcaaaattgcagtaaaaagaaggcctggggcatgtgatctgcactcgaatctctaccggtttaatgaccaaacaagctgctactgttgtatgtcaggtgcctttctgtaacatagcctgttcttttgcctctgtcacgcttatcagtgaataatacaggttatttggtgtgtaattttcaagtgacactaaatttagagctaaggatatgtaactgtaatatggactatctaggattccaaaaatttcaggtcaatagttatccacagtagaatagcctgccctttaatcaccatatagaatccattatcctcggtggattaaattttttgagtggggagatttttatgaacataaaagcaatgctgtatggtcagcaatttttctcccaaaaaatatttgagagtacatactaatacgctagcttcataatccaaacatatactatgctatttgcagtgccagttgatacttgatacgaatatgtctatacttgaccatacatcaatctcagtatgttaagtttctgacttactacagttggtaacgtgatgcatatttttctataagaaactcagacctagaaccttctgaatgtttgctgagtttcaacaccaaatgatacaaagtctggcctaatatctaataaatttggcctgctttttatctgcacatatttgattgcttgtaagttgatatatcttttggttatgttcattcttcaatcttcagtgcatagtcctgtaaacaacacgcctttttatttgagggtagaatcaaaatagatgatacctgagtgttttctatgattgaatgggtagagtcaaatgtgttaattgttatcacctcatgttcaagttccttattgtgcaatggaatctacaaaggaagaaaaagattatgattattagactgttgcatttatgtcctatattccaattagtaactttggatgggtttaatatttgtccatatcacgattacatctttgtggtccatttgctattacttggagccttcgaccatgccagtattgcgcgcttacatactaagttgtataagacttttcataccttaatttggcttttgaattctatttatctttattcctttgtggtggaaatatttattgctggtttatcgtatgcagcggttgcagatggagtggaaatcaggcaggctcctgggagtcctctaccaaaatcaactgacctctcccctcttcttcttgtggagataccagggccagaatcaagcaaagagaacagtggtgtcatgtggacatcatcacctgatcggctcgaagatcctcgtaaaccatttcagtactcgaacagttctggctctccctgtttttcagaatcaggttctgacatctataacaagagagaggttatacagaagctgaggcagcagctgaagagacgtgatgagatgattgcggagatgcaagctcagattgttgatcttaagaactctcttgttgtccaggtgacgcagaccaccaatttgcagtctcagttggatgctgctagccgagagctttttgaatctgagagagagattcagcatctaaggaagatcattgcagaccattgtgttgcggaagcactctctcatgataagcctttgcaagctggacattggcaatcagatgctaccaatgggcatgctaatggctatgctgatagcagtgttgatgaccctgagctgcattatattggtattgagaaaaggaagggagaggtagagaaggtggaaatgctcaagcgggaggtctgtgatctgaaggaagttattgaaggaaaggatttcctgattcagagctacaaggagcagaagctagagctctgtgggaagatcagagaattgcaagaaaagctctctgcacaagttcccaacatcttgtaggatcttctgaaagtttttaattaagttagtcatggagcagaaggggtggagttctgcttcacattaggccacggattttctggagaaggtctcagcacatggaacatcttgctaggatctttgcaggatgtttggctatcttcatttctgtgttgttaggttgattcgctttcttcagtttttctcctttgttgcttgtgctgaaagggtccctcttttcccaattgataggcctaggtagctgaactaatgatgaacttgacacgtacgtgttgtacaggtttctgatttgcaagcaaagttatgcgatgtgcctccatttagctcggtatggttgaggggagtgtcgttttggaatgtaaagatgctcttgttttgctgtgtcttctgtttgacttagagaacctaaaaaaatcttacctgattgatatttattggaagtgcttggctcgtttttcatttcttgtaaagttgcacttacaaagataaggtaattcttttgcattgtgttgacttcattattcagaagattcacaagctggggttcccaagggtgatgggctatatatgctgagatgacaaagctttccttatccattttgtttcgtccttgtgattagtgtactgtaagaaatcattagaactagggtagtaattattatttttcattcctttggccatattgcacatcttgtttgacattgttctgaattgttgccagcaactgagcaatactagtagtagcattttctgtggcttagataagcactggagcacaataccgtactgtgccactttactgaagccattttggtggcactgaattttgtagcatgcaagagcaggactcctctagtttaatgccagtttgatgagcaccagaagaatggacacgaagaagatgggcaagctggacttcactcgtccgcaggatatatctgacgatcatcatgggaaagggcaggatacccatgttggtgcgagtactgcagccaaccacagccaaccagtgatactccctccgtcctataatataaggggattttaagttttttttcttgcaacgtttgatcacttgtcttatttaaatttttttgaaattattaattattttatttgtgacttactttattatctatagtactttaagcataacttttcgttttttatatttgtaaaaaaaaattaaataagatgagtggtcaaacgttgcaagcaaaaactgaaaattccttatattatgggttatgggaaggagggagtagtttttattcatgttcaaggcagctggctcaggtacacaactacatcgatcatgcctttgtagtatggtcttaatactatagtgttgattgaaatggtcagcttaatttctatccatgcaaatgcaatgcaacaagacaaccaaacaacctattgctagagctagcatacacttccaacaacagtacaagacaaccaaacagcctagtgttcattcttgagtaatgaaaatcatgaagcgaacagtagtgcccggaacccatgcatgtgaactggcctaatcagagatatcacgtcgccgcaggtcaaaagaaagtagccgtttgtcgaataattgacactacactattaaaatttaactttgactgcttgtgtttttttttcaaaaaaaaatacaaatacttgaaaatatgttgtaaattgtgtgccgtcgtaaatataatcatattcatatatacaatttctattaatcaatcatttaaaagtacatttatggtcaatgcatgtgagacgatcctaagtcaataatgtcatttattcaagaaaaaaaaaggagtagcagcagtaatatattgatgcaaacgccgggcattcggcgatggagatggcggtcaattcatcatgggcagccggccgctaaaaggtgatgagcaaaacgttacagcgtacgaactgtaattagacaagccaacaaaaacagttttggataagcattgcatggctccatcggagacgtccatccggccacgttttcagaccggccgaatggttggccgtctccatcagccatgcatatatccgtttccgtttcattccatccatactggaagaagaagatgatgcgtgttcatcaacatacttcctttgtcatttaaaaaaacctaggtgagaatatgagaatatgactccatataaaacaacccgattatttttttatggaggaaatatatattattgttgccttcgtttgaaggctttcccaacacacttctcttattttcactctcaaattgttaaacactgtattttttttaaaagaaaaagaattatatgcgaaagttactttaaaaaattcatatttatttttttaagaaaaaatagctaatacttaattaatcaatacaaatagactactccgtttaccgggggagttcctaattctatattccaactagatcatctatactttgaaggatttatccagccacgacggcgtaggtcgtcgcctctgtcgtcgacgacaaacggcacgccggctggccggctgccggtgagctagctagctagctaaccacccgagctaattaagcaagaagcaatctactcctactctcgtactgtagccattttgtcagtcagtcgtctcgtcacaggttgatggcatcagtggcacggcatatgacatgcagctactgtgcatgatgcatggagaaatcaatcaggcgcgcccactggtcgccggccgggcctcacgtgcctgatataaaagatatacttgttcttctgctctactcccttcgtccaaaaaaaagacaaatcatggtttccgtgtccaacgccatccgtcttatttgaaaaaatcataaaaaaaattaaaaagacaagtcacgcataaaatattaatcatgttttatcatctaccaacaacaatgaaaatatgaattataataaaatttcatataagacggacagttaaaatttgacatggaaactcagggtttgtctttttttttggacggagggaatatcatatgatagagaggagagggcatgcagggatggcgacgctgctggctggagacatgagaatgtgatgagcagtccagaaataattcacgatgcatatgcattcgacacggagggatgaggacgattcgatcgatcgatcgatcaaacaagctagctatatttagctaggcccggctgatcatcgatcggccacatatagtatatgacaacactgtgctgcatgcaaagctgcacccttgatcggctttcactgtatcacagcagcttcaattcgttcccagggcagcaaaatctcgacttctttttgaccatgctacagtatgcctacagtacatatgatacaagttgcatatggcaacttgcttattcctccaagttaacaggcagggccacttaattttcactcctcttcagtctgtcactctgtcttcttcttcctcctccgatccatccatttactattattatgggcctgtttagttccaaaaaatcacataaaatctttagacacatatatggagcattaaatatagataaaaagaaaaactaattgcacagtttgcatgtaaattgcgagacgaatcatttgagcctaattaggccatgattagccataagtgctacagtaatccacatgtgctaatgacggattaattagacaaaaaagattcgtctcgcggtttccaggcgagttatgaaattagtttttttattcatgtccgaaaaccccttccgacatccggtcaaatatccgatgtgatacccacaaaatttcatttcaccaactaaacatgccctatgtattgccttaggccctatttagtttaggggcgaaaagtttttgtgtgtcacattagatatatggacacccatttaaagtataaaacatagtctaataataaaaccgcgagacaaatttatgaagcataaccgcgagacaaatttatgaagcataattaatccgttattaacaaatatttactttagcacaacattatcaaatcatggtgcaattagatttaaaaaattcttctcacaattcacacgtaatccgtatgattagttttttttatctatattcaatattctataaatgtgtccaaacggttcaaagtgtgacaggctgaaatgttttttgtttaggaggccttattatctttctaccagcgcttctggctcactgtcactgcagcttggagcgacgcgcgtcaatgcatgcatgcatgcagtcttacgacgacctgacctgcatcaatttcagcacaactcctgcctgcctgctctagtgctgtagcacgagagatctatggagtccttgttgcagatagatgcaggacaggagagccaaggaattcagagaaattcagataaggcaggcaggggatcccatgaaaagggaaaattgttcgtctgcttctctctaaccctatcctcctcctgatcgtctattcgtctagctagctctgcagcatatgcagttgatcgatcagacttcaataccaagcagtagccatgattcatcgatcgatcgatacatatgcgtggagcacgtgcgatggagccccacctcacgtggctgaggagtgcacagcggccattgctaatgctacctctctccaagactcacgatgatgctctcaccacacctggccatgcatcaaaacgcggcgccttcaattcttcagttacggatacaccacagcagtaaaatctggttcagttcttctctgccgtcgctgttggtttctgaattattaatgctgattgatgatgtgttaattgccaatatatggcaccaggctaccctgcattgtcttgttcctcctgtacacatttggatggaaatctgaaaggaaaagagagatgaaatgaaagaaagaaaagcatttcagttaaaaaggaacatgtcatgtcccctattcctttgtgagtagtgatcattcttagatctaggaaaagtcgttcaggcaagcttccagctttcgataggaatcactttacaatgcacatgtcaaagagagatagatagatcagtccaatggaggagagtagttgccatgagcaagccttcaattttagtggttggggttcatgtatgtttgcccatattttcccaatgagatcgatcgaccgatggatgctagttgaaaagttgcactgttgtcttgttgcggcaatggcccataaatttctttatttattttggctcttttaatcaccattgcatcaaactgatcctacgtaccttcatcagcttaattgggtttaatatatttcagcaaagacattctaacaatgcagatactaaatccactaaatgaacaaccactgaactgcatgcagctcatggatgtttatctgtttcagtttttcttaggagtaatcattacgctagctcctgtctgattaattagtttaatttcttttggtcttgctgcaagacagagtatatatacatactaccatcctactagctgcagatatataaaatgcacacatatgcatgccacttctggttgatctcccctgaatgagctaatcctctaattgatgtttcattggatccccttccttgcacaactcctgagaccaaatcaactgacagtgacaactaaaggataacaataacaattctttgtgtttaggatcttgagggctcatggtaaataaataatcaattgacccttcatcttgaggcaagtgtattaagaaaactagagtagtacttgcaatccaatgcaatgcaaggcaatgctggtgtcacatgaggtcagcgaggaaggaagaacgaggctatatatctatctatctatctataaggtggttggagcatcacagatcacaaagtacaagcaggtcttgagttggaagcaatgtggatgggtgtatcctatgctaattatttatggcctttattagcttgtggctctctctcaaagttgtgatagcatctgagcagaataaatattgtgcagtcacaggtggagagtgatctgtattaagttggacaggtgtgcatttcatctacttttctccatcctctctctagggttcaaagaattgttcctcattaacatttatgttttggtgtcaaactcacatgcttcgctagctagctgctcctcctgctgacactgtccaatgcttaacttgcttgcattgacagcttctagtggtggggtgtgtgtatcttgattcttgagagtgtatagatttttccaggactaaactaggtcaaacagcctggcaagttttagtgtgttgttttttttatccaagctccttcattgttcttgcctgactgtgaattcaatgaacacacagttatagttttcctcaggactaaaaaccaggtcaaaccgcactcactgaattctgaacctgtagctttgatcagttcttcagtcatcatttatctgtcaactagtactaaattttcttttgcagcaccaaaaactgcaaatgccagagtttcatactgcaagaatcttataaagtgataatatgcaatgattaaggtaataaggggcttcatcttttgctctgaccaatgaagactgaacatattagtaacataaaacgcttcagcttgaatacactgaagactgaactttaacacaaaaagatactagaaaaacaatactgtgctcttagatcagtgaccagcaaacagagtccttgacaaacaaattatcaaactaaatctggtgtttagtatgtacacgtttacttgctttctcatggtttaataattaagaaataaaagagtatatacaacacatttggtcaagctagttttgattgaacagtgcaaaggaatctatctaattggacctggtttctggcaaaggggcacaagatgaggctgtagttacttatcctcctgcctggtgtctaattggacctgacaagcatcacatggcctcctgtgttcaaatccatttgttaaaagcctctcaaatcttgcaaacatgcatggattgtgccaaatactactaatccactcactagtcactagtatgttgcttgcactcaaactgaatcccaactgtgcaaaaactaatttattcataggggcaatcaaatcaaatacacacacagcttggcaatttagaaagcgcatgtttcttgttgaatcccatgaacctgaactggtcaatcaccaccagctgaggggctctcaactacttctaaatgttagaaaatgttaacaaacaaatgctgaaattagtactgtctgtttcttaccagttatcaataatacagttaacccgcaggcactatatatacatgacatgtatatatgcaaagtgaggtacatagtttaaacacacgagtcttagtttaatgagcagttaatcatctgtgtatggcaacattattgagatgcatggaaagcaagaaacttggcttcnagtgtctgcaggatggcacatgtagtaccagctagctaagcctgccttttttttttctgaaatattcctctagatctccaaatctgaaagtggtgttgttttcctgttaagaaagggcccttggctcttgccccttgagacatttgtgatctatcatctatctatctatctatctctgtactagtaattaagatttgattttaagagtagtagttagctaagagtaagatgattaggaaccagcatttgcatttcattgtcatcggtggtgatctgatgagactaaatgtaatgagccgagaagggaatgcgtgcacagtacaaccgacccaaaaccaaagaattaggttgtctcctgacgacaaaacacatgcttacaggagcatcagagaaggaatggctgctaattgaaccagtgggctccacaccctcccaggacctgcatgtttatctacattgggccttgttggcccattactttcaaagctacctccctccatctcaatctattgctacctggcgcctgccatatttctcagtttacatgaaagacgcgcatacatgattaaatgcatatccttcagttttatatatttgtaactttttcagagtaaagatcatgatattgataatgtgctggctttgtcagaaaagccaaggtattagttaatacatttgtaactattcactaaccccaactgccaagcgcccaatgcaaattcaactcgaccggatggatcattgctaatactgtgaaacgtgttctaatcaatgatcatcggctgaatgcagtgcatgttcaaccacctaaagcttgcatttcaagcagcttcagattaactactgcaatataatgtccactaccaacaactatataacatacgtatacgtacggtcttatcttctttaccggccgtatgcgtgtgaccatgcatgcatgaatgatatgatttagctgataaaatctgcatttgcaaaactgcaaaagagaaaaattcagagatgcatatggtgctgttagttcacatggagtacagagactttagagctaggatccaaacccccaattcgatcattgatagtgaccacttactcgttcgatcgatcggtcgatctacggcgatctatcattctatccagcgtcgatccatggatgcatctatctatctgtgtccatctcatgacaaggaaattcagctaagctagacgcatagtgtggtccgtgtactgccagttgatggcttcagcagcatacgagtgctagctagcaatcgtggccatgcaaattagcttcagaatcgttcgatcacaaattggaatgggagcaaattagcagagctgtctgaatctatgtggaattacatgctacactccaatttcaggaatgtgtcatctgctagatatgcttgttaggtagattattgctgctgctgctgatgatgatccatcaattaatggtaagtaattcagtgctggtttaagcagagatggatatgacaaaatggtgccagcaacaccctaatcagggtggaaacatgagcaaaacaagtgatatatatgcacatttatgtaggacaaaaaaacaaaagaaatgggctgtttctgctggctaggttggaccaaaaggatggaatggaataccccctccatccatgtttttctggggtgggcccacacccccacaggccaccactggcaactggccaactcgtgaagtcagaatacagatcacaacccaaaatcactcaataaattcaaagaaaaaatgttctttttcaaaaaaaaaaggaatgccaatagtttaaatttaagtatgaaaatcaccaaaaatgtccactaccagaacttttttttcctacaagcaccaaagaagagcatgagttgtcattttattttcttattaaaacaacaatatacttggtatttattatacatgcatatatatatatatatatgtataggaaaaataattacactcctagtattatattaatccctagtgactagtgacttgtagtgagcgagagtgagagtaggctttaacttggggcattaacctccctgctcttcttcttcttcttcttcttcttctttctttctattcctttccttcctcctcacttcttccttcttcttcctccttcactctcctctcccctccatccaacgctgcttcgtctttggagttggagttggagttggacaccacccaccggcacctagctaggcttctctaccatcatctgtgatctttcttgtcgagagagagagcaagcagttgcatgcctgattggtcagcgagtgagctgctggtggcggtggcggccgcgcttagtcagcggtggtgactgtcccggcgatgtcgggagctgaccggctaagcatccgcgccgcggcgctggcgctcgacgatgctgccgccgggagggacaagccggacaccaagcgtgacgtcttcgcggatcttggctcgccggtgtcgccgctgcggctgcggcctggcggcgccgcggccacgccgtcgtcgtcctcctcgtccgctggctcggccaagtcgcccgcgctgtgcaatgctggggcgggggtgggtaggggaggaggaggaggccgggggagccactcaggcgagctggtggcggaggggaacccgccgcggccgccagggcaccgccgctccggatctgggcctctgatattctccggcgggagcagcagcgccgggagcggaggaggaggaggaggctgcggcggcgggagcacggcgagctcgccgttgaccaatgcgctgcctaccggtaacatctgcccgtccgccggcgtcgcgagcgcggcgcctgcgccgccccgacgcgcccgtcccgacgtgcttggatccggcacggggcactatggccacggcagcatcatgagaggcggcggcggcatgactccccttagaagcagcattgacgccagtccgtaccacggcagctactcgaggtcgccggcgccgcagggcagcagcgggggtctccaggaggtgaccagggccgggaacgagtggtacaagaagggccattacggcgaggcgctgcggcactacgaccaggcggtggcgctgtgcccggacagcgccgcgtgccgcagcaaccgcgccgccgcgctcatcggcctcggccgcctcgccgaagcgctccgcgagtgcgaggaggccatccgccgtgacccggcgagcggccgcgcgcacagccgcctcgccgcgctctgcctccggtgagattctttcgcccttgcgcgttcgcagattcgtgtgctccacagccccaaacggattcacagatctcgccttgacatctccgatctttgatgctttcgtctttgcttatgcattagtgcctgacataacttgtgggtcaatagaacagggaattgttaccgatatatgctgctccgtatacctaccgtttctcttgtcttcttgtttgtttgatttgagatgatcagtagctttgcctttgctgatcatcaccagtaacaaatttacttgttttggaagtaaaagtttgatcttgaagttactgagaagtttttttttttttaaactgaagttggctagcaattgtgtggtgagactgggaggtctggaaatgtttgtatctttgcctctttggttggtatgctgaagttaatcaatgtgctcttaatatgattcgcatcaaaacaatgtagttgagagtgagtgcttacctgtattgtacattgtatttagaccgtagtacaggggagtcagtggtggtcctaatctattcagtgctaacgttcaatcaatttatgggcagtagctgtttgattttgtcactgaaaattgcaccatgacggctgcatgcaggtttggaatggttgagagggcaagggagcacttcatgttagctgggcaagtaaatcagtcagacccagctgagtttcagaggctccaagaggtggaaagacatctggggcgatgcatggatgcgaggaaaactggagactggaagagtgcgctaagggaagcagatgctgccattgccaatggagcggattcctctcagttggtaatatccccttccagcttatatctttgttgtcctgtaggcattgttgttttgtggccagtgttaaaactcagtcaatgaacatggaatcgaattatggttgcagcttcttgccttacggtctgaagcacttctccgtctcaacaaactagaggaggccgattcgactattacaagcttgtcaaaactggacattgcatcgctatcttcaatgtcaactaaactatcgggcatggttgctgattcatatgttcatgttgtcgaagcccaggtcaacatggcttttggaaggtgtgtatgattctcatcttgataattatgatttgttttcgtggtccgtagcaaaactagcactgaggtttattcctgcaggtttgacatagctgttaccatggctgagaaggctagggttattgatcctggaaatacagaagttggaaggattacaaacaacataagattagttgcacaagctcgaggacagggaaatgagctttttaaggcaggcaagtttgctgaggcatccttagcttatggtgaagggctcaaatatgagccctcaaatccagtactgtactgcaatcgagcagcttgttggtcaaagttaggtcggtggatgaaagctgttgaagattgcaatgaggccctcaaagtccatcctggttacacgaaggctctcttaagacgtgcagcatcctatgcaaaggtaagcgatacatgtatcattgtatttctgattatttgcgcattgtggtgttgatatctccctgttaacactcaattagcttgagcgctgggccgattgtgtgcgggactatgaggtgctacgcaaggagcttcctaacgacacggaggttgcggaagcattgttccatgcgcaagttgcactgaagacagcacgtggggaggaggtagcaaatatgaagtttggaggagaggttgagacaattaccagcatagagcaactccgagatgctatacattcacctggtgagcttttcttctacagatttttgctgctgtaccgcaaggtcctgtcatggtcttttgcatttactcattgaactatagccgttctagtattgtgggtaatcagaactatcactgttcttattgacacacttcactaggtttctacttactacatgataaaatttcaaaatcttgcatatcagcatgtatttaattgttttgaagttcacaaggcggcatgagcctgaacataatttatgtggtatttgttcaggagtatctgttgtttacttcatggcaacgatgaatcagcagtgtcaacagataaccccatccgtggactctctttgctccgagtgcccttcagtgaattttctgaaggtaatccacctaacatctctctctctctctctctacaatgtgcatcgcatttgatagaagtttcaaaggtgctaatacaatcccctctgtatcgaaactgtttaggtaaatgttgatgagagtcctatggtagcaagagcggagaatgtgcgcatagtcccgagcttcaagatatacaaggacggtgcaagaatgaaggagatgatctgccccagcttacacatcttgcgctattcagtcaagcattatgctgtctccagttcttgaggaggtcttactagtggcactcatattttttgatgcatataattccctgtcacctaccaacattttaccaacaaactattctctataatcagcctccacagcatttctccagctgcatagttactctccgctgagcataatgagctaaagcttgattcacgaagtagtttcctattggctatctttcctttgttacctgttgcatctattttctgatccttcatccttccaaccttattcttggatcatttaggttccttcatttgcttattcccacccatccatcgttcggccaacctgcattgtgcaattctttcatctcttacattctgttctgccacctcataatgcatttgacacatttttgctgcagcccataggccactcctcaagaaaaagaatgcttctgttctgacattgtttagatgcaggcatgcttgttgttagagaaagaaataagaggctgcagacagaattggtttttttcattacatgtacatataccatatagcaaaaacatgaaaccaattggaagatttgattctatggagggatggtggtgccactttgcagtggacagaagtacagggctagttgccaattgtagagagaagatagatgaagaaagacaatgtaattggtagggagataatgagggaggtggttgatgtctctttgcatatgcctctgctgggtctgtggtgctgatacatatatactacttgctgacatttttatgaataaaaatagcccaacattctttcttatttctactcagatatgcagtcttgcttccatttctgtgctgctgtgatgttgaagcatgtttctgtttctgtattagcaacaattttgtcaaaaccataggtgtgctgtaacttcagcagatgatttcataggtgtgctgcacactaactacttatagtcggtgagaaactgcaaaagtagcagatgatttcataattttgattgtctgatttagattgggcccacctgtcaggattgtgctaatgttgtttaggcagcaagtacctcctactgtagtataatactgctcctacagaaataggagtagctgcttttgcagcagatttcatgcacagcacagcagtaacaggaatctcttggagaaagaagcaccggccacgctcttgtttacttgtttttttgcatcatttgtggctgaagattgaagcacctgtcgtccagcaatgtgcttgtcgcaacttcccacgaacttggtagtgagtgtaagaaagaaagagaaaaggaaagctttatttttcctctgagaatcgaagaagatccagccatagatttcagagtggttttcgtcagttctgaaagccttgcacttttttcagtggattggctggtatactccagcctccaggtgtcgactgactgctgtgcaatgcaaatactagtactagcatgcaacaacgtgacgtgatttggtcgtcagagtctcgagagatgatagtccaatccaatgcaatgctgccatgtttttgggtgtgtttagttcacgtcaaaaatagaagtttggaccctgtttagttctaaagttttttttaaactttcaattttccatcatatcaaaccttttatacacacacaacttttctatcacatcgtaccaatttcaaccaaactttcaaacttcagtgtgaactaaacatagccttggttaaattggaacgatgtgatgaaaaagttagaagtttatgtgtgtaggaaaattttgatgtgatggaaaagttggaagttcaaagaaaaagtttggaactaaacagtgttggacacttggccatctccattgatgaaaccaatcaggattcttctgcacgctagaattgcagtcctatggcgatctgactgaaaccaatcaagctgtgggtgctttgcagtttgcacacacacatgttcaggtccacatgatgaacgagatgtagtgcaggttacttgatcactgggcagggtttggtaggagtagcagcaatgttgattgtagtaactagagattgtcttctggttcttgacttgatcactggaatgtgtcgtactgcagatactaatgcacaatgaatgtaatgttaatgttaaaaaagaaacaacagctactactactgcttggctgatgaagaggtagtaatgctggatctcttggtgtagaagtgaagcaagctgcttagcaatcttgtcggaatttctgcgtagagaccgggctcgtgtgaattcagatacagaagagtagttagcttagctgagtgagccatgtgagtgtgtcactgaccatttcatcgctgggttgtcgttgaagcctgcctgccattaacaagggtaccaacacatgttctgctcatcgacactcgttgacgcgtgtcccatttcattgcttgtttgtttggggtcgcccccctttttttatctccggggaaaagagaagttttttccctgatatcaggccgacatggcgacaatataactatgcactccaatctcaataagatggcgatcaaagtataagcaggctgcacaactgcagagattgggcaccgacacgccgccaagcacgcagacaagctaagcataacaccacaatttctgttccatttcagtcccttcaggtacacggcttctgttccatttcaaaactcgtttgtttcggttcatactctttccgtctcaaattacttgccgttacaggtttatcctaagtcaaacatatctttgactatatgagtttatagaaattgatagtcaaatattaaaatgtttaccttaggacaaaactagaacacaagtagttcgaaacagagggattacttgattttctgcaggtcactggctggaaactacactacctcatgggcactgtctttatttcactatactgctatctaccaaagtggaaatatctaaaagaatgaggtgaaatccctactgttacagatgtgagtgaaacccccttcacaaaatcatctaaagacactccagcgcttagcaaactagcactggagctcaactagttgttgcctatacagctatctaaaacaaaattttatcctggtagatatccaatgcatcgatgattttctgcaggagcagcttccggtgtagccgatatctgcatatcaacagaaaaaatgtgttaacaagcaagtggtacaaacaaacataaacttcatgggagcaatggctaaaacaacttgctagttcacatacttgattgcgatttcacgtgttcttctgatatgtccatcagaatctgcaacacattacagaccaatcatttgcatgtatttctcggaaggactatgaaaaaggctaaattaatacttgggatcctgatgggccttacctagaatctcctggtcttgttgaatagtggttgaaaaggactccagcatcgtatggcattcctcttgtaatgcctgagcagattttctttccaagcttggtatggcaggaacatcaccttctgaccatgtcggcagagttcttgctgctgccacgactcctccatcaacaaagttgttttctcctgaggtcaatgcagctgcaacacattggatagttcaaatcaaaggttccgaatcaaggcatgttgcagaatggttcgcaaggtcatgtgttcctagttcctaccattgtggtagagctcatcatgcaagccagcaatgttgaagaccgacaggaaggagtcaagatgaatcttggcatcactcgagaagtttataagctcccaaggattctgtagtgtttgttgtgtgcacacaaccatataagaagtcacattttttttaaaaaaaaaaatgacactgtagttgtttcaatgcatggtatcgtattaacatgcctagcaatctagcatagcagcacaacatatttgatgctagagttgtttcctttaagcagaaccataatctcgcagatatagttatacttatacccaacacaatattcctcaatgctaagtcctgccaagtgggaaaggacagatgtggcttgcaagaacaagcaagaattaaaatcaaacacatgatcataccgttggtgatgagaaaccatatctttccataaatgagctgttcactccactcatataatcaattgtcatctgtactgggtccatagaatgaaatgatcaaactggtttgaaattttggatggcatttaagtaaagttggcaactttccatgcaaataaggaatttttaattataatataacattaaactagtcgctctttgctcacaaggaagctaattgtactctaagctctaaacagtacctcatctccttttttgacagcatgcccagccttaatcatgacttcaaccatacgatctttgaaacgccaatgcaggaaacaattagcatcaggtgaatgattcagcatatctggagacaaataggcaagctataagttatgatgagactcagtatcagtaatcagaagctagaatatgctgattatcagaacagtatagttttgaatttcatgcctttgtgataattattaagtaattcaatgtaactatactgcctgactagaacgtctagaaggaataaagcgtagtattggtgtgaaaaatgacaatagatattagttagatccttattccaacagagtttaaccatacagaagtagtgctgatattagaaaatataatatcttggatcagttggtaactatgatttactgtgcaagtaacattagcgctataacattataaaaacctttatagcattcgccagctcaaaataaatggagcaaaagatccctcagaccgcagccttgacttagactgttagacatctgattatcatcgcaagctgaagaaactaagtgattttattcttaattttagtaatcggtgcttaatacacactgaaaataaaaataaagagcataaaggggaacagataagaaaacatgtaccagcatacggcactaggacatttgcatcttggaggaaggctcccattctcagtttcaaattgacagagcgagactgaacaatactcagtgcccatagaaatctttcatggtcaggggcaagacgctttagctttagagggattgttttatgctggacattacccatcaagctagtgttagatgtacccaagccagcgaagttgatcaaatagtacagaagtgtacccaatgtttttgccaaaaatcaattgctctcttctggttctttaacattttcgtggcaagatcttggtcttctagttccattagatcgtcctggcaagccaggcatgtaaattcattcaaactgtattgtcaggtttaagaagactacaattcattttgtttagatttacaatacctttggtgccaaaagcaagctagtgcattcatcaacactaggcaaaaaatcaccatatagctgccaaaagttgtcttctacatcaaatgcatagagaagaaggcaagctaaccttagatcccaatctgtctgcaagagggtacagattgcgttaggatgcagtctacatcacttatgaagctttgacaccgcatgaaggaagaaaacaggttgcaagtgtgatgagctactggcagtctgtaatcatcgn

SEQ ID NO: 8 - DNA, 7097 bp, Oryza sativa
  unsure (1)..(7097): unsure at all n locations
cgctgcnngggttgacgatcgatggancanncancagnatggtagttaaaaacgaccncccacaccgnaagaaagaagaaaacaggnggccagagcggaggcccaccatcccttttatccaatataacagcttattttcatagtagatggaatgggcagtcaaagcgctattgaatcttaattacacaatgttcctcataagtgattctgtagaaactaaaaaacacaaactctggaatgcacatacagtcttcactggaacataccataattagagggttagagggctccatttacctcaggatctgttgattcaatgatgtcaaatatgggatggcctagtggaataatgtcggggaaaaacatccaagggcgtttttgagttatagtcagcatcagctccaatggaatctccataatcacctgataaagtgaaatgaatttttatatatatgccaagaagattatgcataagtgtgtgattaaacttaactagttcttaaaaagtagtgaacacacgagcaagctgcctcatgatttctgaaatagaacagttctatgtggtatattaaagtgaagcactagcaagctttagttgcatccagaaactgaatgtgagcagtccttacaccatatttgattatttgcatagcattataaaaggcagcagaagatatgtaagcgtaaagtacctaacaaattcaaagattgacttcatttcgtactattcagtagaattcatatttgttctgatagtaggacatacatacgctaaccaactagcagtaaatggtaaagtaacaaccacagaatgtagaccatatatatgtactggagtggagtgagtactggctgtggctggctctacattgtacttgtacatgctatttgtaatgcccctttgtaagtatagtacttatgtccaattgcagtgaattggaaagataatgatgggatagttaaagaaaggctcactctagctctgcggagtgggtcgacgtcccgggaggcatagacggccatcccatcggggccttccaagaactcaaccccgtacgcccgcatcatccgcgcgtaccctatccggtagaagtcggggtcggccggctccatctgcacacgacgacattgttcatcatgcatgcatgcgcgcgagcagaagagatgtgagcaacggaagcaactaggcgggaagagattgagcacctcgggcgggaaggggtcgtcctcctggggcggttcgaggagcctgagcgggggggcatcgtcgtcctcttcctcctcgccgacctcctccgccgccggtgggggtgccgcgggaggcgggtcccggaggcgagggcgtccggcgcggggaggccgcaagacgaggcggcgggcgcagggaacggcgcggcgaggcgggaaggtggaggccgggagggggagggggagcggcatcaggagaggggaagcggcgggagtctccatgggtggcgatggggataggaagcgcacctcctgcgatggaagaatacgttatctactgctgcgatggacgagacgagattttagcccattcaaatgaatggcccatgggccttaaaatctataacctcgcgaggaataagtgtatattagctcccttatcgttcgctcctaattgaatcacctccctcaaccacacaacctggtatagcgcatctcccatcttcaaaaactgatacaaattaactcctttatggtttggaaaacggttttctctaacgtggtaggttgaccgtacttgactcgttgagttagcaggtagaactcacatgtcagcaacttcctcctcatcttgttttcttcctcaccttccctctatctctctttcctctcttgtgggcctcgttgggtggcgacaacagagtgagtgacagcggtggagagtcgaacccgaggagagcggcagtggtgacgactgaccagccgaagccctactctcctctagtgaccacagcaaaggccagccaagggcctcatatattatctgtcttgactgtaaggaatacatcgatgagattctcggagatagttttttcttctatattttaatataaaggttctaatatatccagcagagctcctgccgttcaatgtttttaaaaattaatatcagggttgacccattcattcgtaaaaagattcagagtttacaagatcctttatacaaccagggatacattgttagtaaaccaagtgaacagcaagctagcttgttctagctaacatatgaaccacctcatcagctctgcggcttatggcttacgcttacatgaacaaaagaaacttaagtaaaacatcttgccaatgatttcatctcagcagcaataaagcccgttaaggacctatctctggcaacaacattcaactttgaggcaggggagggaatcaattaatcttgtttcataccaatattatctatctatctatttttatctttttagaaatctatctatctatctatgtgcgcgcgcgttttgtgctcagaaggtgatggcagatctgttctaatcgagaaaaccatgtggaacatatattaagatcatgtggagaagaaaaaagaaagagagaacaataaaggattctattatctagtcatatactcatatatgaagaaattaagatttttaatattattataacattattccaaaaaaaatattcttatatcagtgtccatacgatggtaaatatagatattatatggcacctaaaaacaatagatgcactacatatatataatttgttgtttttgtgtatttagaccgggaatacgtttactgaaagagagagatacatgaaaacatatgcacattgtattgttgtctgaaaaaattgtcactgctacactatccgttataagacaattagaaatatttcactcttttttaatatatttgctccagctatatacattatattttcttgattatatctcctattccatgatttttaaaacatacgtcttctatgatgatatgattaatttgtatgggattcatagtgaatattcatgtggaaagaatcattcctgatcgggcctaactgtggtggaaatgattatacgactttcatgatgtgcgctagccatcatgagcacgcccatgttctattttcattgagctactattcattttccattcagtgtacatgtgcatagaaatgtcgttaaatttcagacaatttcctccaaaaaccatgtagaaactcatcaatcatgatttgttttcttaaaagaaaaactcagcgttgctgaaaacggtttaacttaggagtgttatacttatacctataaaaacacaaagaataatacatacctgaaaaaaatgaaacattacttgggcagcgttcgtttggaggacattgagggagaaagcatctcattttccacacgcacgtttcccaaactactaaacggtgtgtgttttttgtaaaaaatttctatagaaaagttgctttaaaaaatcatattaatctatttttaaaatttaaaataattaatactcaattaatcatgagctaatggctcacctcgttttgcgtatcttctcaatctactcaatccacttcttctcaaacacacccttgagcaagttttgtgggagagtttgatatgcttttttaaaaaaaagaaagatcagagactgataatcgatcccacagtccactgacgcgtggcccccaccccgaaagcgccggcccacagctcagccccgggcccagcacggtgcgcctcgtcgaactccccaccgtgctctgctgacgccctgggactcctctcacctactactacctgacctatatgtacccaccccactcacagttggccccactcaacctgcacccaccacgtcagtgactcactacccgtcgcgcgaggcccaggtggtctcgcctcccgaaccacgtacgcacacattcaaaaaaaggcaaaagaaaaaaataaataaaaaacgaagagaaaaaaacacatctcccaccgcaccgcgacgcaggcgcagacgcctgcttctcttctctcctctcctttcacgcacacagcacagcacactcatattctcttcctcccgatcgctaccacctcctatgcagctcacacccaacccccacgcaaatctagaaccttgtggattgcgcccttgctcgatacgatcgccctacccgtcagccgtccgatcggatccccaaagtgaagctcctccctcctacccattgcgttcagatagctccatgtttggcatccgtttggacccatgcgcgtgctccattgaatctgagctcttcgcctgatgctgtttagggtttccggtttgccgcccccgcgatttagatggtttacgatggcgccgtgaaggaccaggagagctcggctaacccggcgtcggcatcggctgctctgtcggaggcatcggcggcggcgtcggaggtaacagcggctgccgcggcgggggcgggggctggggcggcggaagaaggggctgctgttagtgggcgaccgccgaggcctccccacgacaagcggctcggcgtgcggcatcccttgaagcaccgcaggttccgcgccggggggaaggtgatggtggagcccggggatccgccgtccgcccaggaggtggcggatgaggaggccagcgaggtggagcaggaggcggcgccggtggagagggaaccaccacaggaggagggtggtgatgtagaggtgtcgtctgcaccggcagagatggaggtggtggagggggatgcaatggaggtgtcacctgagccagcagtggctgtgggggagtcggagttggaaggccgaccaggcgaggaggaggaggtgtcctcgcctgtggtttctcaaggggagaggaagcaggagactgctgctgctgctcctgtgccagcagtggaggagaagaaacacaaggatcaagagaataagcacaaagagagggaaagggagaaggagagagagagggtggatgaagtgggctacatgagtggtggatggaagaggtaatacttgcttctcttttccctattggagcttgcagataatcggttctgtaggcaggaattctcgtttatgcatttaattcaaatacaccatacagcttctgttctgatatcgttcatatcaagtggcgtaatagacgtacgttgagagcatgcttctgttctggtatcgttcatatcaagtggcgtaatagacgtacgttgatcatgcttctgttctggtgtcgttcatatcaagtggtgtaatagacgtacattgatcataaaatagacattgcatgcccaacatagctttgcgacagtaagcggatgtggctttttagtagatttgcaatgctccattataaccagaaatgtaatagtgattgacctatttagaattgtgcatttcagtggaccagaacctcaagctctatgatctcttagactagcatgtgtgttctaaacaaagtgtcttgtctgaaattgcatgcaagagtagcatgtgttatgattgtgctgaagaagcattttgatgtatttatgtagttccactatttggcagcatctttctggattttttatgaattactattcatggaatattgtaatgtcatcaggaacaaaagaaagaacatggttttaatgcgtacaaaagtaaatatgatagcacattaaaaaaaaattgcttacgtggcagtaatgtaaacattctaccatgctactttagctaaaatgttcataccgagttctggcaagctataataacaggcgcaataacatatgataccggaacaaatttcttcacagaagggtgctttcaatgctaaaatgtttgttgttatcataacttagatcttcatgtgatatctggtcataatatcaacacatcagatcattaagtaggccacttcattattacattcattaatcaaactaagctaacttctcctagaattttttttatgtgtgcctctctttgttatgctccatcacatttgccaaataatgaatattttgcacttcgtatctatttttgtatttattagtatctttggtgatagaaaattagacatcaatccattctgctttgctaatgggtaactttgagtttggtgcttgaaatgtagtctggtggtttaatggctggtccattattggagatgaagcaactcaggaatagaatattttcactttcttgtttgatacagatagattatatagtttagatggagtgaaataaactttaaatggttttatggtagtagcgttatctagccaggttttgcaggcagaaaatcctttcttggtacttgctgattgacgtgataaaaattgaatgggatttctcacgctcaagtaactgttcggaccctcagcccccatattattgaaatccaactgattcaaatacctgtaactaatttctattgacatatggcttctttttcttcatgccagtagattgttatttgtagaagaataactgaataggcactgtccttttatcagaatgtaaagttaattttaccattatattacatgaatatcataagcattttcatctatttctttcttaacattaggccttgttatttgactgatttgcagtgaggatggatttctgagttgtggatattcgagttttagaggaaaaagagcaagcatggaagacttctatgatataaaatcatctaaaattgatgataaacaaataagcctctttggaatatttgatggttggaaaattttccttcagacctctttgtgtctatcagntggtctattttaaacgtttcttttcttgtgcaagtcatggtggttcacgtgctgctgagtatttgaaggagcactttgtttgagacctcattgaacatccagagntcatgacaaataccaaattagcaataagtatgatatttgttcctagctgtaccactaacctcttcaaaaatcctgtggatattcttgtgatggagtaaactgatcaatggtattccacacgccgaacatataaaaaacctgttcaaagtttttgtatctgaagcccactcatgagatgatgatccaccgcttgacaagccgtttggttgaaa

SEQ ID NO: 9 - DNA, 36036 bp, Oryza sativa
  unsure (1)..(36036): unsure at all n locations
ctgggcaatttgataactgatttacaccagttcatcacaataagtatgatattgttcctagctgtaccactagcttcttcaagatcctgttgatatttcttgtgatggagtaaactgatcaatggtaatccacaggcgaaacatataaaaaaactgattcagagtttttggattctgaaagccacactcatagagatgatggatcaaccgcatcgacagcggttttggttggaaatcatctctatgtggcaaatgttggcgactctcgtgctgtaatatcaaaggctggcaaaggtgcttctgtttacaaaagatgttgttcatttatttaatactggatgcagttgttgcattctttgtggcggtgtacctgctgaattgttgttaaacatttcgtttccctcctatttatagctattgcactctctgaggatcacaagccaaatagaagcgatgagaggaagcgaattgagagtgctggtggggttgttatgtgggctggtaagtcctgcttccatcaacacctagagtacacacaatactacaatatctgtgttctaatctgagatggcatagatcgtgccctgttattttggagaagcactgacatacataggtggaggagacttgcaaattgcgactatcatcttgctgatgatggtaaatggacttttgcagaaacttgaagggtagtgggtgtacttgcaatgtctcgggcatttggcaaccgcttgttgaagcaatttgttgttgcagatcctgagattcaggtaacatgagcagcacatatatataaatatggcaacacattgatcctctgtggcttatactttactatgaagtgtgaactcttcaactattttatcaggaacaagaaatagatgatgaattggagtttctgattttagctagtgatgggctgtgggatgtggttccgaatgaggttagtttgctaatctatagcttccctagaggtgcagaaattcatttgtttgcattatatacatgaaatatactttattgggcttcaaagattggatttgtggcatgtgcaacatgtggcggcagtgaacagcattagggcgatgctctgatatactgtgattttgctgtccaactactgtgtgctactgctgtcccataaaattatggtcataacaatataaacaatgatgcatttgactaggtttatacttaattaagacattaaggtcctaattcaggagcacaacctactccttcacatctgagttgcttggtgcataaatttgttgtaacaccactatcatgttcgtgtcactatgaagcttgcattcatggaacttgcagcatctttactctgttatggaggtgcagtgtaacacatgattgtatcaacatacttttacagggcttggtatttatttttcataacacccttactgattgtactctcttggtcataaatagttgatgtttaggacaagattccgtcaaacttctaaagttccgacgggagtgaataacattattctcgtattgatttcttgctcatgtggcttctattttgtcttgaacatacacatcacatattgcatttatggaatgcggtttaacacatgacactgataataaccatttacacttatatagggcactcttactgactatagcgttatttctctgattggtgtcttgctcacatggctgcaatttttcttgaatatacacacatcatgtcataatggataatctaattatgctcccctcttgttcatagtgcattttaaaacatagttaattcggctcatcgtgtttctactatgttgatgcaggatgctgtttcactcgtgaagattgaggaggaacctgaggcagcagctcggaagctgacagagactgcattttcccgagggagtggtgacaatatcacatgcattgtcgtgaaatttcaacatgacaagatggacggtgattcctcaccaacaagcgataaaagctgattccatttgttgtttgttatacatgttgtcggtcgtttaacttcagctggattttcccggcttcatatggtccctacaatggcgtagctggtactaaagactcgcttcatgttcgcctgtctatatatccctaattttggtgcctctggtggtttacaagttggtattgctatctatacttctctttagtctgcaattttgtagatgttatagaatgaaatctttcctgggccgaatacatccaagccaatatgtgtgaagtccatggatgagcttgttgatcaagactgatcccaggccagtggagttgcattacatgagctcccaatgctgggctaccatctttctggcactggaggtttaaatgggctcatagtctgatccgtggcaatggcatggctcaaacttgaaatacatttatgtcatgtgcgcagaagcacagacaggattgccaaggctggcaagatctggagcagaagcagcactatagaacgtgaactacacatggttgctctattcccatgggccatggatcgaccatccagagaggaagatgattgatggtcctgctcctgctcctggccctatagttctacagagatgctgctttagccttgggggcaagtttacaagcttgagcaatgacatttccatttaattgtttgtgtggtacatccggcagagtaatagtttgagtgagaatggattcgattgcgttggtagctacggcgtgtccgtaccgtaaacaccgtaaggctgtgtgtactgtggatttggttccagtagtgccgttgggagatggagcccattggaccacctctacctgttccatccctactgtttgtacagtagaactacagaccagacaaggcattcgagtactcctttaagttgccagttctacactatttaagtactcctatgctctaaccagaaatactgcctattgaatgctgtattgtgctccaacaaatgcacaccgagaaggctatcacttgatactacacaggcaccaacctggattcagcttggtgctaggttgttctgaaaagaaaaaaaagcttggtggtaactggtaagcagccaggtattcttgtccagaattccatgcaaaatgagaacactaataactagcctatgttaaaagaagacacttgtggcttgttcactttgctttcattttcaaccatacaagttttgggcattgccaaattttagaaaggttgccaaattttagtaagatttcatatgtactcactaaaatttgacaacaaattaaatgtagtcatttatttttgggtaactttgccagaaaaaggtaatgttaaaaatggtagcaaagtgaaaagccgttagatgagaatgtgactccacctacttagtcctgaggccacgtggaatgtgagaacaaccacaattcttaccgaaattgagctgcctcatttgagactcctatggcatgccttgatggagcaatcgaaaagttgcacacgtgaagatttgctactccattaataaatcaggatatgctacttttgaagaattgaacatgttgcaaaaaaaaaagaaaaaaagataaatcctcaaataataaatactcgaggaaaatattgaccccaagtaacttgtcctcttgcactgcatatttgcatgccaccccagaaaggacgagagaggcagtgagccacagtgcaagaaaccaaaccataatactagctcgatccatgacaactacacataattgcggaccacattaactccactccacgcgtacatccagccacaacacgagggacaccaccttttcagtgtgaccgtgtccacttcacttcacttcgccgtgctcgccatcatcgccgctgttgctgctgctgctgcttcttgccaagaagcgatcgatggtggcgtcgctgcgcctctccctcaccgcggcggcggcggcggcgctggcggtggcggtggcgctgctgttgccaccgctggccgcggcgcagggggagacgacgtgcccggcggacgtgccgccgcgcggcgcgtggatgtccgtggcgagcttcggcggcgtcggcgacgggcgggcgctcaacacggcggcgttcgcgcgcgccgtggcgcgcatcgagcggcggcgcgcgcggggcggcgcgctgctgtacgtgccggccggggtgtggctgacggggcccttcaacctcacctcccacatgacgctcttcctcgcccgcggcgccgtcatccgcgccacacaggtacaggcacagcacagacgacagctcagctgctaggccatcgccatggccatgtccttcttttacctccaagacctctcatcttcatcttgtcgagcatttgtactggatcaggacacatcgagctggccgttgatagacccgttgccatcgtacgggagaggacgcgagctgccaggaggaagatacatgagcttgatccatggtgatggcctccaggatgtgttcattacaggttctaattctctctacatgatgacacctcacttcttgtcagttgtcaccttgtcctcaagttactgtttcactgcaatacgtgtactacacatggcccagttaacttgcagtcggcaaaataaatcagacctgcaattttaaaaagttcacattttctttgtttgtttagacttctgaagcaagatgatgagaatgccatcgaacttttgtgtcgttgggatgttcaagattccgtctttctgtgacctgtgcaggtgagaatggaacaattgatgggcaaggcagcgtgtggtgggatatgtggaggaagcgaacactgcccttcacaagaccacatctattggagctaatatcctccactgatgtgatcatctccaatgtcgtcttccaggattcgccattttggaacatccatccggtgtattgcaggtgaacacaaacagatcactttgttatacttcagagcctacactccaggcattattgtgaactccattgctcacatatggcttttggacactccgttcaattagcatattgtgcttctgcagcaatgtagatccactttgatggatgtagaggctgggttttaatccattatctaaaaaattagcatattgtgcttctgcagcaatgtagtaattacgaacgtaaccgtgttggctccacatgactccccaaataccgatggaattgatccaggtacaagagttgtttcactttgtaaatctgtgcgcaaaattccctatgcctattctgaatcaagatcttggactcaaacactgcagattcaagcagcaatgtctgcattgaggattcctacatttcgacaggagatgacttgatctccatcaagagtggctgggatgagtatggcatagcctttgggcgacccagctccggcatcacgatcagacgtataacaggatcaggaccatttgcaggctttgcagtgggaagtgaaacctccggtggtgtggagaatgtccatgtagagcacctgaatttcttcggcatgggtgtcggaatccatgtcaagaccaactccggaaggggaggattcatccgaaacatcacggtctcagaagtgaccctcaatggagctcgatacggtttgcgaatcgccggagatgttggagggcatcctgatgcatcatatgatccgagcaagcttcctgtcgtcgacggcgtgacgataaaaaatgtctggggtcagaacatccggcaagccgggctggtaaggggtatcagggactcggttttcagtcggatttgcctctcaaatgttaagctctatggtggtgattctgttggtccatggaaatgccgagctgtcagcggtggcgctcttgatgtgcagccatcgccgtgcgcagagctgacaagtacatctgagatgagcttttgtacaaattagatcagatacaaaagtgaatgatagtcatataatccatcctgaaataaaattcgtcatgttccttttttttggcaaaaggttgagttgttgtgccgattgattaaaaatgtaactgaaacaatgaattgtacttatccaatataataattcagtaccatatgtggcataaaagatcaattcctgcgttcatatgtatctgtaaaactacgtcaaatctacttccccaatagggaaatgcatacaaattacaattgtatgtatggattaaaaaaaaaagcaagagacgatgcatatgaaattcaattcattttttagttctgtatacaaatcgtaatcataccgacatttacagaaatagaagttaagtatctggctctgcaggagatcccctggttaattgatgttttaaaaaacattatagaatggggaatgcggcggcggcgaggtcgcaggcgcaacaggggtaacctgcatcacgattcctggagaggccgaaccagagcttgtgttcggcgaggccggtgaaggaattctctgtgacttgcccccaggcgcgccgcgcgagacatcgatcggacgcgacgcgtcctcagctcgtccgagaacaagatactgtcagcgccgccgacggcgacggcgacggcgtgggatcctcgtcctccacgcgggaattggtgacagacagctccaatcctcgtacgaaaatctggcgtcctgcaattcgtccctgtccacaagatcgggcacgaccgcctgggattggcaactagcgacactagtccttcttgtttgctgcccaagtgccgacgacgtagaggtggtggccactggactacggagaggtggtggaaccctacttagctagtactagtagctcaatgcccagacagcctgaattgcccaatataattcactattcacagatccatccaacctatactgaaagtaaaagaactgagaggtcattttaccttcctctcctccttctccatcttctccttctcaccctcttctcgaactggcacactcactcttccgcgtcatataacctggatgaagaaagccgataagagccagtaatggtgggtgaattgatcagctagttcagtgttcaccagtaatcattgcaagaacatttcccatccacaaaatggtgaaacctaacagcatcacgaagaataatttgtcgatcacatagagaagagatatgctttgccacctcatggcagtcgttgcacatcctggtgttcttcatcaccctgacaggcgctctacttgcatctgagcggatcagcccataagtgatagcaagcttctcagtatggccaaggagaagcttctctttctcttcttcctgaacattatacgctatgcagctggtgtctggcacatatcctgccttttttatttgaaacaccagacgaataagctcttcatatatctctgcagtttcaggatgcggcttcccatcgacctcaaagacatggataccttgctcaatctgtatccaactccacccaggtctactatccactcctcttgctttcattgcatatttcaggctctcagcttcatcatacatccgttcatactcatacaaattcatcatcaacaaatagttggctgaattgtaaggctccagtatgaacaaattcctcgcagccacctctgcaagagcaagattcccatgtattgagcatcctgtgagaagtgccccccagtggcttgctcctggatcaatcggtgacctctcaatgaaatccattgcctcatcaagataaccacaccttgccaagaggtcaaccatgcaggcataattctctgtcgttggctttacaccatacttagtctccatactgtcgaagtactcccacccttctgtaaccaagcccatcgatctacaggcagttagaagtgcagtgaaggttatggagtccggcttcaatcctgagttccacatatcatggaacagttctattgcttcgcgaccttgcccatggactgccagaccagttagcattgcattgcagagcaccaaattcttctgctgaatgctttcaaatatcacttttgcactaaccaagcttccacccttcgagtacatgtcaattaacgctgtgctcacaaccatgtcacagtcatatgctcttcgcagcgcgaagcaatgcagctccttgcccttcttttgcagagctaatccagcgcaagcccggagcaacactgacatggtaaccaagctgggctggacaccatccttctgcatctcatgacaaaagtagaatgaatcttcatactccccattgtggcagctacccgagatcaatgacgtccatgagaccacattgggcgtcacaccagctgccttgatctgccggagcagcagcaccgcctgcgagctctggccgttcatggagtaaccagtgatcagaccattccaagtggttatatccggatcaagcctgttcttcttcatcaattccacgagctccagcgctatgtcgaaccgcccggcgttggcgtaccctgcgaccagcgagttccaggtggtcaggttcctgtgctccagcgcgtcgagcaccttctgggcgcaatcgaggcggccgcacttggcatacatgtcgacgagagccgtccccgtgtagacgtccggctcgagctggttcctcaggaagaagcagtggatttccatgccatggcgaagcagccccgtgttggccactgatttgaggaggctcgacacggtggtggcgtccggtcgcagcccttgcttcagcatgctggcgacaacgccgagcgcttcccggtcgcggccgtgccgggagcagccggacagcacggtgttccacgtcgcgacgttgggctccggccccgacctggacatgcgcgccgcgagctccagggcgtcgtccacgagtccgagccgcgcgcagcacgcgacgaccgcgttccacggcacgacgctgcccgcccccatcgcgtcgagcaccctagtggccgccgcaacgtcggcgttctcggcgtacatgccggcgaggaatccgggcacgagcgggtgcgcgtccagggcgagcttgagggcgtacgcgtggacggccctcccctcgcggagcgcccccgcgcggccgcacgcgtggagcacccgcgcgcaggtgtacccgtcggcgggcaccccgcgcgcctgcatctccctgaagacggcgatcgcctcgtcccactcctccgcctcggccagcatggcgacgtgcttgttccacagcacggcgtccttggcgccgtcctccgccgcctcgtggagcaggcgcgcgcaggagggaccccggccgaggcgcgcgagaaggtcgacgagcgcgcacgtcacccgggggtcccgcgagaggccggtcctgaccgccagcgagtgcagctgcggggccaggcggcgcgcgacccggtggtcggtgtcatccccgtggaggtcggcgcagtcccggagcagggagacgaggacgccggcggagtagggcggcacgccggtgcgcagcgccgccgcattaaggaacggcggcgcgtggcgggggcgggcgaagggtggcgcggtaggtgggaaggagagggagacgagctgcgcctgcgccttcgccatggaaaggaaggaaggataaggtcaacttttttttttaagagagagaaataaggtcaacatatgtggaaagatgggcctatttagatttcatgggcctgtccagatgggcctggtccgtctaataagggaggcccgaactgcaatatctactcgaaaagaaaagaaaagaagagagaaaaaggaatataaaaccatcaccagaaggggagagcggcggcggaagggagagaacagaggtgtgtgccggtagagaagggggaaaggggggaaactgatttaatagctcgggtggacgtacgtctacccgtttatatatgtcatctacttcctcacattaatcgaagaaaaagaaaaggcagagtccatatagaaaatacaatttagaaatagctgaaattcaaaattaaaaaaataagaaatattagaagaggagaccagagtccatatagaaatacaatttaaaaatagttaaaattcggaattaaaaaataaagaatattagaagatgagaccagagtccatatagaaatacaattaggaaatacctgaaatttggaataaaaaaaaaaaataaggaatattagagtagagtaccaagtccatatagaaatacaattaggaaataactgaaattcggaattaaaaataaggaatattagaagtagagtatagagtccatatagaaatacaattaagaaaaaaaatagaaattcagaattaaaaaataaggaatattagaaatagagtatagagtccatataggaatttaaaactaactaaaattcagaataaacataataaaattaaaagtagagttttgagtccgtataaaaatacaatttacaaataactaaaattcgaaattaagaaaaacatgaaaagaagagtttaaagtcaatataggaatacaatttagaagtaactgaaattcgaaattaaagattaaagaatattgaaagatgagtttagagtccacatagaaatacaattagaaacaataaaaattcagaaataaaaataaataatattggaagaagagcttatagtctatatagaaatacaatttacagaaaattcgaaattaaaaaaaggaaatattaaaagacgagtctagagtccatatagtaatatatataatttacaaataactaaaatttgatattaaaaataattaataactaacacgtatataaaatacaatagaatattacacatttgtagtttcgtaaacttattgcaaaatttaaaatatgatgtcatttttatatatttgaataatataatgagaaaatatatatgctattatatgaaagaaaatataatgatgctagccgcgcaatttgttctggccaccatgctagttcatattaatgtggatgaatctagacatatatatctatctagattcattaacatcaatatgaatgtggaaaatgctagaatgacttatattgtgaaacggatgaagttgataattatgaaaaaaattaaaaaatatatgaacaagatagattaatatgtaatatagcaatccacaaacatgaagttaaaattcaacatctacaaatcataacaaaaataacaaacaaaactcaaattactatatgcatatttacaattaaatttgttatttttgttacaacttatagaagttgaatttgaacttacatgtttattgaatgatataatacatattgatctatcttgtcattttttttgaaaatttttcgtaaccatctagttgacatgcaataaacgagtggacgtccactcgaactattagaattcatctccggaaaggggagccgctgcaaggaagacatatagaatacgcctccatatgtggaaagcctaatgtgccaatgctcgtgacatggacatctcgcgaatgctttttaacaatgtaacgataaatggctggttagggtttcgaggtgggatggaaggggggaggtggacgttgtgaaggaggaagtgggggatcgagcttagatggatggcttgggaagctgtggaacggtggtgtgtggcggacaaaggcaggcgacggtaccaccgtaatgcggggtcgacaccgtagtcattggtgacgcaactgccactcttacttcttaactcctctcatttccctgtcctcgcctttgatgccaacccaccgctatcctccatccctatagttctatccttcatccccataactctgacattgtcatccaccgtctcgtcacccaccagtgtccaccatccaataccaattcttcgtctcttacaaccatctctctggaccccaaaaactcccatctttcctcttccccaccaaccctcctatgttgaccctaaactcaaacccgaatgctaaccgattgagatagctgaaaagctcactcgagcacgaatcacgaagctatatccaatgatccaaaacctacaagatttgatcttcgattttatatggctggttagttctcaaaaacttttcccaaaaaaatcacatcgaatctttagacatatgtatagagtattaaatatacataaaaaataaaaactaattgcacaatttgtatgtatatcgcgagatgaattgtaacgctccgcttttcgcgtgacgttaaaaactaattcgacaaaatcctatatgcaaaaatttcgttctttgagtgagagtctaagtcgtgccatggatctcaattcaatctccatcattgttccctctcatcgccatcaaaatcctccacctcaagtttccaatcccgattcaggtttccgaaatcaaatcctgaaattcaatcgcctcctttgaatcctcgccaaatacttgtcccgattccacaaatatccgagtccaccttgaatccattccttgactcctccctatttccctgagtccaagtaatcaaattcgaaattcaattccaaatccaaatctcttccaaatcatctctctgcaaaagtctattttgcctcccccttggtcggtgggccgattcttccttccttggcccatctcctccctcagactcacacgtgcgttgcacgcgccgagccgagccgagagagagctctctcgctctctcgttctttctctctctcgatgctttctctctttcacgcgccgacgtcgatttcccgccggcatcgctcaaacctccaccgccttcgctcgttcccgcgtgcgctccctccgtggtggctgaccgcccttggtcgccatccgccctggcccgcctgcgctgcgcagccgcccgcgcccactctgccgccgcccccacctctgcgccgcagcgcgcgtgtgtccaagatgcggaggcagcgcctctctctcccacgcgctttctcctccctcagatcgcccaaaatcggcaaggagccgagctcctttctccctccccctttttgctttttccccgaccggcgccaccgtcacctcctttgccacccgtgaccgcctctgtcacagcttgaccgtgagtctgccaccgcctctccttgatcgtccgtgctcggttccttcccctcgaagctcgacatcccgcgcctataaaaccacagctgagcccctcccctccatctctctcgttttcgccccccaccgcgccattacagccgaacaaccattgccgccctgttgccgctcgacccgatctcgtcgtcgccgtccgccgctgagcaccggaggaaccggtgcgtgcgtgggcgcgtgacgaggagctccgggcgccacttctcctctctttctccccggccgcgcccactcggtgccgcaccgtcccaccgtcgcgaccacctcgccatgactccctccgatccgcgacgccgtttcctctcgtcggtgagctccctgccgaaccctttcctcctaccgcttgctatgccgcgcccgccgccgcacgatgcgccgcgcgcctcgccgttgctctgtttccgctgccgcgcgcagtcgcgcgccgtcgtcgggccccagctcgtcgaccaccctcgccaacactgtccttgagctccctaggacctcctcaaaccattccctagcaccgccgtcgcctggcatggcctcaccgccattaccgtccgctcccggaggccgctgctcgtcgccggccctcctcagtgcttctccgccccatccgacaccggaaacggattccttgaaccctggagatgctcccacccctttgaatcgaatcctcgtcgtctcgttgtgttttcacctttttgctcgccggtgattgccgccgccgcaatccaccaccgtcggcacctctcgcgccgattcctctcgccgccacactcccggggatccccttgagctccccctgactgtccctaggccgccggccttctcctttgcctccgcgccgtgtcgccccttccgccgccgcataacgccaccgcacgtgcatcgccggtgaccatcgggtcccgcgtcaccgcgtgcgcgtcgcaaccccataccggttcggctaagtccgagcccgcgcacccttcgctcttctcgcgcgcggccacgtcggcgcgccagcgagattggccgccgccgccagccgtcgtcgcgcgtcgtcttcccgatccgagcgatggaatgagttccccttctcctcctcctgccgccagtgctagccgcccctccggcttgccgctgttcgccggatcccgccgcgcgccatgagccgcccgacctcctctcccttccccatccgacgtgacgtccacgttggcgccacctcagccgtcggccccgcttgaccaagtcagccgacgcccagtcagcagccgcctcctctctcttgctcttgggcttggcccagtagccaccctcctcctcggcctgataagtaagacaaacaaagtccacatagactccctttgtccaagcccagtgtccatcacccaagagctaaaagtccacaattactccctccaattgctcctctctctctcaccttcttgttggccccacgtgtcaatgagtcaaagatattcttgggaatatctttttcaatactccacacatatttctcttttctagaaattcaataaatcatttcctatattccaaattccataaacccatcctcttaatccggagattccaataattcgtcccctcgagcccgtatgtcagtggatgtcaataatattcttgagaatattatttctataaattccataaaccatttctcgtattccagaaaattccgacaaatcatctccttgtccagaaaaattcatttaaacttccaaaattcatatccctcgatccgttcatccgattgcctccattccacttccagtaattccattgaattgtgatctatctaatggcactattaattagcctaaatcggacattttatttggtctttgcttaggtttttgattgtttgcgcctagttgcggttatcggatatttttcttcaagcggatttctcgaagatttgtgaagcttcgtgaagaccctgagcaaggcaagccacctttgaacatattgagcctatatttgaacttatttatgttacttgcaaaatattatgcattgataggattgcacttaatctgtttgccccgtctgcaaggcagaccggtgggcctacctaatttgttgcatctgatccttctattgttaattgttatatcatgtttccttgtaaccatctagttgcgcctcgataattcgtgcactctgtgcgagtatcgatggtcgccttcaaacttaaaatttgagtaacttcttgggtaacacttggtttacaaaagttttggaaaacccgacgcctgggtcggtgccttgtgaaagaaaatgagttttaaaaatgaaactcgcgacacaaggccattcctgggtggaatacttgtgcagtcgcatttaaggaccgattccttcggaattacatccgagcatacaacagtgcggccacatgggtgtaatgggacgcccctggctgagtaattagctaatcaggagaaccatgatgccaagagacatgtggattcaacggggtggtgtcggggagaaccctcgggcttcctggcacagtatggtctgggacctaacctgttgttggtctgggacccctctcgttggcatatggcaaccctgtgtcggctttggaaatgccttgtcgtgaaagcctcaaagtcgccagacgtggctgttctgcacgggctgggtgacctaggttagtaacgtcgtgtgggtaaagtgtaccccctctgcagaggttattaaactgttcgaatagccgtgcccacggtcatgggcggatgtgaggtgattccttaacgtagtttttgttttaccctgttttatgaaaatgtgttaaggtttgggaaacctaatgcttgggaagcatttagttttccgggggacagcgggaccgggtgtccctagaagtgattggtcgtttggggaccactattatcgagaagtttggaaaattggtttggtttgggaaaaccagatttgaagccaactctgggagttgtgcaaatcttgataaataaatttgttacttctcacctcccgaccgagctgagacttgtctcgctctggttgtggaaagcacacacttagattgttgaaaacttgaaaacaaaactgtttgcaaaataacagccttccctttaagcttgcattaaccacctaagttcccctggcttgctgagtacgtaagtactcacccttgctctctatataaatatagttctgccagctccgaagatgaagttgaagtgaagtgaagattagggtttcatcctagttccctgccgttgcctgtggcgttgggtgttagtccgttggttggttccgctgctgctgctgttgttagtgtttgcctcgtctgtgtcgccggttgcattctcgggctgtctgagctgcaacctaagttaaggtaaataagtcctctattaattataaggatttgcaatgattcatgtttgtcactgtgggtaccagcgctatgtcctgggactggtactgagatcgcggtttcgtaggacgcggttcacgccgttttactacgacaagctcctgccacgtgccgttgtacggcggtgccagattgaggtgtgacacaaatcttttaagactaattagtccatgattagctataagagctacagtaacccatatgtgctaatgacggattaattaggctcaaaagatccgtctcgcggtttccaagtgagttataaaattagtttttttattcgtgttcgaaaaccccctccgacatccggtcaaatgttcgatgtgacacccaaaaatttatatttcaccaactaaacagaccctaaagattagcaattctcgttccctatatttgtcaatcctcaatccgtgtattgtgacccttgaataaacacgtcaaaacaactaaaatctttgattactattagatcccgtagaattatttcgtcactgacgttaggggcaacattgaacttttacagcacacggggctgaggaagaagaagaagaagatggttgccatcagcgcagctcggcgggcagcgcaaccctccggctcctagcggcctcctcccagttgagcggcaagcgtccctcccggtcacggctcagccgctcctgcgcgccgccgcgcagcttctccagccgcggcgcgtcgctctggtgcatcacgaacaccttccccatgttgaacaccgccgccaccagccacagcacgctccccaacacgcacatcgtccacgcccagctccgcccctgcgtgacagtcaaaccacacggttttgtcatggcgtcgtgcatgccaacgccggcggcgaggttgctcgatcgaatggatcgcgcgcttaccactagcaccggcggctcggggcgtcgtcggcggttgacgacggcgccgaccaggaagagcaggctcccgagaagcatcggcacctgcacgctcgactgcagcagctgcgcccgcccgtcggcgcgctcgtacacctggcacgagttgagtatcgaccccagcagccacaccagcgccgcggcgagcagcgtgttcgccgcgtgcgtctccctctcgccctgttccatgtcaaagcagagtgatcgccatgcgcgttgtgcacttttgccaacgatctagctatttgaaacgcacctgggagagcagaaaggccatggcgacgacggcgaggacgcacccagccacgtgcagcgccggcacgaggagctccacgaggccgagctgggcgttgtacctgaccagccccacgcggcagtccacgccggcgaggtgcgccgcgaggtcgtgcgcgttgacggcggcgacgagcgccagcgccacggcggccacggtgagcgccgtcctgctggccccgcccccgcccccgccgtccgcggacagtgccgtgagcgccacggccaagagcagcgccgcgaacacgtacgccccggcgttgatgtactcccaccgccgcacggtcagcgccggaccgtacatgcgcgcctccctggcggtggctagcttcaccatggccgccctgggactcagctcctcaactgaacgcgacgccgatcgaaagcaaacgctcgctgatccgctaagtacgagtaacagttgcggttgcgcgagtgcgtcaatgcggtgggcgggggggagtttgttggatgcgcagtcatggcatgcgactacgtggcgctatgcatggcatccagagcttgtgtgcctcccgacgaaatctctgaaagctagtggggacttggagattggcgtttctgcctccataatccagatggacattttgctcgccgggaactgtaccagtgttacatctggcaatggcatgtctgcaaattcaggtgtcacctgctcttgattcatcgagacgatgaccgataatatatttagatattaagaaatggagggatcgggctcagcatcagttcaatgaatcaaattaaactatagctagttaacgtatattcatagttaaatttgttttttacgagttatagaagttaaatttaaacttacatatttataaagtgatatatcatgtgttaatatatcttctcaatttttttcataatcatttaagtgacatgcgatcaacgaggggatattctctcaagggattaaaatagtttcaactcccgggttcagagttgctactcaattcttcaggttcagacttcagaaagtattatacagactgagcatcagttgatagaaaaaggaaatgtcttttcttttgaatgcacagcgtatgagctaagctaagcagggatcggatcatcccctgcaccgtatctatatgctaagtaagaattacttacatctgaggtgcatatgtaccgcaacctcacttggaaaaaaaactcgtggacacacacacacacacacacacacacacacacaccgttcctgtatctataacacggaatcatctcagtgtattttgtatctgtaatctgcaatgcagaggggatcatgcagaaattatatacagcagaatatgcagagtagaatgaatacctgtggttgttggtatttgctaatgctatgcaggtttggggaattagtaagattgctaggaatacatgcttgtactacatgttttatgcacagcagagagacgagacgattgcatggtggttttcacatgtatctgcgcaggtattccactcgcgtggggtgcttgagcttcatgagcgccttgagctcgtacttgcgcaccatctccctcgagatgttgaggtttccggcgatctcgctcagcgtccgcttccccctcccgtccagcccgaacctctgccggatcaccacgctctccttgggcttcagcgaatccagctgcacatttatacatacattcgattcgaatcacatttcaaaggaaattcaagaacagaattgttctgttcatttacaacttacgaggtcgtcgattgcgaagcggttgagggtgttgtggctgctggtgtcgacgccgatggcgtcgtcgtcggtgacctcgttgatgagctcctcctgggtgaccctgttacgcgcgtggagggagtaggtgggcctcgtcatccgcaccacgtcgcggtacctcgccggagacagccccacctttttcatcacctcctcctccgtcggcgccctccccagctcgaacgccagctcctcccgagccctgtggatctcctgcctctcctgcacccaatcaatcaatcagccaatctgaagattggacaagacgagatcgagctgaagaagaagaaggaggaggagtacgtacggattccatggcgaaggggaagcgggtgaagttggagagggtgatggcgcggacgatggagtggcggatccagaatagggcgtaggtggagatgcggaagccgcgcttgggctcgaaccggtcgatcgccgtgatcaagccgttggcgcccgcctggcagatgtcgtcgaacctctcgtcgttggacatgtccgggtagtacttgttgatcgtgtacagcaccagccggagattatgctgccattattatattattcatgatcagtctctactgattgcgtacgtgacagtagtgacactagtttagtgagtaactgagtaccttgatgagcttgttcctggcagctcggccgacctcgagatggcgcctcatctgaagaacggacatgttcatggcctcggcgagctgtgcgtcgtttggctcgctctgcacttcgttctccaggttctccttcatttccatgatcgcctgaaatatgttgatccatcaaccggatcctaattagtcaatttctccaactaatcaaactagctaaaacagttagaatcatcaaggcaattggcaattaccttcatgggctgcatgatcctgaagaggcggatgctctgggcggaggtgagcacgggagggatcttcatccgcttccagtcgaggctgcccatgtcggtggacacggcgtgctcccggagcagcatctcctcgaacccccgctcctcgtcttccaccttgccggcgccgccgccggcctcttcttcctccctcctcctcatctccaccctcttccccaggtccatcctctgtccccgcctccttctccggctgctcctcaccgtcaccgtcgcgttccggctcctccccttcgatgacacccatacgcatgcacgatcaagatcgatctagctagcaagcgagaatccattctttcgatttgatttagaagaagactagctaggatgctcaccactctgccttttctcttccgcttggtctgtttgctcttctcgtcctcctcgtcggcgtccttctcctcgaccacggcggggctcagcttgtagatgctctccagcgcggcggccacctcgttgtagtccgtccgctcccgctcccgctccgcgtcggccgccgcggtcctcgacgccgtcggctgcggcggagggagcttggccgtgccctgcttcgccggcgacgcgagcgccgagcagctggtggacgacggcgtgcgccgccgcggcccgccgccgagggagagcacgacgggcgctgaccgccgcggcgagcgccggtggcacccggcggataccggccggctcggcgtcgtcacagtggacgccatggcagaccagaaaactctaaccgaaccttctagaaccttccccgctcgttcactcgtgtgtggaatggaatggaatggaagcaacaagcaagcaagcaatggcgtcgacggaatctcaggcgagaagatgctcctctcctccccgccacgccatataaggggccggaggcgaaggcgcaacggccgccacgagctcccctccggcgaatcggacggccaggaacccacgggacgacggatcggacggtgagggaggcggcggcgtggcgcggaggggcgcacgaggttggcgggagatatgcgtggatgaggctcgcgccacgtgggcgatggccataagccgcgtgatattttcgggatctctcgcttcggcttcgggtccctgggcccaccgatcagtgacacgtggaggcggagaaatcgggaaagtctgcatgggttggtgttccgctgtaattcagtgggcctgtaaatatttgggctgaatttgtggccacatgattttttttttggaattatattagcacaaattcttctgcaatttctgaggtccacaagattgtgagtttacgtgggcctaattcggccgttttttctcgctgaatggtcatcttgtacgactcgcctacggaaatctacggtgtccaccaagtttgcactacgcaaaaaagagaaaaaagaagggaagaacataatttgttcgaatctggaattttcaccagtgttcatgaaatttacaacacaacaccttagtgaactttcttcagcacacgcgtctttacgttttttggccttttctttttcttcatgaatcgatgatttttcctctttctcttttacaatgttttttttttgtgaaacctaatgaatacaaatgtcaatagtcaaaaaggcgccaaaaaccaagcactatcgctattcgttaggtccatttcagtccacgacgttgccgctgaagagcttgaactggccggcgtcgagcacgagcttccgtacggaggcgacggcgccgatgaggccgacgccggtgaagacgaccatgatggcgacgttggcgaggtacaccggcgaccgcctcggcggtgcgagcgccatgttgtacatgacgacggggagcacgaagtcgagcgggatgaagccgacggcgccgacgacgccgacgatgtcgccgaagaagggcagcatcgcggccacgaacgcgcacgccgcgacgtacgccgtccggagcgccacccggggcgccacgttccgccgcgagaaccggccgcgcgccgcgtcggccgagctcttctccatgatctcgtacgccacctgggagtagacgagcgcgatggcgagcagctggaggaggacgagcacgacggcgaggccgagcagccacgtcggcgccagggaagggcccttgtccggcatgaggctctgcaggacgttggactgcacctggctgccgaacgcccagtagccggtgatcgccggcaagtagaaggtgaacaacaccaccgtgtagcacagcaccagcgccttcatcatcttcccggccgccggcggcgccagcgtcgcctgaaaacattgccatcacgtcgttaaatcagtcacacagcttgcagctgtcagattctcagaaacaaacaagctgctagtacctggatttcaggcagaatgccattgccgaagacggaggcgaggatggaaatggagaggaacgcattgaaggtcttctccgaattggatgagctcagggagtaatccttctccgggacatcgctcaaagcacctgtcagacaagaacaacatcgctaattgttacaacaaaaattcagtcacaagagatgaggttaacatggtgtcgtgtcatgtcaatcctgtcgtttcttgctgtcacagtgtcacttgtcagtacgagattacactctaatacacactcaactctgaatctgaatgtcaagtaaataaatggcaggcgattacctgctcggatgcaggcagctgagacaaggatggtgtagccgaagctgaggaggagcgagccgaggttgatgtaacgcagggagtggaacgacggcagctgggagagcaaggacagaaccacagcgacgacgatgatgaaatggtacagtttcaggggtccatttggtgcaaggtccgagtacattatctgcacatatatgtgaagtgaaatcatcatgtctcacaggagtttcagaatgtcaaaaaaaatatagtaaacattcctaattgacacataaatcagcacaccgatgaaatgaaattaccaagcattcgtaattcaccacaagtcagagtggctaggacatacagtagtagactcttcagggtgtgttttggttcacgctaaaattgaaagtttgattgaaattgaaacgatgtgatggaaaaattgaaagtttgtgtgtgtaggaaagttttgatgtgatgaaaaaattgaaaatttgaagaaaaaattgggaactaaaccagcctcagtaccacttggacaagttggattgcgtggtcaaactcagggtttctctgtccttgtcgtatataaaaagtacggcttggtcttccattatctacgaaatataaaagtacaacttgtctaagctatttcaacttctgaggtgagatcatggtattgcacaatgcaactctaagtcaactcactgtagccaatattgttgacaaaggcaaacattttgttaggagtatgcagaattaattcagttattctatttctgtatgatcccttcccacaaagaaaagatgataacaacttgaatacaaagtccagattttctacataatcttgacagagaacgatgaagtgcaacataaataaacaaataaataaatgaggacttattattcagtttagtgtgaattcagtttcgtgggaagccatgcatgcgtgcacgatttatacatacttgtaagcagtcagccgcaagaaggatgctcccgatggtaataccggcgttgatggcagtttgcacggtgaccaccaagtagaacacccatccagatcctgccaagagaagagacaaaattgaattaatgacactcttaatgatgaggtaattaatctctacatttagaagaagatgaggtgcatgcggaccgaggacgtcggcggcgagctcgcggaagcggatgtggcggcggccgtgggcctcgcagtggtcgaggaccctggacatgaggtagtaggcgtagaaggtgacggcggcgacggcggtgagcgccaccaggccgagcgcccaccccatcccccgcagcgcgtacgggagcgtcagcaccgtcggccccacgatcgccgtcgtcaggtggaacccggcgtgccaccacttccctggaatcataattcaccaacaattaatccaagatatatactcctccggccatatgtgatgtgatcaggtagtagctaggttaattaggtgacctttggactcgagcacgaaggcggcgccggcgtcggcggcgggcttgatgccaaggcggcgagcgccggacgcggcctcgacgtcgaacaccgcggcggagggcggcgtcggcatggtgttcatcaccggagagggagagcggagcagagggctgcctccggtgccggccatggatctacgtcgaggtcaagaagaagctcgcatctcgctgaacacacttacaccttacagccttacaggggtatggtatgagatgagacgagaattgaattgtgtgtgcgttttgatttgagtttcttgtggattacaactacaactacaaccaggacagcgcgcgtgaggaagagaagtaggcctgaaaccgttgacctttttctttttgacaagaagattattgaaggagtcttgactgtatcccactcccaccccacggcgctggagacacgtaccactcaaaccgtgacgcttcagtttctcatcaagccaactaaccgctcatgcgttgcaggagacccaaggcagatacagatattatctactaacagcaggcagcagcacacatgtagattataccaacaacatggaacctatactgacaataaggatttctaaactaaacaccactagcctgttttgtactccctccgtttcaaaatgtttgacaccgttgactttttagcacatgtttaaccgttcgtcttattaaaaaaaattgtgaaatatgtaaaactatatgtgtacatgaaagtatatttaacaatgaatcaaatgatatgaaaataataaataattacttaaattttttgaataagacaaatggtcaaatacgtaataaaaagttaacggtgtcaaacattttgaaacggagggagtagtacattagataaatgaagttgaatatcactgtatttatctactgtgggtaaagtacaggccaatggggaaactataataaacttttgaggggatgtcccctagttatatttgcatgccacttaaacaattatgaaaaaaattaaaaaaattgagaagatgtattaatatgtgatatatcacttcataaacatgcaactttaaattcaactcctacatatcgtaacaaaaaaaacaaattaaattataactagttaacgtatatttatagtcaaatttattcttttttcgttttgacatgtagaaattaaattttaaattgcatgtttgtagagtgatatatcatatgttaatacattttctgaatgtttttaaattttttaataactatttaagtgttaaataatatggaagtagagattttaaaatccactctccaggcaaacgctacaatgcagcccaacccaagatattcagagagattatctataatcatcttgcttagcgtgcaggttgtactaacagcggcacacatgtagagatgtatagtacgtagtataaacgcaacataacacaacctgtactgacaagaacagtactaaaataacactagctctgggatcaccacttgcttgttttgtacagtacacaaatgcagcgataataaactgttcgttagttcgtacagactagagggatcagtggggcgtgctgaaaaaactgtaggaaatatacaggtcaacgctgcaatgcccaacgagcaacgatacacatgcaagatgcatggtactgtacgaaaaatgcctccagactccagccaactgaagatggaattgttctggcagataagcagctgtgcaatgtgcatatataatgcgaatttccatattactcctcccatcccaaaatataaatatccaagtacttttggctttccatatgacatagtagaagtttgttcttaaaaaaaaaatctactaacagatcctttacaatgtataacatgttgatttcagccccccaaggtgttcatgtgccaaaacactgttgacaaggaaaatacatttatcgattaaaaaaagcatattaataaaaactggaatcacaacagagtagtacgttattaaatatttcgaaccatgcactggtaagctcatgcatgttttccatgattgagtaatataatggcgcatttggtcagccaaactagagttgagtttcagtataaaaaacaaatgtaatacctttgtaaatgaaacctcaagcccaaatcatcaaacattcacatctgccacctagcaaaaggtggttaagattaaatatttacaactttacatacatgtgtaatataatgtaaaaaggcactggtatagcagacatattacaagcccacaacgatacacacccagaatattgtctatactctattgctctgtatcaacaacatatgcaggggacaggaaacaacatacccagacacatgaggaacttagagctgttcgcatgcttaggtcatatatacctaaagaatgcttcaaatgaagtaatggaatttgtacgacaatttgtcaactttgaatgagtaagtggtaaatatatataaaaaacaggtcgtcttaggtactcgtgtattactgttgctgcacactcaagcttcaagaagtacaatctaaaggcttcttccatgccacaatccaatttaactcccttgacagcttttacgtggaaatgagtttttgcaaagcaagggaacatcatcagagccagagagctaacttttctcttcagggacgtgcatgccaaatccacgttttaacttctcaactctgatcattaaaatttgaaattgttagtgcctggttttaagaaatctgatcaaaacgtagttgctgataaaatttatgttactgagtctaagcgttgacacgggagtaatcattatgaatagaagaaactagtaacacaaaactctcgtaatttcatccaaaggaacgatatgatgagcttgcacaatatcatctgatgatttacttctacgtatacaatagactacaaacaatgaaaatactgaaacaaccacagcaagatgaaaatagctaaaagacaaggttatgcatagagcgctctattctttggagggcaaaagatccgatgcccgtaaattgtggacaatgaagcttggataggacataacgaccaatctagttagtacaaacaaaaccggaaatctaattaaagaaataagaccagacaggttggaagagttgtaactactatgcacgcaagctgaaagtattgatcatgtcatgctctagtgttctatagctaaggtggtgtttggatccaaagactaaactttagtccctgtcaaatcggatgtttggacattaatttggagtattaaacatagactatttacaaaactaattacataaatgagaactaattcgtgtgataaattttttaagtctaattaatccataattagcacatgtttactgtagcatcacataggctataatcatggattaattaggttcaatagagtcgtctcgcgaattagtccagggttatggaatggtttttgtcaatagtctacgtttaatacttctaattagtgtcaaatatccaatgtgacagggactaatccaaacaacccctaaatttcctctggcctgttatgtgagatgcattagcttggcctagatgtccagagaggcagagactacagaggacttttcgtattctgtgattagagttgaggtgaaaagggaaaaaaaatcatgtacagtcgttggctgcttgttattgggtttttatatttagggtgtgtttagttcacgccaaaattggaagtttgattgaaattggaacaatgtgacggaaaagttggaagtttatgtgtgtagggaagttttgatgtgatggaaaagttggaagtttgaagaaaaagttgagaactaaaccaggccttactttgaaatgatatactcctattcaacaacaaattaactaattctttggcatagatgatacggtgcattggaggccatgatttcaaaacgtgggacacaagaacaacaggtgcaacatgaaaacaccactgcaattgactgaattgcctggtattcatgtttgttgatgcctgatttttttttttgttaatctggcaacataaagatctggttgtctttagctttgtcagaagatgctgtgaacctgtgactacactagagctatttgactagggttgtttaacttgaaagatattgctgctagatcctgtccagcctagatcttctgtcccctggcacaacatctttatttatttaaaattttgcatttttctcatgcttttttcagttagtaagctcgggcttttcttctcttattggttatgttggacagagttgtttcaccagtttggcatgtgttcaatgccttaccaatttaatacatcttaagccatgatctgaaccttctcctggctcttctattcttgttggatcacacactcaactcccaacttcaataattagtcagactctgttcattaggttgttctttaaaatgactagtgtaaggaggccaaaaggtgaaaatattgtgcaagaaatgaatggacactacgtgaccacaaaattctggaaatgctatttcacatggtgttgttcgaactgagctgaagaagaaacttacgtaggagcaagctttccaagctttcgtaattttttgccagttgtttcatcaatcacatttccattgatctcaacagaatatgattttccagatatccgtgggagacctcttcctgcaagcaattcaaagtctttctgatgaagttctctaccattgacaataactcctgtgttcccaccggcacaatttttcggcattggataattaaattcctttataaatggctgcaaaaacaaagctctgtcatgacgtgctaccacaaagttctagagaaagaactacgagaaaaataatcatcttacagggatgatgccactacactcatgtcccatgacaccccaaaatccagcgcggtagtcatacctgaatcacaattagagaatacggaatgttaccttacacggaaattcccaatgccttgtgaatttaagttggtgaagatccaacaaagttgctttggaaagtacattaggtagatgatattcccagagtaatttttactgtactaactttgcattttcctcgtctttgtatactaatcagattaattttaaaactgtagctggtaaaaggcagaccattgaattatggagcttgcatgtcgcaagcatgcagatgtgtgaaaataaattatagttcacactgtaccattacgattaacaataacagaacaaaactaatgttgcacatagttactgaatgccgagacaaagtaagaccgtgataataaattaacagatgttaatacatgaactaggccatgcaagaaattttttgagctactagcatttaatgggagcaatcaacagccaaaaaaaaaaaaaaaactctgcaggacaagaatcttccaggtatctcatcactgtacaaaatgttctagtaatcaactcagggaagtggttgatttggctgagaaaagttatcaaggaaatcaggtacataggttggttaatatgcaattgagaattacacagtcatttaatcaccgctgtgcagtataagtcatcttaattcctactgttaagatagattcttctgaagaataacaccaatctcttttgcctgtagttgtgcgtctcttgatttcaaaggcaaatgataaaaagatgctaaagaaaacaatgacaagtgccaacacggtagatatcaaacgctaagaacatcagtccataacaatttccaaatttatgaagggagaaggtgacttaccaatatgaaccagggccaactggaccagacttcttctcggccttccgtaggacacgttcggagattgaatggccattgattgaaaccttagcactgtccactgattgattgaacaaagaaatgtccttcaaacctttcttcaaaaaaccagcaaaaaactttgaatccccgttcttagtagctgcagactgaacttcgtctagttcagcctcagaagaaacacgagaactagaatttgtgcgctcattaactgatgactcaagcttcgatggcattatggcatgttcagaatttggggagagcaattcactataacaatcatctaagtcatcttgtttgcatatcgtagctatagtttcaacttgaatgacactgttattatcttctttgctgcatttgctatatcgctcagtaatgaattctgattgaaagttgttgtcatcttgtttgattttttcttcatactttttgctcacgtctccatcttcaaggctgctggtatcatcattatcagccgtcagcttgtctatgttacccatgcttccatcatcacaaaagccacttgtactttctttgagcttttgctcatgtctactgctgacagtttcttctccaaatccttctttatgatctttgctgttctgctcatatgtcacgtccgatctttcatccctaacattagcatcaacagaatctgccatgatatttaggctacattccttgcttgtgcgatctccaccactacaatcttttagacgactggaaaatggatcgacacatttgtcctctataactggggcctgtagattgcctgtattaaatgctgaagtttctacttgactgtatgcatctccttgacatagtatatcctttgggatatttgcaagtctggaccttctaacagatactgatagtaactgactgctcctgtttgatccacactctttgtctattctgtcataactagaagtagaagacacagaaatattgtctgcaagatccttgttctgctgccatctctcttgtgcttgcagcttatggaaactagaatttccttcatcctgatgttggtaccacccaaaacttttgttaacctgacgactggaactccccactgtttttgatgcagggaaagatgtcggcgcaaccaaaggatgaattttcacttccttaagcttgaaactaacgatctccgagcacgaaccacaccgaacttgaatctgcttccgagctgtgcatttcccaggaggcagctgcagcagctggttacaagaactgcatacaacgaaaggagcggcgcctctcacaggacgacagaaactctctgccttcttcctgaaaaactctgtcctcctcttcgacaccgagaaatgagagtacaatgacgaagcgacagacctccggtcaagctccgatgagactgatggggacctatcgaacaggtgagacccctgctggcctgcaaagtacctcgtcatgggaatgtgctcctcctgcatcacagctctctggccatgaaggcactgtgcacactggcaggtgctctgatggtgattccccccaagatacccagaattctcccactgcctctccggccattgccggaaccgcccactcggctgcctctcatacctatctctatgcatagaccgatgcagctggtcattcggactgtgcggaaagccagacccgtaccttcccgtgtagcgtgagcggtagtgctccggcccacggcctagcggcggcggctcggcgtgcgaggggcgcagcgaggccgtgcggcggctcatgcggtggcgctcccgcggctggtcggtgatctcgcaggacctggtgatgtggtcccgcagctcgtcgagcttccggagcagctccacggggttctccttgagcgcgccccaatccagcacgccactccggtcgccgccgcattgcccgtaatcgaagggctctggaaccctagcccttctcctgtacttcatctccttcgcctcgctccccatggcgccttccacgggacgagctttccccccccccccccccccttcgccgaatcgaaaaccctgcggggaaaacttccaatgagtcgctcgaaattcgtagccaccaaacacgaaatgggaagacgccaatgtagatcagagcagcgaagcttctgaatgctacggagaagcggaggaggcggcggtggcggttacctcgaccccaatgttgcggagcacacggcggcggcggagactctacggcgcggggatgcggagaagccaccggcagcggctcgccgatagggctacgcggcgaggaggaggcggtgggacgtggggttcgccattgtggtggatggagtggcggccgcgcgctgcggcggcgagaggaagaagacgagtgggggtgaagtggaaaagagaagcctaaatcggcgggaatccagggactggtttgtaattatcaactttctagggggtttcggcgcgatgtagctttgggtttcagttggggatgacctggctgagacgctgacgaggtgggcccacgtgacagctggtctgatctggctttgactagaaaagagcccccctttcttaacgcgccattgcttgctttatgtcaaacacagtaacagcgtgattagtggctgtgctcaacaacattaatactccaactaaaagtaaccaaaaataataataataatcggcctgtctatctatatatctatctaggtgagtgaggctgcttgtgtatagtttgtttgtaattttaaaatcttttcttttcattagcattcgaaggttcatctcataatttggaacgcataacaaccacatgcttttcgcaaactatgcaggagttagcttgctaaatatcatcctaaggggagttgacagagatcaaataattcgattttaaatctacatgtgttgtacggcgcatttttgcgatataaatttgtgtatcagggggcagccccttgtaagagccgcaataaacagtggttagtgcacgttaacaaatgagctctcgtggacctcatttttttagtgaggtatatatctcatttcttcaacaatactacttgttcttctagctatagtaatatatgagagcatacagtgtgttataatccaagcaatcagtttgtcaacgacaaaccagacgaatatatggacctaaacatgtggcatgttcctgtttctttattagaattttgtcaggttatattccatcagcatttgatcaatatctgacacaagaggctgaacattcattacaggacgttttagccttcaaacacaggcggcattgacaagagcctgaaaaacatgcagtgctacgaaaatgagaaagttcagagagatccaaaactgtactacttgagtatttttttttcttctggcattgatctgtatatctattgagttttggagtacatacataatagttaaacctgaacttacatttttcagatgttgaaacctgaaccaaaattgtataattgggtatatcttcagacagggaactgtaatggctgttgggttctggagtacacaggatagttaagcctgaacttacatttattcagataatgaaacctgaacctgcatgattgtaaatgtttccaaactctaaatgcttgcatgctaattaaatgcaatctagctgtagctgcctaatgcaggatacaattaggcaagctatgtggacaatgaaggttgagattaattagcaaagtaatgaagggagtggggactgaagaaaggctgaaaagtggcgagtcatgtcatgggtgatgagaaaacagcgaagcaatgcacctaactctcgaggtcggaagtggccaaagaagatcgatcaccaaacaaactagttagggggcgccaaccaaccaccgtcaaccacagacactcggacagacagctccaaaagatgcagatgccagtgctgcacatttggccacatgaaagtcgcattcaatttgcttaattaaactagtaatttgcctgtcgaatagcccatgctacaccgacgaccgtcggtcctcttctagttttcagatgagtgtgtcctcttaacaggagaagatttgcagctttttcgtgctgaaaaaacggtacggacagtccggtttgtgcgctgtttgtatccaagaacatgacgaaattagttgaaaaaaaaagtggtatctgaatgaagaataaggatgtgtttgtttctgtccataacattaacattttcttgatctgaaaaaaaaacattagtattttctttcagacatatatgtattgtaagatattcatacgggaccaaatcaagtgtacatgcgattcagatttgtagcatctgtgaaacgactgctctgcaatcatattcgtttcagtgtctccttttctaactgtatccatatatgttcatgcgtgaccaaaattaaaaataaaaaccagacatgcattatatctgtttcactgtttgcctaacagcaaaacagttaggcaaacatcacatgggtagcccactgttagccttccgctgatgggctggaaagtcgaactgaattcacggcccaccccctgaggttggacggggccggaagcccgcgtgtggagatgggccaggccggttacttcctctgttccgagatcaccgcctccaagctcctcacagtcacagccacaagggaattgaagccgccgccgcctcctcgtcctttcggccgtgtgctctcacgcagggcgcggcggcggcgatcttctgtgctagcgtggcggcatcgccgttgctttggaggtatgagctcctgtcctcctgtgcctcactttccccttcatatctcttggcttcttcaattttttcccgtgcaaccattcagaatttgtttttgcctaaacattcccatctgtcatagaactgctcctttttctttctttttctttttttggctcaattgctatgcagcgataggccgggcattttcaggactcaacctgggccgaacacgaaacctacaactgggctctgtctgcaggcctaatattacaaacttggaagaaaaaccacacaatttcggcggtgacacggcggcatacatacatcatcatcgatatgtctttaacgcagtggagaattatcacgggcgagcggcacatcaaccgatcaaattatcgatcttgacccatgccatgcaatggcgagcttcacatgtccaacaagcaaaagcagcgaagaaaaggcatccgacgatgcgaccacggagcagaatgctaacaacaacatagcagtatatgcatacggaaggagaaagaaagaaaagaagaaaagcagaggcgaggagcgcctcgcatgtgaaaaaaataactcaccggccgggagatggaatggatccctagctagcttggcggtcgaattcatcgtcctccatcgccgccgccggcagctggctcctctctccgctcccgtgcatgcatcccccatccctttttaattaaagccatctgtctagctagctcattcagaataatcctctttctttctcccatctttttagtttttagctagctttgcaacagctagagagcacagttcagttcagttcagaaattcatattcactgagattagcaaccatgcacacgtacgatgtgtgagcctcccctgcatgtgcccgtcgtgagttcatcannnnnnnnnnnnnnnnnnnnnnnnnnnnnnnnnnngggagtncagtnttcaattncccgg

SEQ ID NO: 10 - DNA, 845 bp, Oryza sativa
  unsure (1)..(845): unsure at all n locations
agctcctacctgaattngactggtagaaacngcccanccnngntatgaacgcgctgatcctgatgcaacaacctgcagctatgcatactgatcgatcagaggattgcccggggaactgggttgtttggctctgtggtcaactggaagagcgagcttattaaaactgagaagcatgtgcattagatcgttccaaacatatgatgagaaacaactcatctacgcccagacatccacatgatttctagccggggggacggctgtgtccttcagcggcaagagaggtcaagaagaacatttaacattttgaaagacccagctttgccggcaagaagaacaaactcgtccaaagagctgttgcatcatcaaaatgcaagaggcgtaagtcttctactctaaaaactttacctactaccagcagcaagctactaagcacgcccactttcatctagttgttgagaacgtgtttagtcatgcatgcttagccatgagatgtgtcatgtgtgcaaatgtgaaatattggtgtcatgcatttcccctttttccacctcgcaaaagaaatacatttcctctgcgtttcactgaatttatcagatattcacaactgttgcatgtgtctttttttcccttggtgcgatattccaattcagacatcaattgagttgccgaagcaaggtcgtgagggagcaaaaagaggttgtgagtcccattgtgacactggaaaaatgaaacagaacctttttcagagaaggtaaggatcctttgacagaacgatacaaatacttattggttccaccttttctgcattataaaatttctttaccaagaaaaaccgcctttgtaaaacg

SEQ ID NO: 11 - DNA, 1003 bp, Oryza sativa
  unsure (1)..(1003): unsure at all n locations
naaaaatcctctccctgaaggaataaataggggttgggtgtctttccacacctttttccaacccaatctcttcttaaataagagcccgtttttcaaactattaaacgatgcgttttttttaaaaattctctatatgaaagttgcttattttaaaaatcatgttaatctatttttttaaaaaataaatcctaattagttataaaaaatcctcggtcgtttaccatgcacgggtgttagttaagattgggtcccctattaatattttttctatgttcgcagtcgttgcaatgcgccacgcacgcagcggtagcggccacgtcttgcgccccgaccacgccaacgccgctcagccgaagctaatcccatccagcatttcaatgatggtgtcaacgtgttaggaagacaacatagttgtacgccggaacaaatttggtcagaaatctctgtggtatataacatagtgcatagtgcatctcgcactactacagaaagcgtttttgcatacggccggaatcgatcttcacatgcggttggccggcccgcatgcgcgaaatggtctgcaaagatcaccatttgcgcatgcggccgtcgcagccgcatgcgaagattgatcttcgcatgcggtcacttaagacggccgcatgcgaaaatagatcttcgcatgcggtccatataagaagccgcatgcgaagatatattttcccatgcggtcgacctaagaagaccgcatgcgaagatctattttcgcatgcgggcgtcttaagtagaccgcatgcgaaattcaatttccgaatagctaaaataatatttattctagcattttggtgattcgtaattaatatgaaattattgagagatttattatcgtatttcggagtagtaagcatataagataagacaagtgccgcagtaacaaacatgtaatacataaccattaattcaatcgtaattttgatgaactacttgcagtagaaggcgagtctacgtcanatctaccccgcgt

SEQ ID NO: 12 - DNA, 1129 bp, Oryza sativa
  unsure (1)..(1129): unsure at all n locations
ccgctcatgaaaggcntacctccaacatgttcaaaggaacatgtagcatgcatgggttttaggaaagccttatgaatcgtgaactatagggcccaaaagttaaagtatatgtttctgaatagagatgtgtatagtggctgtcgaatccatcggtaattaaccgtgacgatgaaacatgctctatatgtaaatctgtgatgaaatagaaaaagctaaaggaaatagtgagataaaggggaagaatgttagatggatctccttccccttgagcccaacggctcaagggggccttgacccgcgccctgatcgggggcgcccagcccaatggctggtgggcccccgtcacactgtgccatataaagaggggtggaggacggcacgggataacatgacacaaggaacgaggttcgtcgccgccgccactccaccccacaaaccctaaccgatcgagggggcacagccagtgacgggaagtccaccgccgcgccacgcctcgtcgtcgacaccgtcgctgccgcaaccgcatcaccgccatcggcaccgagcacaccgtcgccgccgtccacgtcaagcccgcgacgacaacgacgatggccggccggacttcctcctcctcaacaacgactggtcacatccctaaaccctctcactccctctttgttcattcatctattgttgttcatccatcgcaaatagaaccacccgactagatctaaacctaggtgatccaatagacaaccctaacaatggtatcagagccaccctagagtttagattggttggggaaagaaatccaaaagaaaggccaagaaaagccaacgatccaacggatcgaaaagatcgaatccctaaccctaatcttacctcgtcgccggccgtcgttgacgccggccacggagggggagaggggcgaagacaaggttgttaagccaaccaaataagacaggcttcgacataggtacaccacacaacggcgtgaccatggcccacacgacttaaggaagacaacgaggaaaaacacacgcgccagcctactaacttgctgtgtaacggtgcgaacggccaggccgaaggttggccacagngcacccttcgagctaacaacggcggaagcttnccccttcttgag

SEQ ID NO: 13 - DNA, 5060 bp, Oryza sativa
  unsure (1)..(5060): unsure at all n locations
ggtccaaatcatcgtaggcttggggtaaagccaggttcgtcaaggttcacgccatgtttaataatactgtgaagctccaggatggtcttacaaaatgggctttgggcagtaaagtgacttttaatgctgttattgcaaaacttaatcctatattattattcccttgtacctgccttgcattaattatgcatccgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctcttttcttcttcccctaatgctatttgcaaaaggtttacccttttcttcctccttcaaatttcaactagtactagatggtcaggtcagtgatgaagaagacatcgtcagttgttcgccgaagctccggaagactgcaggatctgctagtgaagtggaggaagcagtgaagccagctgtgaagcaggagtgaagatcttggaaaacccgtcgcagaacctaagccaccctatagggtagtgttgttagtcgtgtgttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctccccttcgttttccctctcttcctctccaaacctttgcaacagatggctgacaatgagaaaggcaataaggtcagaagtcaggacattggtacctcaagctcccgagtgaatgaaacaccagacaccagttgtgtggcagtggtccaacacctgattaaccagaaccaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaacatcagagaagaaattccttccgaggtgcacaacagttgacagagcatcttttagctaatggaggtagagtgtctgatagtgaagattcagatcaagtctcctcagatgatgaagatgaaatggaacgtaaggcatgctctcgttggggagaagtcggtcatgttgccagcttgtgtgccactacctgctttcattgtgaggaagaccatccacccggtgaatgccccatgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaagatcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcctccatgcatcccgaagcagtcctatagcccgcgttgcaacagctccaattccaatgagtgcactaccacaaggtgtcgatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaaggagggcattactccaaaaactgtccccaaccaaggcaaaatcgacctccacattaccgccaatttacacgaagcagacattccaaccgtattgtggtcactggagcaaacgccgtacccgtaaggcctcgtgttaatcagaacccatagcagaaacaatgcaccaatgctcctcctgctgcacctgactcggcaataaaccatagcaaccactctctgcatcgacagcctcagcgaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctatcacatcatcaccgaaccaatcaaggatgcagtcactagaacaatgccagctatatctctccagaatcaaaatgagcagccatgtttgtggttttcagttcactacttatcatggtgtaatcgaaagtttgcagcaatcatgtaattcataaatataatcatgactgtaaacagtgagcttgctatgtttagagatgattcatgttgaggatacaatgtatcgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaatagccaacctgtggatggaaaagaaaaacaattaaactgtgttgggttaaaaagccaacgagacagtagttgaggataggagttcggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatatggcagaagaacaatttggatgccccccatctcgaggaagcactaaggatgatcatcggcaattaaaccctagtggtatagatacaaatagcaggcaatgtatttccctgaaggtagtcagtacagctttttgacgaaccacatcaaggtttcaccgaaaggcagcaagccaaaggacctcatcgtccccagaagcgtccgcaatccacattaaagaataccacctgatagagataggccgaaagatgattgataaaaagagattggcaaagatgttctctagcatgaaagaagtaggccgaaaggtgattgataaacagaaacatgttctgcatcgctcacggaagacccctgattgtaattgccccgcaacagtcaccttgtcattaagtaagcaagatgacctaggtaaaagtgtttctatgaaggcaaagagtgaaatcttccactcggtatcagatgctacacggagtgaaaagtgcaagtaccggttaccaggcaatgccatgacttgggagatgatccaatgggaaagaacacatcaaggttaaaggtgtaaaggaatacgttgaatgctaaatgatgacaacatgaagagaatagcggaaagtaaactgaacataaagtaagtgaatctgcgttgcttgttcgtgggagctattcccagttatgaatcaggtgatatgttcgaagatagtctacagaggtcagacaacgaagcttcagatttggcaggataacgattagacaataacaaatccagcagtaaagccatttgggaagacgtcaaagtatatcaagtaggataagttggctctcttgggaagcataattcaaaggtaaagttatcgacccttgcatcaaatagcagaagtagctatcacccggagaccagggaagctaatatgaggcagttggtggcgagttcgaagcaaatgacaagcatggtatcctagtaatgacaagcaggttacgacgcatgacatgaagttgataacttgtccgaggttgactccgaagatatgaatcatgagaagttctggaacggaagcatcactgcactaccgcaacctagtctgagtcagccaaaaggtgcaccctggtccaagtcaggtgaagagaagattccatccgcaacaggaggtcaagccaagcagttccgagtggtgaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgataaattcttcttggtctaaaaggagccctcanattttagtggaattgtagagcacagattatatttgggaagaataaacanaggtcgaaagattttataaaaagaaaacccctaaagaaagtcttttttcnccccttttccttctttggcccgcnttgnccaatttccttttcctctttnttctcttccgcgggccat

SEQ ID NO: 14 - DNA, 10140 bp, Oryza sativa
  unsure (1)..(10140): unsure at all n locations
ctttgcgggggaattagttcgccaaccaccaagtcactattgtagtattaattagccttagcatatcggcacgaaccgctagccataaatgactatttaagtctaagcatgaaatattatttgggttttaatataagatgactttattggtaattagacttagattgtagaattattgacaccgcaattagtgcgacaagtagcaattgactattgtagtattaattagacttagcatatacgcacgaaacacttagcatagatgactattttagtcttagcatgtaatattatttgagttctaatatgatattactttatttgtaattagacttagtatgtataattattgacaacggaattagtgcgacaagtagcaattgactattgtagtattaattagacttagcatatacgcatgaaacacttagcatagatgactattttagtcttagcatgtaatattatttgagttttaatataagattactttatttgtaattagacttagtatgtaattatttactagctagggttgtgtaatatacgtcacctagacttagcttatatcacgatttgtaattagacttagcacgtaaggttgtgtatggttgtaatgtacgacatttacacttagcatacatgacttagattgttaaaacataaatgtctcgtgacttagcagatgtttcttgtatgaacagatggctgaccgcgatgaggaacagatattgtacgatgcaatcgcggagggaagcagccagtactggaatgaagaagtgtcgcgacccaaatcgactctaaaattcatcctcgaaattgtgcaaagaataattaaaattaatgtgaaagcctccaacaattaaaatgtgcaaagataaaagtcaaatggggcttggaggatttttgtatatttcctaaaagcctaaaatgcttaaataaattttagtggaattttcagagcacaaataataattgaaaagaaataaacaaagttaaaaaggttttataaaaagaaaaccctaaaagaagtctgtttccccccccctttccctcttgggccggctcggcccattccctccctccctctctctcctctcccgcggcccatcggctccccgcgcgcgcgcgccgctgacaggcgggcccgcccgccactctcgctgacgggtgggacccacctgtcatccccctcctctcgccgcgcccgccgccagcgcccgtgccctagcgccgccgccgccgcgaatcccgccgctcccggccgctccgcgtgcaatcaagaggggggatttactccccgtaatcccctcccccgtttccccctcttttccctctctctctccctcggattcgctcggaatcaagcccgaaatcctcgccggcgtattcaatggcggccgaatcttccgcgcgcgattcctccctccccggccgctctttccttcccccggcgctatttaaaccctccccgagctccgcccttccgtttccgccgctcaccgctcgctctcgccgtcggaatcgtgctcgcaccgtgctcctctctctccgccgtcgccgccgagctccgttccgtcgccgccgtgcttcggttagccgccgccgccgctccgctcttcctcccgactcggcgacacctccctcggcatcgccgcatcgccgtcgaccccgtccgcgcctccacttcgcccgccgaccgccggagcaccgtcgtcatcgtcttcccgaaccgcgccgccgccttcttccgcttcggccgccattctcgtcgtcgtcgttgtcccggcgtgagccgaagaccgccgttcgccttccccctttcctcctctctctcgggtgccactccgccgcgccgttggtcgccggcggcgaccatcggggcgcgggtgcgcgccactcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtctgcgcgccctctcgctcggctgacgcaataaatgagtttttaattaaaagttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagatgaaacaaaacctcaactagtgggtactctattcatgggtccactagtatgaatttaggtagatgcttcgctgattaattagtcaacattaggtggttttataactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgggctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagacgtgtcttgtgggtaaagatgtacacctctgatcagagtaaatctattcgaatagccgagccctcggatatgggcaagccgagcaatgtacccaagtcagtgttataattcttaaaattttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtttagttctaggatcgtgtttacaaaatggccttgagcaactaaatgtctttaaatgctgtttactgcaaccctaacccctctatgttattattcctttgtactcccttgcatttattctgcatttgtgggtgtgtcttgttgagtacggtggttgtactcagtcttgcttaattttcccaagcccagatgaggagctccttgaagatgaaggctttggtgtctagctcgtgcctgccgtcaagcgcctgtggtcgtcgccctagtcttccgctgtttttcgttgtctttgtgtgtgctgggccttcgctgcccatgtaataattttatatacgcttccgcttgttaaactctgatttgtatcaacttttggtgtaccttgcctcctgggacaaggaataatacacgcacgtcaggaacgcctgttgggtgatttccggtcgtgacaagttggtatcagagcctcctttgaccctaggacgagccgtagatcccaagccttagcaatattttcaaaaataaaaatcctttattatttgtgaaaacccgctattctctctttgtcttgctgcttcatttatcgtcaaaatctgatcttttaaatgttgttttcccttttgtttttgtttgtagatggccggcagcgttacccgtcgtggtttgcacatgactggcttcgtcttggagctgcgaggcatgtgcgtggtcttggggtatccacatggagtggattaccaggccaggccgcttccggatcaggagggtgaggatgcagagcctcacgctggttgggaggtcactgcagtgatcctctccggctctcccgagcggacttcactggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgggacgccagctcggaggatgacgctaccgtcgtgcatctggcacgcatggtggaggcgtacgacgcggctcgtatcgacttccatcagatggtgcgtcgtggcatggtggagaacaacatgaagatcctggagctgcgtcaggagaacctgcagctcaagaaggacctcgacgcgttggaggcgcagctgcatcagctcaagatcgcccagggagagatctgccgccccaagcgtcgccgcgtctgccgcagccagaagatcaccgcccgcaagagcacctccaggcctgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcttgcgcgtgtgtttttcctcgtttgtcttcttgagtcgtgtggggcatggttacgccggtgtgtggtgtaactatgtcggagcctgtcttattttgtttgcctaagcaacttgaaccttaatgaaccaatttaatatcagtaataaatttaagaataatggtagtcgtgggtggttagttttaatcgtcagctctccttctctgtttgctggttctgtgtggggttttcagatggtgacgaccaggagaaatgttaacaccggtgaaggcaaccaacccgaaggcagcaaccccaacccccaaggcaatccacctccaccaccaccaccagacaccaacgccattctcacccaaatcctcgcccagcaagccaacatgatgaatgctttcctccaccacctccaaaacccgccacaacagaatgctccaccaccacctccccaacactccaaactcgccgaattcctccgcatccgcccacccaccttctctagctccaacaatccagtagatgcgttggattggttgcatgccgtggggaagaagctggacactgtgcagtgcagtgatgaagagaaagtcatcttcgccgcccatcagctgcagggacccgcatctctatggtgggaccatttccaggccacgcagccagagggacagcctattacttgggcccgcttcaccgccgctttccggagaacccatgtgcccgctggagtcgtggctcttaagaaaagggaattccgagagttgaagcaaggcaaccgctccgtgatggagtatttgcatgagttcaacaatctagcccgttatgccccggaggatgtgcgggaagatgaggagaagcaagagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctcgcagcagcagcaacagcagcagaatcagcaagggactcgtgcgccacgtcctcctacgccaactgtgcagcccgttcaaggccgcagggacgcttcaggtccgcagcggctgtgcttcaactgcttcgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttccccgttcattccatccccgctacaattttgttcgactctggagcttcccactcgtttatatctgtgccattcgtggaaaaaaatcagttgggggtagaaaggcttagaaaccctctgctcatcaccacccctggcggggttatgacggcaaagtattatagccctgccgttcctatagaaattcaggggattccttttccctcggatctgattctgttagacacaaagaacttggatgtgattcttgggatgaattggttggctcaattccaaggagtagtggattgcgcgaggcgcactgtcactctgtaccgaggaccagaacaaccggttgttttctttgcacctccaacctctgtcagaagttcagaactgcatcagataggtctgtcagaaatccccatagtcagagagttcggagacgtgtttccggaggaactacctggtatgccgcccaagcgagaaattgagttccggatagatcttgctccaggaaccactcctctgtacaagcgaccctaccgtatggcagcaaatgagctggccgaagttaagaaacagttggaagagttgaaagaaaaggggtacatacgtccgagtacttccccttggggtgcccctgtgatttttgtagaaaagaaagacaagacgaagaggatgtgcgttgactacagagctctcaatgaagttaccatcaaaaacaagtaccctcttccccggatagatgatttgttcgatcagcttaaaggtgccactgtattctccaagattgatcttcgttccggatatcatcaattacgtattcgtgaggaagacattccgaagaccgcattcactacgcgatatgggctgtatgaattcacggtgatgtcgttcggcttgaccaatgcacctgccttcttcatgaacttgatgaacaaagtgttcatggaatacttggataagttcgttgtggttttcatcgatgacattctgatatactcacaatcagaggaagaccatcagcaccatctccgtctggtgttgggaaagttacgggaacatcaattgtatgccaagcttagcaagtgtgagttctggttgtccgaagtcaaattcttggggcacgtgatatctgctaaaggagttgctgtggatcccgaaacagtgaccgccgtcaccgattggaagcaacccaagacagtcactcagattcgcagtttcttgggtttggcaggatactaccggagattcatcgagaacttctccaaaatcgctcgacccatgacacagttgttgaagaaagaagagaagtttgtgtggagcccgcaatgcgagaaggcgttccaaactctcaagcaaaagctggtttcctcgccagtgttaatcttgccggatacccgcaaggacttcatggtgtactgtgatgcttcgcgccaaggattggggtgcgtactcatgcaggacggtcatgtggtagcctatgcctcacgccagctacgacctcatgaaggcaactaccctacacatgacttggagctagcagcggtggttcatgctctaaaaatctggcggcactatctcattgggaatcgctgtgaaatatatactgatcacaagagcttgaaatacatcttcactcagtcggacctgaatcttcgacaaagaagatggttagaactcatcaaggattatgatgtgggaattcactatcatcctggcaaggctaacgtggttgccgacgctctaagtcgaaagagccattgcaatactctcaacgttcgtggcattccacccgaacttagtcaacagatggaagccctgaacctaaacatagttggtcgtggatttttggccgcgttggaagccaagcctaccttgctcgatcaaatccgcgaggctcagaagaatgatccggacatgcatggactcctcaagaatatgaaacagggtaaagccgcaggtttcacagagggtgaacacggaaccttatggaacggaaagcgggtatgcgttccagatagcagagaacttaaacagctgatacttcaggaagctcacgaaagtccttattccattcacccgggcagtaccaagatgtacttagatttgaaggagaaatactggtgggtcagcatgaagcgggaaattgcagagtttgtggctctatgtgatgtgtgccagcgtgtcaaggcagaacaccagcgaccggccggacttctccaacctctccaagtgccggaatggaaatgggatgaaattgggatggatttcatcaccggacttccaaaaacccaaggtggatatgattctatatgggtaatagtggatcgattaaccaaggtagctcgatttattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcgtatcacccgcagacagatggacagaccgagcgtctaaatcagatcttagaagatatgcttcgcgcatgtgtcctggacttcgggaagacttgggataagagtctcccctatgccgagttctcctacaataacagctatcaagccagcatacaaatggcaccctatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgacgccgtgatctggaattcgcagtggatgactttgtgtaccttcgagtcacgccattgcgaggtgtgcacaggtttcagacaaaagggaagctcgcacctcggtatgtgggtcccttccgtatcatcgctcgacgcggagaagttgcttaccagctggagttgcccgcctccttgggtaacgtgcatgatgtgttccatgtgtcgcaactcaagaaatgtctccgagtgccatccgagcaggccaactcagagcaaattgaagttcgcgaagatttgacctatgtggagaggccagtgaaaatcctggacaccatggagcgcaggaccaggaaccgggtaatccgtttttgcaaggtccagtggagcaatcacgccgaagaagaagctacttgggagcgcgaagacgagctgaaggcagcccatcccgatctcttcgccagttcttccgaatctcggggtcgagattccgtttaaggggggtaggtttgtcgcgacccaaatcgactctaaaattcatcctcgaaattgtgcaaagaataattaaaattaatgtgaaagcctccaacaattaaaatgtgcaaagataaaagtcaaatggggcttggaggatttttgtatatttcctaaaagcctaaaatgcttaaataaattttagtggaattttcagagcacaaataataattgaaaagaaataaacaaagttaaaaaggttttataaaaagaaaaccctaaaagaagtctgtttcccccccccctttccctcttgggccggctcggcccattccctccctccctctctctcctctcccgcggcccatcggnttcccgcgcgcgcgcgccgctgacaggcgggccccgccgccactcttcgttgacggtgggacccacctgtcattccccttcttttggcgngcccggcgcgggcccgtgccctagcgccgccgcgccgngattccggcgtttccggccgttt

SEQ ID NO: 15 - DNA, 2131 bp, Oryza sativa
ggagtttgtttaaacagctggggcgggttcgattttaataaggaggggtgacaattccaagggaatcgctgatgagaggagaaaacggcggggcgtttattgtgaaagcgacaaagggaaaacggtggtcatggtttgaaaaacaaaagggaaacctttttcgggtgggaagcaatttcgatagtcgtcgttgtccggggtaaaccgaagacgcccgttcccttaccccttttcttcctttcttcggggggcaacccaccggcgcggttggtcaccgcggcagaccatcggggcacgggtgcgcgccgctcctgtcgtccggtccggcgaggccgccttcgggcgcgccctcgcggttgccaagtgggggcggcagtcatccgcccgagcccgcgggtgcggccgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatggtattttttaattgaaaattaaatgaagaaattcgcaaatatccatttaaagagcatataatcttcaaatggccatatcttggccatttgaactcggaattggaccgttcaagtctctaatttttccttaagatgtaaagaacccatttttgtgctttgtttctgctgttatgtggagttatttagtgttaaagccttttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagaataaacaaaaccccaactagtggacactctattcatggttccactagtatgaatttaggtagatgcttcgctgattaattaggcaacattaggtggttttataactttagacttgggaaattctcatatcatttggacaccatggaatggttggcttatgttggaagtggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcggagggttggtgcccaatgctaggggctcagttctgtctgcctgtcccgggtattccggccgtaggtaggattgggtcggtactcttgtctaaggctaggatgggttggaaactatgtcacgtcttccgtccgtataccggggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttataattcttaaaattttgctcaacaactaaaatgtggaatggttggcctgggttggcttgggacgagctgggacccaagtcgggttggcaagtcggtctaaatcatcgtaggccttgggttaaggcaggttcgtgagggttcacggcctttgttaattatactgtgtagctccaggatcgtctttacaaaatgctttgggccactaagtgacttttaaatgctgttactggaaaactaatccctattatattatttcccttgaccctcctttgcataaaatatgcaatcggcgggtggcttgctgaatattggggtggactcattcttgctaaaccttttcccccctcaataagaagaagcttgtgagaaaga

SEQ ID NO: 16 - DNA, 41962 bp, Oryza sativa
  unsure (1)..(41962): unsure at all n locations
gactgggtgatcggctcgatgcaagtagnccatcacattngnggttgtgtgttgtttatcacagcggcngcactcagncttgcttaattttcccaagcccagatgaggagctccttgtagattttgctttggagnctagctcgtgcctgccgtcaagcgcctgtggtcgtcgccctagtcttccgctgtttttcgttgtctttgtgtgtgctgggccttcgctgcccatgtaataattttatatacgcttccgcttgttaaactctgatttgtatcaacttttggtgtaccttgcctcctgggacaaggaataatacacgcacgtcaggaacgcctgttgggtgatttccggtcgtgacaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatgtatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcaccgactcctcctcaggatcctgcaccgtctcctcctcatgctccgccagcaccgtctccacctcaggatcctgcaccgactcctcctcaggatcctgcaccgtctcctcctcatgctccgccagcaccgtctccacctcaggctccagcaccgactcgtcctcaggatcctgcaccgtctcctcctcgtgctcctacacctactcccccgcaagctcctcttccggcaccttcaaggtcaagggcccccccagctgcaccgcctgcccacacaagggcaacgaagaaggcgaaagttgacgccgcaaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggctatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagccgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcacacatatctacgaactataccagctggacgccgtcgacgtctctattatgagttgctggattttgtaagtatatcgttcagttagaattcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcacaatgctcgaccaatatccacaagaaacagaggacaatctcgttcatcttctgaaggcccagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggtttcgtcatttggtccgcggcaaatggagagaaagacttaggcggaagttcaaatttcctgtgagtacacatgctctacatttatatttctccgattcaaatacatacaagtgtatattaattagatctctcgttgcttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgttttattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatatatgtatgcatatatatgtattgaaacatatatatgcatggtttatatatatatatatatatatatataaaccatgcagcaacagagccatgaaaaaaaaaaaggtcagctcgatctttactcccggttatttcacccgggactaaagatagcgatctttagtcccggattggtactcccggtttggaaaccgggactaaatgggggttacgaaccgggactacaaagggtttctccaccagtgtgaattagcctattgactaggagacatacgtattagttatcaagaagttcatattttcggtttctctcatccaaaattttcaacaaggatgaaaatgagaaatctattatctattatattatattatattatattatattatattatattatatactaaaagtccattaaccttcctacaaacgctcccgagctgccatgtagcctcctacaaactctcataagccgccacatggcgttctaataaattagaaaaaaaagggtggacccactaattttgccaattaaatctccacctaaaagaaaaaagattcggtatccccaccaccgtacgcacgcacgtacacgtactcccctccacaccattcaaactctccgctattctcctactccttccgtttcacagtataagtcattttagcattctccatattcatatttatactaatgaatctagacatatatatatatatatctaaattcattagcatcaatattaatgtggaaaatgctagaatgacttacattgtgaaacggatgaagtatttttttagctaacttctcctattttatagctagcacttaatatataaaaaagataataatcgattatctaaatctacaaaattctcaagttacatattttttctcatttttttcaactgttgtgttatttatcaattaaatatcaaattcaagatctatattacccatattttgttatttaaaaattaaaaattagatcatgtgacctttatctaattattgagtttttatatgattttgtcagttaaaaaaatagaggaggtgaggagcgagaaggacaaataaatacgtacgtacatgcacatctcacgtacatgtctcacgtacatctcacgcctttttaatttttaagataattctaactatataaaataatggatctctcatctttaagttaaaatcgatagttagactttttttagaatttttatgattttatctgatttattatactgtcatatgatggtttagtagcgtttgtagaatcacacgtggagtgtatatgcttggcgctctaataaattatagaaatcctagaaaatcagaggaaaaaaaaacattcaaccttcaattttcacttaaattggtggatccgttattttaaaccgttggattagatctattaaaactcccacgctgttaatctccatcccgaaaaagaataacgtacgtacgtatcgtacgtacgatcatctcactttctcactttctggaaaaaaaaacttaattacctacgtcatatactatggagaaaaattgagagcagagctactagagccatacccaaatccttctgaagacttctcagactaagactcctattctattcctactccactagctttagaacactactaaattagagagagagctttgattcttcttgcttgaggtgtctcatggagtggaggatgagagggctttatatagccctccaatgatggttgtggcggttggaatggtcggaaatgccctccaaccatcattggggagtgatccaagccattcagaagaaaccctgcgtccaacggcacctgggagggttcggccgaaccatgggctggaccattctggccaatctttggcaggtggcctcctcttttgctcctttggcgatggcacccaaagaagggagggggagggcggtggaggcggcagcggctgcttcgggcacggcggcggcagggaggtcagcggctgcgactacggctctcggtatcggctcagggagggtggttgcgacgacggctcacaacgtcggctcagggagggggcgacaacgacacgggggagggagcagcggatccggcggctgtgttggcagggagagccggatccggcgcttgactccccaccggcggcggcggcgatgttgggaagggtggctctcggcgtcagctcagggagatggatctggagggctcggcggcgtgtctccttctccctctccctcctccaccgccgccagctgccgtcgccaccaccgccgcgggctgccgccagctcggggctagccggatttttgttaatgtgttgatttttgtgatgcttgaatgctcaggtgaatggaaattttttactgtaaattgttgatgtaaatttctgtggattttttagtgcttgggtaaatttctgtgaaatttttgaatggtggagtgttgacagaggcggatggagcggtgtcgctccgtctgtcgtttttttaaaacatggccagcattttgactggcggagtgaaaatgttttttcgctggtagccgtcttaagctannnnnnnnnnnnnnnnnnnnnnnnntgatggctagcttaagacggctagatcttgattttcactggcctttgctttgtggcggctctaaattcagccaacgaaatcccaaaatagccgccatgaaaaatggatttcgtaatagtgttccattcccttcttagtgaagtggacagcgttgacaaacttttgtatggctcttagtactacaagccttcacaagttgtccttcctctctttactgatccggaaacggttacgatgatgctgaaatactttcgcaaactattctttgatcctttagtgattagtatcataccagcaagttccgatgggaagctgatgacatgatagaccaactgcaacaggatattggtgatgatgataggatgatgacaaaggctaactccgacgatgtggaaaaatgtgattttctttttgttgtttccagcaagcttagagctagtgcatataccgatccactgattgggcgatgaacgatcaagccataacagggtcagggtagtaatccaatcaaattacacattacttcatctttttaattgttacactctctttctctctctctataggatagtcgtctttaaaattttgctcatatgcaacatggtgatttaatacagaatgaccatttaagcttctgcagcactttataaacgtaagcaaattttatgagcatctttcccatccttgaaaaggtctcacaaggtactatgaggtacgaggtaccattcatatccaactgtccattacaaagggtatgatgggaagtaaaatctcgacatcaaggtgggattcattcaacgtagcgctgctatggagcttgccatttgtgttgccgccgatctcattcctactcgcctccttccagattgctctgattcgttgagctcgtccaccgacctatcgagctcgcccgtcacgccgcccgtcgtgctcgagcttgtccgcctgtgcactcgagagtcgagcctgctcgtgcttggagctcctcctctgcggcttcgtgctgtcttgattccataatagcttggccaatgaatttaacctggccactgccgaagtgaccagcaagagagagttcattttaaatcaacaaggtagcccgcgcattcgcgtaagtatatatcgtagggctgtatttcaaacactataaagatgggatataagccagagaatatttgttgttaaaaaaaagaatgataaaataaatcatacatcactatatacaatgtaattaaggaaatgtaaattatctagcaataaaaaaagaaaaatatttaccgtaaaatagatggaatatactactaaatatgataagaataagaatatctctcatatttaaataaaaatctttttgtcgtggtcatatataaactcctctattgttcttgcttcaaaagctatgtgcatttttaataaaacaacattaataccactaaaataaattatacattattaatacactaaaaatcatctacaccgcttaacttggtgttcaccacttatttccacatctatgtataaatagtctaaacataccacttcaatcgaataatacaataacaccattaaaaatagacatgaatgtctctctaacggataaagttgactataattgccaaggctttcttatgtaatgccctggaacatcagtcccacatcgacgtagccgtaaccccaaagatcagcctatagcatcatttaacacttaatacactattggcacactcacaaatgattctattagttagtatgtccctttatatacattgcctacattagcctttcactgatgccacctgaactcaaccatatgtatacccttgcagtatttacgatagcatagtgaatactataccctgcattgaaggacggagagggacaacaaggaggaggtgatgaaaatagttataatttttgtcccctacttatttctgtgtagtatttttaacaaaatcgtagtttaaaggctatggacaacacataagtgctggacggccggctttgatgttttttttcttgattagtatttctttgattttactattgatatattagaatattcttctttatactactctggtattgtattactttccgagtatatgaataccaactttattatatatccaaattatattaattatgatgctagcttatctgggaaatgcaatggtgtgagcataatgatcatgtatacgatttctctatgtcatgacgatgatattaggatagtatttggtaatttaagcgtggtgtttagattgctggatatcgttatttggggttatatgctgcgaacatgtcgaggtgggccgctgatggtgacagctcagtacgggtattcctccgcgcatgtatataatcctaagttactttcctggggagggtactcatccgtatttagccctagttggatggtcatgacggattatcgtaagaaactcggcaatcaggagtggcttctcaagcaccacgagggcatttggaaagagggtattagctaaataatcatataactaggaagtatgtataatgtgtatgtatattagaagtataggaatagattctttctattttcgttccacttagcttagatgatttattatgagagtatgcaattctcttgctgtgtgtcactctaccctattcattatcttaaccccttcttagactttgattattacaagtaatatataaattattagtatagctctctctattataatcatcccacgggattaaataaatacgatacccttggaatactctcgggtgaaatactataatggtatattcgtgcgcttacagatgaaatcggtaaccataatataccacgagagtttctgcgccattgctgggaattatatttctagtaatatcgttaagaaacaccaatagggtcctcgacattcgtgcctccaattgtgtcacacataatggacaattcctgaagggaaactcaccagtgcggtgacgcatgaccaatgatgaagccgagccatccatctttgatgcaccaccaccaccaccaccaccgctgccgccgcttccagtgccacttgatagcccgccgcagccaccagctgccaccaaagccacagccgccaccttgggataggtttggatggggatttccggtgtgtgtggcgggagcgacgagtccgattgggtgtagttcaaccagccgcttctagcaccgattgcctgtcattgctaccaaccatctccaccactgccaccatcgccgcctaaggttagatttggggatttcgagtgtttgtggagggagcaacgagtctgacagggtctagttcaatcggacgtagttagggttacatggtgcgatgccaggggcacttccgtcatttcgaaattctctctcctctttttgcctggaaataataaaataatgcctcgggtatcctacgaccatttacacaagttatatgtggaatccaacgcagtgtcacgtttctgtgttgtcttccagccaattacatgattttagatgtccagtagcaaattctgcctacaaattttagctctggaaaacatgccagatgctaatagtatttgttaatttagacctatacttgtcaagcactcaaaaaaaatccatccaatgcatccatacatctaattcatctaaaattcatgcaaaattcatccactgcatccactgcatagcaatacaatgcaaaaaacatccactgcatagcaatatctaattcatgcaactatacaatgcaaaaaacatccactgcatccatacatctaattcatccaaaattcatgcaaaaatcatacactgcatccattgcatccacaatgcataaaaaaaacaagggagaggaagtgtacctgggaggaaaggaggccggtgggggcgggcttgacattggtcttgaggatctgagaggcggcggcgtggcaacggcggtcggcgaagcggccgcgacgtctgtcttgaggacttggcggagaggaagccggcggtggcggacttcgagaggaggccggcggcggcggtcttgggcgtggaggaggcgctggcggtcggggaggccggatcttgaaccgggaggcggcggcggtggtcggggaggccggatccatgagggctcgtggacgacgagggaggaggaggccgtggtcggtgaaccgggagggcgacggcggtgtcgaggaggacgaggcggcggtggcggcgtcgaggagaaggaggcggcggtggcagtcgggaggcgacggcttggaggaggaggaggaggcggcggcggtggatgtgagagggtgatagagtgagaggcggcgtcggcggtggatctgagagagtgagaggcagcggcggtggaggaggaggaggcaacggcggcgtcgaggaggaggaggcggcagcggcggtggatctgagagagtgagagagttagaggcggtggcggcggacagaacggataaggacccgtggatgaggattgactaagtaaaccctactcaatcctcatctctatcgggcagagtactatacccgatgcggatgacactcatccgtgacgggtgctatttctaagcctgatacggatgacactcatttatgatgggcattagtactaagcacgattgagatgattacatctctatcgagcatagtactaaagcccgtcatagataacttattaaaatagttttaaaattatgataagttataaaatcatttataatcacatataattaacaaatgtcttatttacatagtttaaaattcctagtaattttctaaagttcatataattaacaaatgccttcctcacatatagtttaaaattccttttaatttttaacaaatgtcttatttacatagtttaaaattcctattaattttttaaaatcatataattgacaattggctttctcacatatagtttaaaattcctaacaattttttaaaaccacataattaacaaatccatttcttcaaagagttttaaatcgtaattaactggaatggcatgaaacatatgcaattcattcattaaggctccaatacaaattaaatacatactgataccaatttggaaattacattactacaaagacttcatttacagtgatatgcctttcgaatggtttgaacgaacgtacaccacgttgcccaggcatgtgatgggccgtcagagatgagaggatatgtactagtgtttagacctatacttgtcaagcactcaaaaaaaattcttaggataactgaaaggcagcaaattaaataaactagccatttttctatagtactagttggatgcccgtgcgttgcaacgggtatatatacatttgaaaaatcatcacttaaacaatcgtaaatataaatcacatcatgtcacctactacctcgtggacaagattgttttcgtgaggcctctacttaacctctaatctagtaatctctaccaagcattgtgagccacggaggcatcgtggttgcacattattctatgagaaaatccatgaaattccattgacaagcaccctaattccagaaatgccatcgacaaagacaacttcgcagaaacgccattgcacaagcctctttctcccaaaaataccatcacaccgtaactactgttaactcctctccgttaagttgtatgaaaagacaatcttacccctaggcatccatttgctcacacaatattattttgcattcatgtatatttctacccacatctaaattcatagacatctaaattcaccccctgagctcgattgtgaatcatgggtacctaaaatttctaagtaaagcacacagaaacaacaaggacagcaagaaacagcaagcacatagaaaagcacatggaaattaccctcctcgccggcgcctgtgggactctactcgacggcgcctacagcccccgcgctgcagcctgcgaccgctgtgaaccacatcggcgcgtcctgttgcgctgctgccgcgggcctcccctaccgcaccacccccgtgggccgctggcatagcggtgccgccgccatggaccactgccgagctgagcggcgtgatgggcgtgcaacactgcaaaaaggcacgatggtcaactcgagcaacatgacggcgactggtggggacgtagtttttatcctcacgcagggatgtgttggagatccgggatgcatttagtggagctggaagcaatacacgcacggtatatccctaaggccttgttaagtttagaggggattgaagaggattttattccctctcaatccaaaatcctcttcaatcctctccaaaccaaacaaagcctcaaggggattaatcaaacaagaccccagtgagtctggaccccccccccggccccccaccacccgcaccccaccatgtactcagcgtatccccatcctccccccttggagtcccatttggtcttccgccaaccccaatctcgttagccgcatccgcaacggagtggagcctggtgtttttattggacggggcgacctgcctgccccgcgttgtgctatggatcaactatcagcagcggggacatacaacgagctttagcccccaagacggccgtcgccggtgaagggacgccactgcaccgcagagttttcattcacggttcacggagcttcttctgcgatgcagctatggtccatccatcggcgggaggtcaactcaattgttctgctcaatatctccatcgcaattcaagaagattacagaaataagatccaagagcagagcgtttcgaaaatgcaagtcgcagagagctgatgttgtattgactttcctgtttagacgtactgtcgaaacagggatttgtcagtattaatttcagctactgatttcactttgtcttgtaccattattaactcgttaattctctcaacagcacattgcagagaaagctatcagcggtgaactgttagtctgcgattgtgatgcttgtattataattcgtaatcctattactggatgcttcattctttcttgtggtgaatgatactgctacttggccgcactatttcgtgaaatgtgttagatggatctccctccccttgagcccaacggctcaagggggccttgacccgcgccctaatcgggggcgcccagcccaatggctggtgggcccccgtcacactgtgccatataaagaggggtggaggacgggacgggataacatgacacaaggaacgaggttcgtcgccgccgccactccaccccacaaaccctaaccgatcgagggggcacagccagtgacgggaagtccaccgccgcgccacgcctcgtcgtcgacaccgtcgctgccgcaaccgcatcaccgccatcggcaccgagcacaccgtcgccgccgtccacgtcaagcccgcgacgacaacgacgatggccggccggacttcctcctcctcaacaacgactggtcacatccctaaaccctctcactccctctttgttcattcatctattgttgttcatccatcgcaaatagaaccacccgactagatctaaacctaggtgatccaatagacaaccctaacaatggtatcagagccaccctagagtttagattggttggggaaagaaatccaaaagaaaggcaaagaaaagcaaacgatccaacggatcgaaaagatcgaatccctaaccctaatcttacctcgtcgccggccgtcgttgacgccggccacggagggggagaggggcaaagaggcaccgccgaggagccactcgacagccgcgcgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggtttcggcgacggcgacgccgctccgtgcaaccgcaagagaaagaagagaagaggagctagggtttcggcgccggcggccggaggcggttttgtttgcccgatccgcccgcgcgaccgtccgatcgaaaccctagcaatcggacggccgacggcggccggaccgaaatcggcccatgtgggagcgcacggcaagccactttcccggcccaggcccaggttgcggcctggcgaaaggggagggggcgcccgcccgcgcgcaaggcggccgtgggccgaccggcaaaggccgaaaaagttcattttaggtccctcggggccgaatcaaaagaaaggaagttcattctaagtccctgtttcagaagcatttacaattatagttgttaattgtgtttatttctaagcaatttgaaccaacgtgaaaattgtttagagaatagataaatgtgagaaatgcttctgaacatgtactttgtatattttcatgcaaattacaatagaattttgaattgtttttacatgttttacctctgtttaaatttgaaccaacgggagaattttacagagagtaaataacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaagcagcttgttacagagaggtaccatggaggtggtgtaaaagaccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcttgacttcctgacagtgatcatggcaaagaaaggtgagaacattattacatttgtaaagaatctcattatgattggttattctagatccacatggtggatttattctggagcaactattcatgtgtgtaattgtttaaagggattccgttccatgaggactacgcaaagaagtgaaagatccattagagttgccaatggagttgaagcaaaagttgaggctgttggagatcttcgcctagaactcgcgaatggcttcacacttttacttccagacgtttttatgtcccttctttgcaaagaaacttgataataagtgtatccaaattggattttgagagatatgattgccattttggaaatggcaaatgtgaactatggtataataatgaatgtattggtcttatgttgcaagatcagttttatttgttatctctttctgagaatgtgaatgttgtgtcctcgttgacaaaagaaaagaaagcgaactcctgatgtctcatcgaaattatggcactgttgtttaggccatatttcgagggggagaattgagagactggttaagaatgtaattcttcctccattggagttctcagttttagaacaatgcatacaatgtatagaatgcatcggtgcccaaaacaccgtatgagctatggatcctccgtgtgtgggggagtcctgcaaaggataaagtatttaacccaaaacagtaagctgccattttattggctattctgaaagatcaaagggtcatcgtttctactgtccaaacagttatacaaagtttgtagaaacaagatacgccgtcttcttggaagacgaaatgattagggggagctcggtaattcgagaaattgatcttgaggagaggcgggtgtctgtactcgctccgtcgactcaggaactttccttctctttacctgctaatgttgtgccagcaatgcatgccgttgcggtaccaacacctgttgttatctctcatgtagcaacaatgaatgaaagtgaggaacctgttctacaggattcaacagaaattgttgccacatcagaggaggagctgcaacagcctcaaacagataatgtgcctgaataggaggcccctagaaggcctgaaagagtcgcatatggaggatgatcccatctcatatgaagaggccatgagaagccatgaaagatgaaatgaaatcaatgatgtctgggatttagaagaaattcctaaaggagccaaaacagtaggctgtaaatgggtctacaaaaccaaatatgactctagagggaatatagaaaagtttaaagtgcgactcgtggcaaaagttttcacgcaaagagaagagattacaatgagacattttctccagtctcttgtaaagattcctttaggattataatggcactagtggcacattatgatttggaattacatcacatggatgtaaaaacgacatttctaaatggagatttggaggaaaaagtatacatggcgcaaccgaaaggttttgtcatgaaaggaaacaaaaatatgggatgccgtataaagagatccatttatgggttaaagcaaagcttcaagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactacaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtatgcgcaagtgtgcacacgacctgacttggcatttgttaccgggttatttggcagatttcaaagtaatcctggcctagagcactggaaattggtatagaaagtcttgcgtgattgcaaggaacaaaaggcctcatgatgtcttacagaaaagcagaatcgctccagatagtgggatatttggattctgactttgcaaaagataatacaaagttaacatcgggatacatgtttaccctggcagtaggagctatttcatggaaaagctcaaaacagtctaccactgcagggtctaccatgtatgccgagtttatagcatgccatgaggctatggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatatgtttctgaatagagatgtgtatagtggctgtcgaatccatcggtaattaaccgtgacgatgaaacatgctctatatgtaaatctgtgatggaatagaaaaagctaaaggaaatagtgagataaagggggagaatgttagatggatctccctccccttgagcccaacggctcaagggggccttgacccgcgccctgatcgggggcgcccagcccaatggctggtgggcccccgtcacactgtgccatataaagaggggtggaggacgggacgggataacatgacacaaggaacgaggttcgtcgccgccgccactccaccccacaaaccctaaccgatcgagggggcacagccagtgacgggaagtccaccgccgcgccacgcctcgtcgtcgacaccgtcgctgccgcaaccgcatcaccgccatcggcaccgagcacaccgtcgccgccgtccacgtcaagcccgcgacgacaacgacgatggccggccggacttcctcctcctcaacaacgactggtcacatccctaaaccctctcactccctctttgttcattcatctattgttgttcatccatcgcaaatagaaccacccgactagatctaaacctaggtgatccaatagacaaccctaacaaaatgtacatgttctgaagtagtatgatcaatatcaagcaatccagaaccgaaaatcaacaactaaaaattgctttgatcaaagatagcttccgctatttttagaagaattgaggatttggagcaaagcacggttttcctcaagcccatttcgctcattcactttacgaattgagcagatctatatcattccagctacgccttgcctcacaaactttttttttcatttttaatctcgcgtaagatttaattatccatggtcgctgaaagagatgattctgatgaaggaatcctccctgccggcaccacccccgctgccgccgacgctcgccgtggacgtgtccgtcgtagtgggcctgctcacggccgtcctcctcgcgctagctcttcttcttcctcatctacgccaagcactgcaagcaccgtggcctgggcgtggcgcgcggtgtcgctgtgctgggcctcgggttccagccgtcgtcgtctttgtgcaagcggtgccgctccggcctgagcagctgtgccgtgggagcactccggtgtcccggttcggcgacatgggcgacgctgcgcggcacggcgagggaccaggtgaccgaatgcgccgtgtgccacggcgcgttcgacaccgccgagctgctccgcgtcctgtcccggtgccagcatgcgttccacccaggctgcatcgacgtgtggctgatgacgcactccgcgtgcccggtgtgccgccgcagtgccgctgatggtgcactccgtgtgcccggtgatagggaatcaacgtttcctagctatgtatcggcgtcaaagggggaggagcgctgcgacatgcgcagatggaagcgtgcatcgcggacacgagcggttgcgtgagcgtggatggaggcgcagccgtgtaggggtgggtggatgcgcgatgcgagcgcggatggatggggagtgggctggtgcgttgatcttgcgggaggatcctgggagagctctcagccattagattgtttaggactcaccaccgccactacgaattttttaagtagtaaagataccggaggttaaaagatgacggcaactcagctactatacgagtaaaagttcacctcctattcactttacgtgacatggaagcatatatgaatataattggaaattagatctacagtataattcaatgtcgaattataaaaataaataacttgcaaagaaaaccaacaatacagtttgattcaactccatgtagtcaagaaatatcaacttccaaacaaaaatctctttgtttttccaccatgcgtgcaagttgttttagaagcacgcaacacaagacttggtactccgatttatatatgtatgtctactaagttacaaaccacaccatgaattcaagtcattatctaaagaaaactttaggttcaagtaccaaacgaaaactgaagatcaggtctgaattccaatacgcattcaagggtacacctcaattattgatagaaaacctaatattggcatgattttgtaggcactaaatccagctttggaaaatatactttcccattctttctcctctctctcaaccccatctatgtacatcatgtagagatcaaacaacgcttgtgtctctttgaagatgtggggacacccgataaagtcatggtgtcccacgaatacgtatctgcccaggatgttcagttacgcatgaaatgatataaaagcataaacttcgtttatacaatacttaagtcacttagttcacaacacaacataaatacaaaccattacatatatggcctataaagccttatttctaaaaacagataaactgctagacttcaccacaggaactgcctgagcgtaggatgacctagaaaccatagttgtcccactctaacagatcaacaggtcctccacatgcatcttcctcttcatgatctgaacccatttatgagtacaaatggtactcagcaagacatgcttatgataataaatacaataattgcaatatacaacatgtagtattgagaactggaaggattataccctaaccttaacagttatttcatttcatagagcctatcttaataagcatttgttataaacactattgaacatttaatttaaacaataataacgagcataaaagtatgaatgttacttataaataacatgaatagaacattaaataataaataagttaaccatattaattaatagccatttagtttaacttgtgcccataatctggaatcacccatagacacatctccattaaccgggagcatggcgtattcgaatactcaacgactctgcagcgtctgcccagctttacccacacgatacccacagctggcagggctgaaaagtaacaaggtgtaatattgctccatatatctctcccttctgtctagtaagttaaaggatgctcgagatgttgcttggagtgatccagtccaaggtgtgtaccaacctacctccgcatccacttaccattgttcgttactcgatgggcagctcagaacttcatggacccaaagggtagttctgaactctcggggcccatcgagcccacatatataaatcatataaacatggaccatgtcactttgcttcacacacttgaaagctaatggccagtacaccgaaaggcctgcagaagtttaatcaattggagcaatatacggctagattcgataactcgatcgtgtggatgggcgaaactatgtcattcttattgacacaaggggggttgattattatatcaattttaaataagaaataaccataaatatatccatatattcaacacgaccataaacaggtccataaaaccaaacactctatcatgtgtaccacccgcttacatgcggtgtcaacaattctcagcatatagccataaatagttctataagcatgctttcatatgcagtaataatatccataataaatcaatagtatgttaaataattaacagtttgtttaagtgtttatcaaattttatcctaagtttgttagactctaaggcttattaaggtatttataaaaacaacagaaaaatataatgcaataatagcaatataattaacttgaaagaattcgtgcagtctatcgtactccaaaggacaagtacgctactaaaataactcgctatctactgggattaaattgttcaagggagggtgcatgtcttgcaaccttcgggctcgatgtagtcgtacaaaccgtctcctactggcgcggagatttcactcgctccgaataccggaccaacgtcagcgttttctatttatgcaaccatcatcatcacaataaataatagaaaaacaaagataaccaaaagaaatagtatcacaaagtgcaacaatgggtgaaaaggatttaaagaaataattttagggatttatggaatttcggagaacggcgaaccctagggctaaaattagggtcgcggcaacgggtgctcggattgcaacgaaactgatactgatggattcggaataattctaagagtttggaataggtctcggattttgtttttgaggtcaaacaatggtcaacctgatagaataagaaaaaggatttttctgatttatttttcaataggaaaattggatttgctgttcttctcgttctgcacaggaactggccagaatcccacattgccggcggcagaggaggccggttttggacaagggggcgccggttttgtgatctagggctcgaggcgattccgtttttgtggtcggctgcgagaaaagcgctggcggtgaggctggcggcggcgggcagtaacaggaggcggaggcggccatggtggcggcaactccggcgaactccggttcgggaggcggcctggtgaggttcaatgaggcgagaggagtcccagggtggtgacggccaaagctagcgggccctggagcggtggcgcaccatgcggctggcggcggccgaacagagaggcgacgccgagaggcggtgccggcgatgttccgacgatagattggatgggtaaagagaggggaaagggagtactcggcatggggaatccgattttaccttcaatttcagaggatcggcgatgtatgcgacgagtttcggagctcaatcaatgacgccggtattagggcttcggggatttttcctccggtgacgacgattgagttaacgggagtaggggcggatttgaggaggtgaaagaggttgaaattgcgcttcttttgcctccggtcttgagcgttctagtggagggacgaaggaaatacggaggctggaagctggaggtgtcgcggcggcattcgttcgtcgttcatcctcgtgagagctcgtgcgggcgtgtggcgtgcgaggggcggcacgagctgggcgcgagcacgacgcgaggcggcacagggttggcacgaggcagctcgagcgcggcttgcatcgggctggctcagcctagcttggcctagccatgtagagaaaagaagaaaatatggggaagattaaaatagttaggatttgaattgatgtggaatttagatggtccgacattcgggatagatttaaatcttattcaaaggaattatttgaggaatgatatgcactttgcgacaaaattaaacgagaaaagaaacatcgaaaacaaacatggaaaatagtattttaaatgaactactaacttgacggttatttttttagaagatcaaagcaaactaaatcggttttaaaaagttgtcaaattttagggctgttacagaagatgtccctctgcgagcctgatccaaccactatgtttatgattatcacctttcctccagcatctctagtaggtattgcatctttgcaccgtcgaagtatcttgacacaatcgtcatcaccaaaacaatgcaagacatactgaaacataaacatttagaagtataaaataaaagaagtttggaggctaactagatagctaaattgaagggaaaatgcatctctaaaaccctcgaactattataaattgtctagtcaaacctatgaagtttgtttttattaagccagatctgttaggtgtattcattatggctaatgcgccagcctggccgctcggcagaatccgtttagattccccgccgggcccacaaccacagcttgggaagtcgtgaggcgccacgtcagactgtcctcaagaggccaatgtctgacgtggtgccgggggctactgtcggagatatgggctcgggggtatgtgaagtgaggggaatttaccttcccatcctgccgcgtggccctacagcttggccctacccccgcacctcgcggatcgcagaagcagccgggaggcctcgaggtgccacgtcatgcccctcgggccctcgcgccaccttgccccgaggccctcgcccaactgccatgtggcggggggagcgagcggggaggggacccaggctgaaccgctatcaatgcgcgaggcgccccaactgcccctcgccgcatttcatgcggcaggggcagacgtgcggtgccacccgactgacgcacggcagtcaggaatgaccggtctgtgaccggcctgtcaccggtcatgaccgattggacgggcggccgtgcccccacgtcgcctctgtatccggcggagtggaggtaggtatgacccatcccatcggagtgtcattcggagctccctccacgaaaggacgaccaccacaagtcttcacccatttatgagggaatgacaaggttgtcccccgtgtcaggcggggggcggcgctgggtcccgctcaaggacaagttacggcttagcttccgggcgaagggatagatcgtgatccggtcaaggtagggtgggttcccaccctgtagaagagtaggtagaggcggtgcatgtggtatccccttgagctataaaaggaggatcttgcccaccgagaaaggggacgactctcagcagacctgagctctaggagaagagaagcgggaacgctcaccgaaatttaggaaccctagtaactctcaaccttaatcccacacacaggagtagggtattacgctccatagcggcccgaacctgtataatcctctcacccacacgcgactagcaacactcagggaggatacgcgatctctagaggcgagccctttccctcgaccgaactcacaaaagggggatctcacgatctcccgctagagaggatcactcctcgacaatgccgccacaatctactccaaatttctcaagtatcaagtttgagatttaatctacatgtccaggagtttagagttatcaaccaatcagctcagttttgacgagttggacaacagcatatactttcctctaagtgaagcatctacaacagctatagcaccaagttctactgccatcttcataaattaagatgcgttgcatcaatcttcgtcacacacatgccaacattaagaaaatacttgagcatggatttcttctcaacagtttgatggattattgtcactgacaacatcaccagcacctctacttcatcggccctgatatctctgccattgctaaggggtgactacgtccttgccattggttgcttttgtcatcaccgactttcatcgccgacttgttatttcgtcttcacggttggcctactacgcaactgccgatagaggacctcatcgttatcattgactactacactgctattgactggatcaacgacaccgtcatcttcatcaaaccatgcctcttcggctatgcctactctgctgccgttgatgcgcaacttcgtcatcataaccggctatctctgttgccgccaattgtcattatcgccgattgcatccaccatcgctgattgttttatgcttttgcgtgattgatggatttcgccattgccattgatgagcgtccacgtcttcaccaccggcttgcctccgccgccacccatgatttattcgttttcactactggcttattatgcttctactgatgggtgtctttgtcttcttcaccgggcacctcgtctgttatcgactgattatctcgctgccatgactgcacaactttgtcgccattgctgtgcgccttcgtcttcactgctagctgacttgtctgctgccgactggtttcttcgcctccatggctatgcggcttcatcacctttgattggtgtcattgtctttaccaccaccaacatcttcgtcagctttgatgggtgatatcattttcatgttggtcattttgtctctatgccgactgcgtcagctaccatcaatggacaattgtgactacaacagaaggataagctacatgcttaggggctcatcaacacaagcatgaggattatattttcaatttggacttgttcaggatacattcaacatggattcatggtcatgagtcgatttctcaagctcaacgattggactattcattattccccacgagggccatcagctgagtgcttgcgccagtcgggattcaattatcacatctacttttgtattctccatgagggataattactcggatgagaagccactcaaatgagatacgcttgatctacatcaccgaggatatttatcactcaggatcatattaattggcgtattttatacgtcatattttaagggtatcggtagacatactttaggtctaggcctaatatgtctgtaatccatattttcaggtgtggcctgtcacgttcttttagggacttaggcatctttttgcttaggcaaaagtgcgagtgatcgagtgcccaataccttaaaatccttttataccacagttactcaactttttaggagttggtacaatgcattttaaaaggtgccgaacagtgaagctttatatggctgccccgctgactttttatatagtcaaggcactgtttggttttataaaacaattgattggatacaatatcgttgctttttgccgcgtaagtgtgcattttttattgaccaatattatggcttgggctgatcatatattatggtcatttttcaggcgattggtaaatcatttatgagtttatttactcggatgttacaccacatatgccatatatttccagatgtggtgaaaccatgtatcttttagggactcaagcacatttattaaagcagtgtgtgcatggtgtatgcccaaaaactttggaaatttatttattcacaacatacaagcttctttatagttgttttgctatgtgaattttcaatgatatagtcaactttagattgtacgcatcatattttacaaagcagtcggtatatcacttggatcatgttattcggggattcacactgcacatgctacatattaatatcaagtcaaatggttgactacaattatcaaatccattcggttggttggattatttactccttgactatatgtttagtttgttcaactaatcacatagtcggggggctccacctattaggtgcatctagtcgatgcacctaagtctacatttaattatttttcagccctccacagtcttcagatttagtaaagttactagggagaccacggtgaagatgattgaagcactcggctttggagtaatctagttcgagagaagattatcttttcgattgggaaggtctcaggggctactgtggagattataggtaccccatacccacacagtatggttatctgactagttataggggatagcttatacctatggaatatgtaacggatcatgacttaggtattccgtttctttgtatattacggaacggcttaaagtcctggtttgataatattgcaaattagatttaggaaaccgataccgtattggttaaggtttctatcttgtaatcctgccctccatcctatataaggtgggcaggaggcctctaggggcagatattcataccccagatcgtcagatcaatacacacccagcggattcaaatcctcaaataagagtagggtactacctctcatcgagatagcctgaacctgtctaaatcctttgtctctgcatccatccatatttaggtctcatgcgctaccccctttatagtgctgaaatattgtttcgacatgtaatccattatcaaaaaaattctcaagttcttgcagtagatcacacatcgcacccccaccaccaagtttttctattactacggactacaactacgcaaattagtgactaacaacagaggacgagttcaagcgtgatcaagaggtgcttatacctttatctcttcatcctggggtacttgttaggaatagtcccacattacttatttaaggggagttaaaccaacttaaaagtaggagagcccctcaccactcgagttagattttgagatattgtaagacttcttcctgattgggccaatgtctcccggtttgggccaacaagtgggtatcaaagccaatctctagttcttgtgcacactcagcgtggtgtaagcccaaaatctagtggaccgcgggtgtgtcctgtatgtgcccatgtgtggggccggtctctattgcttgtgcacagtcagcgtggtgtaagcccaaagcctagtggaccgcgggtgtgagtcccgtatgtgcccgtgtgtggggccggtctctagtgcttgtgcacactcagtgtggtgtaagcccaaagcctagtggaccgcgggtgtgagtcccgtatgtacccgtgtgtggggtcgatcagtgctaagcggcaccaatgtgtgacgggggagattgttaggaatagtcccacattgattatttagaagaagttaaatcaacttaaaagtgagggagctcctcacctctcgagctagcatttgggggtgtagaaaggtttggggccaacagaactgtcctttccttcttcgcgatcctccggaaagtcaaactctgcacaaaagcaatccaacaatcagattataatctccaaatgaattaagaagcaagcggccaccaacagaccaactcaccaaccccggacaatcggaagatggaagttgtttattagagcgaggcgagatcggttcaaacactgcagttgtagtactttgttaattgattcgtggttatcaaatggttattaccggtccactgcccgaaatcatcacgcgattagattctcacgaggacgcaagagctatagataattggataaagtattagcaagtgacggttatatttaagcttgtgcgcgcgcgcaaggaaagcagcgggatggacattggcccaagatgctacagatcggaactatcgcagcaccgtcctcatcgccgcatccttcctaaatttatcaccatataataaaatttaaaacttcttaaattaatcatcataagcatgatgttttaatcgatacgtgcatcgcagcaccatcctcatcgccgcatccttcccaaatttataatcatataataaaatttaaaatttcttaaattaatcatcataattagcatgatgttttaatcgatacgtgcattgtgagagaatttatgcatggtgtattgattgatgtgacttaaattatcattggtcttggtgcataaatatatatatgatgattattttgagaataagagagtagttgggaactaacgtgcagtgcacgtaaaacggagcgactcattagtgcataattaattaagtattagctatttttaaaaaaatagattaaaatgatttttaaagtaactttcgtgtagaattttttaaaacacacactgtttaatagtttgagaagtgtgtgcgtgaaaaacgagagagtgagagaaagttaggaacttgcagcaacaaacgcgcgtaaatcagtagccattcactagtgcacatggttggcgctacatactgacactgccctcattggcttggatcttcctatgtcacgatttcctttattttatatgcttactctaccgctgtcaactaattaagtaattttacagttcctgtggcgttaccaaaaaaatacaatattttaaataatttttatgtaaaatttagttcctcttgatatctctggaatgaaaatttacattgaaagttttaatacctcttggtacctctcagtgattataaaatttctccaactaattactatatcccttcctgtttgctattatattagtgtcctctgctaatcaatttcccatgtttctcctatcgagtccaccaaagtctattacatctctcttttagtttgttgaggtcacctaggtttgcaacttccccaactccacgttggagttagcctttgtcatcatcctatcatcatcaccaacgtgccatcgcggttggtctatcatgtcatcagcttcccatcggaactagcaggtatcttcctcaatcactgaaggatcgaataacaatttgtgaaggtatttcagcatcattgtaactgtttccagatcagtggagagccgaaggataacttctgaaggcttatagtactaagagccatacaaaagtttatgaacactctcgagtccacttcactaagaacgtgatggaacttctcttcttcatcatcaaagagttgcatacttcaatgacatcacatcaagcaaagacattggatttatcttataatgtattgttaatatagagttcaaccttcaaatgaatgtatttagtatttagttgtacctttcaaatgcaatgttattacatacatgttgcatttgagtggagtgctaagcatattagttttagacatttcacgtcaattgtacatattttatatgcttattggaccttatcaatagcaacccaaagtccctctcttctttcccaaaattgacgcagaagaggctcatttgacaagtgcaacgggatgctgaagaaattttagtgagaagcaaatgcatggtggtgtctcatagtccaaatatttgcactaaaaattatgggatatatgttggtcaggctgcagtgttctctgaggatcacaaatatgaaaatttttttgatgggactcttgattcacgtatagatttcaatagaactacttccttggttttcctaggttttgagcagtgataaaaaaaatcattttcattataaacttgaaaatggaggcagttcattttggcgatttttcagaaattatttttaaacgtgatatccacagtaatttattttgatccaaaaatttccagaagtttgcacagataaattatatccaacattgtttatgtctgccacaatatggaatttaaactttatgtttttatttttatttctttgaaggcgctataaaattctttaatggacagtttcattatttgagtattaggatatgctgtcacatgcacaatatgtttgtgcaatcatgctgttattaccaatttggcaaaatttgctacaggatatcgaaaaatcatgtaattgactgggagataccacaaaagttgtgtaattggttgtaggacacccgaaataatattttattattttcgggtaaaaagaggtgagaaaattttcaaaatgacggaagtgcccccggcgtcgcaccatgtatccagacttttggctgtcctccaacaccctcccccccccctttgctcccaaagaaacacccgaaatccccaaagctaaccctaggcggcgacagggtggaggcggtttgtggtgacgtcaggcgaatggcgctgaaagtggcctgttgaactagactcgacaacgatggcgatggagctgtgatttttgtcagcgggcaagcagcactggggatgatgtcactgaggaagaagtgagatgggaggaaagcgtcgctacgtctaacgagcacggaggttccaatgaagccattggacatgtattgggatcctaatggtaagtctcagtgcttttttgttacaatttaggattgaattgtatgatttttttagggttttttcacgtaggatggacgctagctcaacttgcagcgttgttgtttaggttggttcatatgttcagtttgatgagaacggtagaccagattttcatgtgtcttgtgaaattagttgggtactagacaaggataccatttgttgcaatgaccttatgaatgattttaatgacgaggtcaaacgtagttctcaacaacagataacaataactttttgggacaaaaatactaagaggtatgtgcagagatagttctttgcgctgcttgatacatttgatatgtactgggagatgaggaggctcactttggttgttgatatgagtgatgacctacgaaataggaccaagccttgtatggaacagggcaacatgaaaattttgcacaaacgatgtttgcaaagccaaatttcattgcataaactcatatgttcacgattagggtacttcacaaacttcattgtttgggttctttggggtcctcaatgttcgcgctaccagttgtgtcacacacaatggacaattccccaagggcactcaccagtgcggtgacgcacgaccaaagatgaagccgagccatccatctttgatgcaccaccatcgtcgccacttccagcgccgctcgatcgcccggcacagccaccaccagccatcaccgaagccaccaccgccacctagagttaggtttggatagggacttcgggtgtgtgaggggagggggggagcgacaagtccaactcagtctaattcaaccggcagcttccagcgccgctcacccgccattgccaccaaccacctccaccatcatcatcgccggctaagtttaggtttggggatttctagtgtttgtgggagaagcgacgagtttgactgggtctagttcatctggaactagtcggggttaaatggtgtgacgccaatggcactttcgtcattttgaaatttctctctcctcttttttcctggaaataataaaatattgtctcggatatcctacagccaattatacaacttttatagtgtccatcggcagtgtcacgttctttacggtgtctcccagccaattacacgatttttggatatcctatagcaaattctgcctaccaattttagctctggaaagcatgccagatgctagtagtatttttctacgcctatacttgtcaagcactaaaaaaaattcttgggttatttaaaaggcaaccaagtaaactagccatttttctgtagtataccagagcttaaaagatgacggcaactcgatctactgtacgagtaaaagttcacctcctattcattttacatgacatggaagtatgaatataatgggaaattagatctacaatagaattcaattcgaattataaaaataaataacttgcaaagaaaaccaacaatataggttgcttcaactccatgtagtcaagaaatatcaacttccaaactaaaatctctttattttccatcatgcgggcacgttgttttagaagcacaacacaagactttggtactcgcggtagcatcttgaatgggaagacttatgtatgtctactaagttacaaatcacaccataaattcaagtcattatctaaagaaaactttaggttcacgtaccaaacgaaaactgaagatcaggtctgaactccaatacgtattcaagggtacacctcaattattgatagaaaacctaatattggcatgattttgtaggcactaaatccagctttggaaaatatattttcccattctttttcctctctctcaaccccatctatgtacatcatgtagagatcaaacaatacttgcgtctctttgaagatgtccctctgtgagcctgatccaatcaccatatttatgattatcacctttcctccagcatctctcgcaggtattgcttccttgcaccgtctaagtatcttgacacaatcatcatcaccaaaacaatgcaagacatactgaaacataaatatttagaagtataaaataaaagaagtttggaggctaactagatagctaacttgaagggaaaatgcatctctaaaaccctcgaactattataaattgtctagtcaaacctatgaagtttgtttttattaagccagatctgttaggtgcattcatctttgtacaaggtcttgaagttcatgtttgtttatttaagccttgcaaatatcttatttattatatattagtcaaattaattggtgtgaatatcttgttttttgtaaggaaatacttgaccttcaaccctggataattactcactttattgactcttcaaaagttgtgttttggtatagtatttatctttgctaattggaggctactcttgaacatttatcgatccttattaatcatagagatgaaaacattggggatttcacatattaattagaatactatatagtgcgaagactggattgagtatatgatcgaaatcgtggcaatatatagttgttaccatgataattgcactaacacaatgatttttttctggcgataggtccatttcctagtaatgtgagaaaggacattcaattattgataatcgttcatcttattaaaaatattatctaaatatcttttgtttttgttacaacttattttatactccatccatctatttttgataggcatatttttaaatctgaaaaaattacttttgataggcatatttcaatccaaccacctattctcttaatgactttcttgaatttaatatgtgactccccattctttcataaagatcggctatatgggcatcgagaaatgtaaatattaatgaatcgcttgtttacgaggaataactagtagcttgtttaaatggatgataagtagaattacctatccttagtcattgtgccaaaatgaaatatgactatcaaaaatacatggagcgagtatcattaatgtatacttctaaacttcataaaaatataaaatttttaaataaaatggatggttaaacccatgaaaatcaattgttttagacatttaaaaatggaggtagcatatagccacatactcaatacgattttccctaaaaaatatacttcctccatttcaggttataagattttataactttgattaaagttaaactgatttaagtttgactaagtttataaacaaatatagtagtatttacattaccaaattagttttaaactaataattaaatatatttttataataattttatattggttaaaaatattattattttttataaacttgatcaaatttaaaatagtttgacttttatcaaagtcaaaatatcttacgacttgaaatactaaataaagatgcgacacaccttgagtagtacggcatctgccggcgggacgtactcaaacatgtcgccggcgacgaaccgcacgtcgccggcgtccggtggcgccttcctgaccacttgcgggaggtccagcacgctgcacttgacatgggggaacgccgcggcgacggccgccgcggccgcgccatggccgccgccgacgtcgacgagggagccaatcccgcggaacacgtcgccgccgccctcctgaacacgacctccatgacgaagcggctgtccgcggccatggcgtcgttcaggacggcgccgtacgcggcgtcccttccggtcatctcccacctggggaagccgtgcgccatctcgaacagcgacatcgccgcgccgccgccggcggcgacaggctcctcctcttcctcctcgtcgtcgaccctgaaccacgcgtgcaggctgaagaacggggtgagagccgtggggtgcacgagaaaccttagcatgggagacatgtcgtgcccgccgccggcgccggcgacgagaaggcggnacgccggggtgagcgtgtacacggcctcgccggaggaggccggctgctgctgcttcatggcgaagatgccggagacggtgagcacgcgcatgaggcgccgaaggtgcgggaccttagcctggcggagcgcgacgtcggcgacgatgtcccggagcgtggcggcgccgccgcggcggtggatggcggcggggatgccgagctcggcggcgcacttgagcgccatggacttgatgtaggagaagaagtggtggtagagctggaggtggccctggagcaactcctcggtgctcatctcgtagctatgttgtgttgtgtgttcatgcatgcatcgctagctatgcaaacaagcgtatttataaggacagacagctctctagattagattagtagtattatgatttgtttaattcagttttagattgttatattttaagatggatggagtcgtatatcatgatagtcgaaaatagcgtgggacttatgatcaggtagtagtaccgagctgtgatcattggttcgaaattttggaaattttgaatttttggaccccaccggtaagcacatatcttccccgaagattttgttttttaaaatatttgtggatttgactgataatatattcaaatttaatcaaaatatgttaaaatttccccaaaaaaatcggttagaaaatatcaaaattcatgaattttaaaaattttggcagccacataaattttggtgactaccgaaattgcaaacactctctgtgattgaaacagacaaaaaaagtagctatcgccaaacaccctaattcatttttttaagggtaaattggaaccatgccattataattttgcaaagtttgagatatgccatcggtatctcaatgacatgtaacaccctaattcgtttttttaagggtaaattggaaccatgccattataattttgtaaagtttgcttgttgccggcagcgacacttaacctagtacctgttattatcagctacccaacgtgtatgacctggtaaaagaatattgtattgtatttgttgtttcttacaggctttcctcccacattatggtagcactaagaggacaattaacatgggtatggtcatcgtctcccaccaatttttaatttaagacaacatcatattttctgctgtgtacctgctcattgaccatgaactttaactttgacctggttccaaaacaccgtttaatttgttataagaatcatcgacagcaacaggtggttaacaaattttatcgaaattaaaaagtataaattaaactaacactttaaatttggcctgcatgattggttgaaacaaactactcatgaattaaatttgaagtatatggatttatatcattccggctagctagtaataaaatttattcgaatgaaatttgacctgcataatcggttcacatctctgtatttggaacctttgcttccagcttcgacatttctaattaacgccgtcacttctactgtataccgtcaacattcacgcgccgccaccttcatcaaggcttcagtagttcagttatgcccggaagttgttataaaaatccattcccaatcatgcgccgtgtacttaaaaaaaactaagttttagacattgacaaagcctcaaaatgcacattgttattattactttcttgatctatatatttataaaatataaaagagtagtaaaagtacaattgcagagaaaaatcgatgttaactctacatggataaatttcacgtattaataattaatgatctaaggtatgaaaaatcctgaccggatcagctaacgtttatgtgttgtactgaactttattacaatatttagggataaagaaattactccctccatctctgaataattatagttttagttagtaaagggcatgtcaagaataagactaaaagaccattatacatttcattaatatggaggaaaaataaggagggagagaaaacgaggaggagaaatgagtactattggtttactggataaaaatgaggagcaaaagatgcagtagtcttctctgaaattccaatttgaagacaagttctcatcctaaaactacacttatttatacaatgactagaatagtaaccatagaattaaatgagttatcacgtaggataaaatataacatgtcaagtcagtaattgaagaaagaggagtaaagcgtgtcttacattagatatggtttctacacaatattcacaatatattgacagagtagtagtattaaattcgaatataatcagcagtactatttgtgttggaaaagtagtagtttcttaataatttggaggatataaaaatcatggctagtttctttttattgtgattgtccttagagactgaggaagtggtaatctataatggattaaatacataatagtagtatgaatttataaaagattgtttagtttcgtaataatagaatatgcatatataatcctataatatttaatagttgaggacggagtaaataattatggcaagtagcagccatcttgaccacatcgtcacctgaattcaagattatgtcgatgtccatttaactacgcctttttaattttcttcatgtccatgtgtcgacatctctgttttggaaccttgcttccagcattgacatttctaacgccgtcatttccactgcataccgtcaacattcaagcgcagccaccttcgtcaagggtccagttatgccagatggtcattataaaaatccattcccaatcttgtgccttggatttaaaaaaataacattttgaacattaacctagtctccaatgcatatttttattattactttctcaatgtgaacggaatttaagaaatagaagtttttactgtaaagctatatacacagagaatagatcaaaactattcctattctacgactatcatatactctcttttattcattctaatttattataccaatcaaaataaaatttagccctaaaatatcttgtggcatgtaacagatgggccacttcggcctatgtgttgcatgtacgtaacctaaacagccatctacccccgcaccttatgacctaacaaacttctcttctcgctagtgttgntgggtctcacgtgtcaagttggtggtggtggtggcagactcactaccaccattgttattggcttttaaagtagtatagataataatatcaaaaatataatttggtaaaatagtttcacatattaaattctaatatattttattaatcaatgatgtaagattttaagttttgattgcatgaattctaggttgtcctttagagaacaaagataaagggtggagcattgggtaagtcgatgttaggcgcgagccatataaaaatcgctgggagtactctcacctgtccagcattgccaagagcccgaaagcccaagaaaccatcaccatggacatgacgcaaacaaccgagtgggacaagagcataagctgtcaagggggagaaatcacgttcttgcctcacccgcctttttgccactgtgccgaaaaagccgagagaattcagatcctggtcattttaaaaaaaattattttacaaaatgaccactgaaaaactaattctaaaaaaaattcttttttgcgcatcggagtgcctggtaccgtcggttaataaggcggtgccatcacctctcacgctgtccacatgccaacgtggcaccatgggggccaaccgacgttgatatggcggaaggagggcgccacgttagcatcggctggcccccgtattgtcacggtagcacgcagaggacactagaggtgatggcgccgctatgttggacgatggtgccaggcactccggcaaaaaaaaaaatcatttctagaataagtttttctagaggtttttttataaaataagttttaaaaaggactaaaatttaaaaaaatccagcgggatctagttgtgttgttcgggaaattagaaggggctctttgcagaattattcttgcatcagagtccgcacctaatcgtcaccacgctatatcagcactcagatcatgtcgtggttggtgtggattagtaagaccctatttaaatgggacttagatgggacttttaagtccctatcacatcggatgtttggacactaattataaatattaaacatagactattaataaaattcatccataattttggactaattcgcgagacgaatctattgagcctaattaatccatgattagcctatgtgatgctatagtaaacattctctaattatggattaattaggtttaaaaaatttatctcgcaaattaactttcatttatgtaattagttttgtatgtagtctatatttaatactctaaattagtgtctaaatacagagactaaagttaagtccctagatccaaacaccacctaatggatactgaatcgagtttaggggtttaagagttcaagcacttagatgacccatttacataaatatagaatttgtgtgtgcacttcactcttattatgacaccattgactttttacacaatatttaaccgttcgtattattaaaaaatatagtatgaatatgtaaaggtatgggttaatattatattttatttgatggtaaaacaagtgacccccaaaataaattatatttataattttttaaataaaatgaataatcaaacgttaggtaaaagtcaacaatatcgtacattttaaaaatagaggatgtattattttttttaaacgttgacttgttggatctcactagcatcccataatatcataatattaagagaacattattgtgtacttgtgtactcggtcccgccatgaacaccctcctcctttttcgttcttccttcgctactaatatagataagcgaaaacaattttaatcatctcatatggttccaacttcaaaactgtatgaaagatcctgattattgtttatgttttctgtaccgatcgttttattctaatattctaatatctctatccaaggcaagtagcagccttctagtgcttaaccatattagagtaagttttgttgaggtgatggtcacctctaattttatccatatcattttctagtagcatatacaacacattgcctctaatacacttatcccattatttatttttacttaatctattggtcactttctcttatcatctatctaggagcagtttgtgtaaaggttgctcattgcatgatcagtggctctttttctttctccccattgctctcttttccacattatcatatattatcctatttctttcatcctaaaatattagacataactattttttctcatatctcaaaatataacataagacgtnnnnnnnnnnnnnnnnnnnnnnnnnnnnnnnnnn

SEQ ID NO: 17 - DNA, 5310 bp, Oryza sativa
cgcatgcgtgctgtaaatacaagctgaatagttattgctcaatatattaagccttttcttacgggtataaattcacgtacatgaggtggtctggaaatatatatatagatgcattgcgaggtcagggcctcagaggtacattatgggagtaggaaaggaaattttatgaaattaatttgaaactgatttaacaagccaaattggtaatagaggaaatcaccactactatgatagctcctgattttgcatacatctaagtacaactactctctgtggttttttcaggtttgaacagtgataaaaaaccctttctaatgtagaatttgaaaatggatattgttcctttttttcaaacaatcagagcatatttatggaaaatgggagatgcacattaatttatatcaaattttgtttgatactggaagttttttattgaactcagccaattcaccaagatgatacaaaagtattgagcacactccgggtctttgtataactaggatatacacagctaaaacacacaaacctaaaagtttataagaaaattaaagcaagttcaggaagtattatgagccatcaatcataacactagatcgccacctatgctctgggtaaaaaaagtccatgaccacttaatccatgtacgcattggataattaaataagcaacctgcacaggagacactactagaaaaatcatttgttgccacgaaaaaaatcgtggtatcaatactaaaattgtggcaatagatacatgttgccacaattttaaaatcgttgctagccgtggtaataaatagcgtagtaataggttattacaacggtttttatttagtggtaataaatttagatgttgccatggaatggatgtggcaaaaagtcatattgcaacacttcacatcgttgtattaaaaattattgccaccactccatatgtggcattagttttatgtaccaaattaaaagttcaaatactagtctatcatcctatatatttatctatttatttttttgatatcatgtcttggctaggattcgaacccaagacctatccttcatgcgtgctcccctttaccaactcacttacgcattaattctgttgaaaaatgcatatcattctatttgagcctacctaactgagatttgaatcatagatttgaatatctaaaatatttcaaatgaaaaagttatcacctataaaattgtagatctcgtcgagagctataattttcatataaaatttgtctcagtccgtgtccatatgaaaaaattaagttaaattatgagacgacaattttttattgcaaccaatttgttgatcgtggcaacaaaaaatagtgaaaagtaccatgtactatgtaaattgccacaaaaattaaaattgtggcgatagaacatgttttttgcaacagtacgattttttgtggcgatatctcattttctattgcaacaaaagtactaaataaaacaacgattgtagattgttgcaataaaatataattatttgccacagaaaaattatcattgcaatagtacaatatattgctacgaattattttttgttgtaataatttggtggcaatagctcaattttcttgtagtgagaagaaataacttttctgtaaaaccagcataactaaagcgagtaacaagtaacagccacccctaatagaacttatggttgtaaatagttttgaactctcaaaagccaacaagtaaagaataaagactatgtgatagagtacttcttgatacgacatatatgataccaaactaagttagcaaaatgacattcaaggaacatgtgtacttcaattatcttcttatcgtgaccaaaataacaattttggttgccttgccgattatgtttagctggattgcattggttagcacaactccacgacgaaggtagcaaagaaaaatcttgatctttaccttcagtttacaaaggcgtccatttatgttcaggacaccactataaacttgtgccaagtagtgaatttacacggtaaactacccactatgcgtcaaattgtttagagaaaattttataaaacgaactcatactttgatcaacctataatagaactacatattcaactaggtgtatcaccaaactacagaattagcaccaagcttattataaaactataaatttaagatgaaatgtcacgaaactacaaatttaataactaaactatcacagaactacatgtttgaactacatgtttagaaaaaacaataatgtttatagctctaatgtaacaatttactaaatactctcttcgtcctaacatataacaatttttagtttctagaatttacctcaaaatataataacttccccaccaaaattttattcttaaccattcaatttctccacctgtcctcacttcctatccaatcacaacctttgtccatttaattctacctaccttttaattaccgtgttcacccctaaactttattatacactggaacggaggtagtaacttctacgaattgtacatgccacgtagtgagtatgatacacaggtacgcactgctgccaatgaatttttttgggtttgctctcgatcgtaacgttcaccatgaaagcgaattcctgttggtgtaataactagaggacaagcctattgtcacttcatcgttatgttggggacacaccttcgaagagcacaccaagttcaaattagcttagaccatctcaaacagcctcttcaaattaaactcttcaaacatccatattccatatagtcaactctccatctgagttggctagtcaaactagctactcactctaacagcctctccatctaccatttccattataagtctttaacaaatgggacccatatgtgctacatttttcctcctctgctcttagacgcacatccgtagaattgcctacaatcgagacacaatcatgacctaaaaaaagcaaaaagaaggggtagaaaatgttctttgtgagcctttttacggtcctgtaaaacaccgcagattggcctgccaaactgtatcattcaaaaattcagagcaaagctccatttcttcagaaaattaaaaagtgtacatgtggagatggagtcctccatgatatgaacatttcgcgagctgacgacgtgaactccagtggtctccgggctgtcctccggcgaggttatcctcatgtagttggccttgacgtgtgagcacctggtgaacgtcaggtggctttcctggctgtttttcagggtgatccccatcatgctgatagcctgataccctgacaatcctcgaagtgcagcgcctacaaattctccatcgttttggtccaaatcctctggagctagacgaaatctctgatcaaatcggaccacaaaaaaaataaactctcacctctggagcagccaaggtagtgcaattctgcagaggcaagaacatgagagagaaaacacaccattgttcagaacttcagaataattcatatcttctgtatagcgaaagcaccattatgtgtggggcccacgattgactagtcacttttggctggctaaatttggctagtggagggaaggttttggctagccagatggtttaaccatccggttggagaggctgttggagcatgtttttttttttttgctagaatggctaaaatttagcttgaagagtgaaatagagaggttgttggagatgctcttacatcaacaagttttctgcaagttggccaaacatgccagcttgcgttgcatatcactgaagaagaattcgtcgtgatggcgtcagtgatcttggagagattatcatcgtcgttactgcattctccagtccccgatgcccccccatgtccacaggacttgcatattgcgagatcaggttatcttcctgttgacacacgcctaaattgatcagtttatggctactcgatctgcctctagcgatgtcagacaagcttattagctcaactttgtctgcctagactcaagctgaatataaatcagtggcgtcgtcaggctcgagctcgtctcgatgaattaaaccttacacgaatggtcatcgaaatctcgagctccaattcaattcctttgataaatacatagtgaactttagcttgaccttgatgtttagataaaagcattcatccaaacgttacgaaactctagctagctaatcgtttggagctcaaatcaagcctaggaatgatcaactgtagaattaatataaaccactggggccattctaacaatggtgaaatccgcactagttggtgaaataggatttttgagaatcaaatccaacctgcaatttcgtagaggttgtaataatctgtacgatgccatcaaactacttcaaggccccatgcatggatattgtacaaaagcagtaattaacccatgttaccctaacacggttactgcaatctccttcccgactctccaattttttgcatgttagcacatagggtcagacacatcgtgcgcaacaaacttgtgcaagcactgattgagaaatcattcgatgagatggtgatgctgtaatgcctcccagtcctacggtactagtacgtagttcactgacggtgccggtccaagacgtattagatgtactgcagccgcggcaacgaggagaaggggaaggtgcgagatgccgccgccgacgccgacgccgctggtgcatgtggaggaggaggatgggagatggatgtggaaggtggaggagaggaggatgggagaagagaaggatgtggataaggatgtattggtgtgagcggggctggctataaagatctccggttcagctggctctgttggttgggtactggtttattaaaaataaaaaaaaaatgacacctctagtattaatgtcggttttttcctttataactagcacctatagctgtttaaaggttatggttcagtgccggttgagctgacacctataagaggttttatagtagtgacttaacattctgtttacgtataggttgtcaattgttgttaaccttaacaatgaactcttgatgtgaaattattctctgcaaactactgggcgaacacaacatgcaattacctaaattgcatgcaccaatacccaatgaacatactccctccatttttttaatagatgaagccgttgtccctttgccccccctttctccccttctctttctctttatcccccaccttcatctctttccctcgcagctatcacattcttctccccgtcacaactattgctcccgtgtcacatttctttttctgtgttttaaacactatcgcgcgcgatgtatataaacttccgtcggtggcccatttattaataccct

SEQ ID NO: 18 - DNA, 6730 bp, Oryza sativa
  unsure (1)..(6730): unsure at all n locations
nnnnnnnnnnnnnnnnnnnnnnnnnnnnnnnnnnnnnnnnnntcttatttaaaaaatttatgtaattataatttattttgttatgagttgttttatcactcataatactttaagtgtgatttatatcttatacatttgcttaaaatttttgaataagacgaatggtcaaacatgtgagaaaaagtcaacggcgtcatctattaaaaaacggaggtagtattagttattgactcagactgactcatcagctctgtgccgaggtcgggttccttgtgaataacaaagtcgaggcagcttaatttcatagattgaagaccagagtacgcgcaccatcgcacacgcgcgcctaccgtgttggtcgtggtggcgacacatgcaatcagagcctcgcgttcctctatcggagttatacccacatgtgtcttcgatcgatctcacccatattactgccactttcctaatgcatcgccccaaccacgagccagccgatggtctcagccaagaccagccccagggcaatatttgcatatgcttcatcggcaaccatctatgtgctcttacgtgggtctgaagaggccctttcccatgtctttgaagtctggtagaacaaacattcatgagcagcacaatattggtgtgttctctgatgcctcctaaccctagctagctgtgctggaattagtgagatcgatcgatctcattgctccaactggggataataaaagataagatatgtcaagctgaatgttctgtcaattgcacgacgctactacaaatccacttcaagctttcctcgaggtttggcagctggctttcattaggattttggatgcaagtatatggccacctgagttacctgtctctccccatttatatggaatgtatattttgcatgtaagcttgacctcgcctggctggacctatagatggccaaaaggcccgcccagcacggctgggcacggtccaccagccatcaggccggcacggcccgatcggcacttcgtgtcgggccgtgccggcccatgggctgcacctcatgcccaggcacggcccaccagctgtcgggccgtgtcgtgccggcacgaaaggccggtggcccatcgggcctttttaaaaataagtctatttttcgtcctccttattgggctattacatatgtacagctaaaataagtctattttccatccctcctctttgggctgacatatgtatagctaaaataagtctattttccgtcgctcctctttcggctgacatatgtatagataaaataagtctattttacatccctattctttcgtccaggacatataatatgtctatttttactacccaatttatttgtgtatcggggttggctgccggcccatcgtgccgggccggcctggtcgtgctgggccagcccaacgtgccgttggaggggcccaggcacggctcggtggtcgggccgggccgacacgggcccgacctccgtcgggccgtgccgtgcttgggccaggccaaaatgccgtgccatgggctgagccgtcgggcctcgagccttttggccatctatagctggaccaccagccatacacccaattatttgaagtatttattattgtgttggtacaaggatttatatttcatgagaagcccaaaggaaattgtggtcaagaataaggcaacagattttagtaagcatagaacacttaagagggagagaaagcacatgtggcacatatatatcgacaatgttgtatagcatacatgcagatattatttgcagtcaaaaacgaatcctatatgaaagctgaaccaacaaatgtgttaattagtacatcagacataaaaaggactttctaaaatattcgtggaataagcgaaatggcatatttgcaaacaaaaaatgatctatgaataaaacttttatatatgtgaacttatccatctaaaagcaaatgctgaaaaataaacttcgatgaaaaaatctcaaatcagtttcaaatttaagattgaaaatttaaattttagctgataagcataagtatataagccaaaaaatgaggtcctataatagaataagttaacccggtcgcttttctatagaaccatctatgaatatgatacatatccggaaaaggagaaatatctatgagcaccacaccggccagtcactgataccataatttttccctaaaaattaattttagtacctcttcaataccatatttgttttctttttaaccaacaccatgtttgcacacatgacgggtgcctataactccatcgacaacttggataaacccaatctcatgacacacatcggacacacgcgagtctcaatagtaaaacaacacatggataccgatcatgacacaccggatcctactataggagcctcatcatctgccaacatggacaatgcgatgtggatttagccatgtcacgccggttagcagtttaatatgatggtatctaggcttaactatgaacaataaaaattctatgacattaaatttcatcataaaaagataggttctacgacgaacttagtttgtcacggatggaacaagttctgtgatgaaatttgccaattcgtcgtgaggaaactaatgtgatgctccgttttttacgaacatgaattcgtcacaaattagtcacataaattttcttatgatgaattcgacatctaccatgaaaattgtaaaatcaaagtgtgtttgaatattatattgtgatgaacaattagcatatgagattattggttttgatatatatttggagattattagcgaatggttcttggagatgattggacttttcaggtgttgaacaaggattgctattggattggatccggtcagaccggcgtgtactgagtggtaagaccggccagcccacggtctgaccggccgacattgtgtcggtttcggtttagggttgattctttgaatatccttggataattcatgtttatgacttctagatggatactatgcgtatgtagtaatgttgtttgctaacaattagtcaaattagtaagaacttgtgctcggatatggtttcttggttaatgcatatgtaggttgtcttgatgcctcaggagaatgttgctagtgatggatctggagtcaacttgggagaaaacgatgtccggacgatcttaatattatgtgggattcttaggctaaagatcaatgcacgtggttggtgaagattacatatggcatacgatggagatattgtgtgcgtatgggatgcagagtcaaatttgtagggagtccaaatttggtaccattggagcctgtaaagtttgtttcttgtacgggaaggtttcctaggggattaggaatgttgtattgggaagtctggagaagtgtcgggctgtcgacattctcctccaagtttgtacctcgacggatgcttgtcttcatataagtaagtgtttgtgacttatttatgatatttactcttattatttaagtaagatatattctcatcattgcgggtttatcgctctgtttacaagagtaccttgatcttccataaggttggtaccgagattggggtagtaattaatagcagagatgtagtgtatgggctagatattacatttctttgttgtgtgctacacgggttgtagtggtaggcggcaggtggtgatatccctgtccgtccttcgtaatcctcctcgttcgggtacattatagagctgtagaccggaaccttttggcagacatgggtaagcaagtgcccgaagcaattgatagagttttgcctaatctataagagttcctctctatgctcacctaccatttatcttgtgttcttgggtaatcgaataagaaaactagttcacacacgtttcttgtggatacgatcacctgaaatactcttggatgaaggctacaatggtatctgtgtgtttgtagattattccatgttcgtaataaataccagctcgacctcagtagcacgagacagagtggatcgactgacagggtgacaatagagtcaccatctttctggatggcaatgagctcccatcagagcgccgccatgaagtgccgcatatccaccggagtgccttttgaagacggaaaggctaaggggcgatcgatcgcccctagcacggtcccccctttcatgtggtttcctttttcggcaccgtattattttcctattttagtaaatttatacacctaaagtttgtacatctcaagtttacgcatctaaagtttagagacccaaagtttgtaagtcaaaactttatatatcctattcaaatttgaatttaaattcaaatattttttatatattgtatttctatacatctaaagtttatacacctaaagtttatagacccaaagtttataagtcaaaagtttatatacccgatttcaaatttgaatttgaattcaaatatttttatatatagtatttctatgcatctaaagtctatacacctaaagtttatagacccaaagtttataagtcaaaagtttacatacccgattcaaatttgaatttgaattcaaatattagtttatagacccaaaatttataagtcaaaagtttacatacccatttcaaatttgaatttgaattcaaatatttttttaatatagtatttctatacataaatttttccaactttattttttttattttttaaaaatgtatggtgtagtaggaatagaagaggggaggaggaagggagagagtagcttatagggtgatggggggtgatagcctagagcggtcacccgcccatcagccgcccctttttgaagatgccatttttgagacgtaggatgtgcgtgtcacttatttgggatcatgtagtagcactgtatgtaagtataacttattttgttatcacaatattatcattaaaggtagtttaggcatgacttacatgttttttaatttatatttgcactaaattttaaataagatgaattgtcttattcaaaattttattatagtaaattgtctaacgtcatgtctaaaagccaataaaaatgtcatacatttcaaaacagagagattacaaatgatagaaaaatattatttctgaaatatttttatagttcaataagttaactctatcacttctctactacatccatgtgatacttccgggggaaaaaaaatgacaattcatatatacgaccacatcacaagtcactaacaggcaataacatgcctcacaagaattattgttaattaaggctacgcaatttcgagcttggagtcgagcttaaccttagcacgacaatgcatcaataacacaacacttcaataatttactaaaacctgctctggaaggttgttcgtaactcaagcacagtaaattttggtgaacgcttcagataatcagataaagttggtctatgctctagttgaggtccaaaatctagttgagcatacaatgaggatagcacgggtaactcgcaggccgcaaggtgaatagtcatgagtccaacattctccgacgttgttccgtgctggcatcatatatacatgccatctgccatctatagaactggtagtagctccgtacagtcctgaagaacatctcaaagccacggttctgctgcattctcgtatgcctcccaatcccactcatacctacgagcagtgctttgagtggtggctgcaagatccaaaactacatgaacggtaaccgcatcaatcacagaaggtttgaatcaaacatgtcgatatggttaattgggtgatgccatgcatgtatatatcatcagaatttcagaatgtgtgtctcctcactctccctgtttcgcttcgaatcctgaggaaacactgggttggccccttcaatctcatttatacatgtgtattttaccgcgcgatggggggcgggacccacctgtcaggcgcgtcttcctcctctcgcccggtatcctctctctcccgtgaaaccctagcgctgccacctttgaatcctactctcttgcccaagttctgggcgaattaattgcaaaaacgatcctctcccctatatttaattaggagctcgtatggccgagatacgaccatccaaacttaatttaagtgtaatttaaatggatattttcaattgtttattattgtaccattaaattaggtgaacacaatattgctcaagaaaagaaaggatcaagcaacttccagccgagacccacgggtcaaacaactagatcacccgtggaccgggtacacagagactatccacagagagaacggagtgagatcctacgtgtcaaccgaaacaagtggccgtcaaacggacctcacgcgactaccacgcgaactgcacacgtgggcaaccacgcggcaaccacacggggaggacgaggagagggcagcgaagggagaggctcttaccatgggtacaacacagcgagggaacaatggtggcgaccggcaacgacgaacggaagaggacgacatagacgaacggaccaacgacgagggaatggctctggcgatcttcaggtttggtgaagaggtggacgatgactggcttggcgctgcggccttgacgacggccggagcaaggcgacggtgtcgcggtagtgttccggggggtctccgagtagcaaggagatgcagacgaggaggaggacaacatggtgatgccgacggtagcgactgtgcagcgagacggcactccggtgagacgtgaggggcaatcagnnnnnnnnnnnnnnnnnnnnnnnnnnnnnnnnnnnnnnnnnnnnnn

SEQ ID NO: 19 - DNA, 7094 bp, Oryza sativa
  unsure (1)..(7094): unsure at all n locations
agactggttgttgaattcgcttattcgattgtacaccagtccattataatatgatggtcttagcccactcgaagattaattatttgaaaattcacaaaagcccacctcatgggatggcatgcatggggagtttagtaccatattgattattctaggagagggggacctccttaaaagggaggacgccctcctagccacttgaagcatgtgaggtggagagaagagggggaacacacgggcgtacttgctcgcctcgctttgctgggcagggcaggcggcgcacgtgcacgacgtacattcgaatggtccgaaaaattggttccttacccttgcgcggatgtagatgaggctactactctctttatgggatacattcttagcgttcttggcgattgtctggtcgaggtgtatatgcatatgacgctaaggagttgtgggatgtgggatgcactgaatactaaattcggtgctactgatgctagcaatgatctgtacgttatgtagcagtctcatgactacagtgtcaaccgttctgtagttgagtaggctcatgagatacagaccatggctaaagaactcgtggagcagtttcatgactacaggatggctgacaaccgttttgtagttgagcaggctcatgagatacagaccatggctaaagaactcgtggagcagtttcatgactacaggatggctgacaaccgttctgtagttaagcaggctcatgagacagaccatggctaaagaactcgtatactgcactcaaacacaacagacaggaatacaccgttgaggggttgatagcgtctcttgatgttgaggagaaagctcatgaaaaagacttcgcacctaagggcgatggtgggcagtccagtgccaatgttgtgcacaaggcccagaacaagagcaaggggaaatacaaagctcagcagaccaccaacttcaagaagcaaaagaagaacaacaacaatccgaaccaggatgagagaacttgctttgtgtgtggcttgcctggtcatttggccaggaagtgtccacaacgcaaggggatgaaagcacctgcagggtagacttctaaatctgctaatgtgaccattggtaacactagagaaggagatctcgacgaattacttctgaataaatgtagaaatcatatgaaagatccatagcatttcgtgacctattggtaaatcaaatcaactttgattctctatagaccaataatatgagaccattaacacggttaaagctaaactgcttgaagtctaggcaaaagggggtactctttgtacaactatattagtattagtaccaaatgctttaaacaggaaatagctaatgtagaatttatctgatatagaacactcatatcgataaaatggtttgaactatttactagaaggggcaccctgcccttttttatccaatgccgaatcgatgacctatgtataaaaaaatgagaaagtttttggatttgaagaaaaaagtaggaattctatccattttcattttccatttttctatttagtttttcttaatgaaattgaaaattttaactaaagggcaaatacaaataaaaaaacaacttatggtaatttacctactattttttcagttaatcagtctactaattggtggattgatacaggggccaatgtacatgtttgtgctgatatttcgttgttctcttcttatcaagtcgcacgggattccaccgtcctaatggggaatgggtcacatgcttctattcatggtgttggcacggtagatctgaagttacttcgggaaagatcgtacagctgaagaatgtgcaacatgtccctactatcaacaggaattttgttagtggctcccgtctgactagagacagatttaagttggttttcgagtctaataaagtagtcgttgtgaaatcattgtcatgattaatatttgtgatgaacaattggctttgtaaaatgatttaatcgatgaattagtttgaaaaaatgtgtggatgttggtgtgagtgcgtgtgactaatgtgggtcaggttgtgatatctgtgcccagaaacggttgttttgtctgattgtgtgcaggtgacttgaggtcagccttggtcaatggtgaggaccgggactatgcttagggaggagcagaggtctagtgcggtcgggataccatgtgagaaggtgactagagtcaggattcttggagggcaacttcggtcaatggtggggatcgggactagactcagggaggagttgaaaggtccagacggttaaagataccggatacgagatggcatacggtggatggacatcgtgtgggagagatcttcacaacgggcttcacgaggtgtgcgtgcaagcgtcggtgttcgcgaaggaaattggaggtagaaaactggaagaagaaaagatgtgttacagtacacgaggtactgtagcaggatacatgtacgtgtgtacatgtgtgatcagtacatgcatgtgtgtgcacaaaagtgggccaggtactaacagagatttggcgggagggtagataggtaattgtctccattggtatttaaatcaatctatgaaaggcaaatcacagtaacagaagttcttcatgcggtttcttcgatctcgagtttgttctgtacgtagtatgaagttcatagcatcgattacatgacattttgatcgattacagatttattttgttataaatattgatgtccataaagcgggtggtgtcatattatataaagttttagtagttcattggtgaatttaattaagacactgatccacaccggcatcctcaggtcatccaaaagacagagaagaaaattgccttccaaaggctagaggatgtgataccctatgaaattaataagtgactataatgtaagcagcaggagcagcaagagatgagaattagtgaacggaagtaatacgcgagcagcaatggcgattgaattataactgaaaacaatcaaggagaagttagaagttgttataactgaaaacaattactaaattgcccatccttatggtttttctattcctagattaatatttagtaatcaccggtggatctttaatagtttaaaaggtatcctagatacctcccaagcactgtaaaagtctcatattttttatagtcatatttccaaatctgaaaaatatatttttgatagtcatatttcaatccaataacatatcttcttaatagctttctcggatttaatgagtgactttccattcttccacgcaagattggctgcataggcatcgagaaatgtaaatattaatgaatcgcttgtttacgaggaataactagtagcatgtttaaatggatgataagtagaattacttatacttggtctgtatgccaagataaaatatgatgatcaaaagtagatgcagggagtataggcaagattggtgataggaaaataccagatgcgaaaaatcaagaattttgcctcttggtatataaatgcagtaatgaaggttactacatgaaaatccaaagtacattctttgctatttttttgtcagaaaaaaaatactggataatgacatgtatgtgctatctgctattcagcattcccgtagtatctgcagcaaatactatttgcaaaaaagagccatggccctctgaggcagataagactaaagccaatggctttcagttaatattatttagaaatttctgtttggtgcatgcaactgatggtctgatggatttaactagatacaaaacttaaaaccgatttccctcaagtcaacttctcagctcagaatctttgcattatttcttaatactaacttcaagggttaagggcaaatccaccaaaaaaatcccaacaataccttaagagggattagccaactaggctaagcggctagcactgtttgatgtgtagatcggagtggcccatgttatgccttataagtggcctaactttgcacgaacgaccccaggagcaagtcttcatgtgtagattttattgttataacttacatgctctgttcatgtaatgaattaacgctgaactttttgtgtgcatcaattgattgattatgagccatagtctaatgtacttaattttcaattaatgtggtgctaccatcattttggaattgcagaaaggattggatctatcttcttttcctttttccaaaagacaataattaagttgtgaggcaaaatatatctcgtattgcaaatgatcttacaaggaaaatgttgtgacattctcaaattggttttaaagttagttgccttcatgcatagtttgtttctcaaattattgaagagccacaaactttttgatttgttgactgacttatatgttaataccaggacgtccttgggactatgctctgtcatgtatgattcaaggtgaaaccgggtgtttttccgaggacgggattgctgattttagtgaaatgttcaaggcaacagacggaattaggatgtaatcacttttaatcttttttaaaaaaataaatggaactgttgtacatacaaggataaagttattacagtgggtgctgtacaattcaaattaccaaaaataaactgtgactgtagctaccatcagattatttcaagcagcatgatatccagatgctatcagttactactcttgcatgacaattcaaaaccacgtggaacctgatctttgttgcttttttccgtctccttttgatagaaatgattatgcaagagtgctaagttcttactctttactaccgatggtgtgcagttccagaattgaagtacaccctatgttcatggtttaatttttaactctttagagacattgaaagttttggcaaatcggagggcggttagagtcgcgcgaagacgcgacattataagctagttgttgatgaaaagtatgagattcactttaagaaacgggaagaaaaatactttgattcgtctggagattcagtgttcggtatttctcactatgggagaaaatttcttgctatgggagagtttctaaaattgattttgaaagtctttgttttatctgagatagtgtatatagttgctaaaatctctaaagagatgatgttttggcattgtaaacttggatatattgtttttatcatctcataggattagtgattcagatcttattcgtgatttgccaaaaattaagaaagatcttgatttggtctattcaccgtgtcgtcatgctaagatagttgcttcatcaaatgctcctattatttttgtgatgacatacggatgcaccaggatagcttttatatatggacgctgttgttccagctaatgtgtaatttgttggaggaaaatggtacgtgttggttattcactaatacaaaaacgatttttccgtgcggtcgaaaaggtgttttcgcatgcagatatcccgtccgtctgcaccgaaggatatgcaaaaatctgtttttttttttcgtgcgagtgatgcacccgcacgcaaaatctgattattgcgtgcgggtgcttatgttgcctacacgcaaaaataaaaaactgaaaacaaataaaatccaaaacctaaccctagctgccgccctccttgtcggcgctgtcgccatcaccgccttccaagcatgcacgccgcccgctgccgctcccagccgttccctcgcctccgctccgccaccgctcctgagcccgcctccgccactcttgagcccacctccgccgcgaccagctctcgagcccaccgccactcccggccgcatcgccaccacccaccgccggatccaggcgagtgagaggcaccgcctctagatccaagcgggtgaggggcgtcgccgacgggagtgcgaggccgtgctgccgccgcctggcctggggaagcatgaagccgagctgccgccacccgccgccgccatcagccgcccctcaccctttgcccactcgagccgccgccgctcgtgagtgagagacgagagagtgagtgatagggagaaatgagaataaggatgaggacgtgagtgagatggatagagaggataagatgaaatttttgaagtggttgagagggaaaacatgtctgaggagggaaggtattttcacgtgcgaaaatcgattttcgcgtgtggccccttatgaggactgcttgcaaaaatagccttatttttccgtgcgaacccttaagagacccacctgcaaaaattgattttcgcgtacggtcctcttcaggtctacacataaaaatagaaggatgatttttacatacgtgaccggttacggtccatctgcaatctaaaagagctccgaccatgtacaggaccgtttgtgtagtagtgatttttgacgattttatagatattcttcggttatcatcatggttactaagaatgagatttttgaacattttcgaagtttggatcatggtttgggtcttaaactttctggttcttcaaaaacaattcaaagtaatatggtggtgagattaaaaatgtgtaccatttccaatatatccattcacgacactactacaaaaatcgtttttctgtacgagggggtcggtaggttccatgcgggccgcttgtggcggcgcctgcaaaaaccgcccccccggggcgggttgattagccgcatgcgaagatccattatcgcatgcggctggttaagacagccgcatgcgataataggtctattttcgcatgcggctggcttaagggaccgcatgcgatgatcggccatatatgctcctccaggcccgagcttgaccatttgaaaacgaagctttctctctcctaaagcaagcaccaattaggggggaggttttcatctcgcaatttttacttgatctctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagntacatgtattggtgtaatttttttgggagacaaatgcatttaaacttttgtatgaaatacctgccgtctatttttttatctgtaacttttttgcctttatt

SEQ ID NO: 20 - DNA, 3842 bp, Oryza sativa
  unsure (1)..(3842): unsure at all n locations
aaagaatgatttttacatacgtgaccggtacgggtccatctgcaatctaaaagagctccgaccatgtacaggaccgtttgtgtagtagtgatttttgacgattttatagatattctcggttantcatcatggttactaagaatgagatttttgaacattttcgaagtttggatcatggtttgggtcttaaactttctggttcttcaaaaacaattcaaagtaatatggtggtgagattaaaaatgtgtaccatttccaatatatccattcacgacactactacaaaaatcgtttttctgtacgagggggtcggtaggttccatgcggcccgcttgtggcggcgcctcaaaaaaccgcccccccggggcgggttgattagccgcatgcgaagatccattatcgcatgcggctggcttaagggaccgcatgcgatgatcggccatatatgctcctccaggcccgagcttgaccatttgaaaacgaagctttctctctcctaaagcaagcaccaattaggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacgggaaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagggggaaaagattgagcaagaatgagtacaaccacagtactcagcaagccacaccggcggatgcataattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggtcccagctcgtcccaagccaacccaggccaaccattccacattttagttgttgagcaaattttaagaattataacactgacttgggtacattgctaggcttgcccatatccgagggctcggctattcgaatagatttactctgatcagaggtgtacatctttacccacaagacacgtcttcctcacgtgttgccacgtgccacataccaccacggtatacggacggaagacgtgacataagttccaacccatcctaaccttagacaagagtaccgacccaatcctacctacgggcgggatacccgggacaggcaggcagaactgagcccctagcattgggcaccaaccctctgccggatgacatctcgactaccgggccgcagcccgtgtagccttcatttgccctggagaatgtncatcgacgcccgacttcattcatctncaatccgtgtacttttgtttatgactagacttgagcacaaactaaaccttacccattagacatgtggaagtaccgtagtgctttgcaaaaaggcccgagcttaatcttattgtgggcggggtgctacttccacaat

SEQ ID NO: 21 - DNA, 3544 bp, Oryza sativa
  unsure (1)..(3544): unsure at all n locations
ctgtnnttacgtatggtccattcgcatggacacgnagcccatcacggagcggaggaagacggcggcgcggctcgggatgacgatgacgacggtactccggcggtcggcgggcgaagtcggatcggcggacggggtcggcaaccactcggcgaagccgaaggaggtggcgccgagtcgggaggaggaccggagcgacgacggcggcgaaacggagttcggcggcgacggcggagggagaggagaacgtctcgggcacgaaaccgacggcgagagcaagcggcgaacggcggaaacggaggagagaggcacggggagcaattatatagcgccgagagggggagagcgcggccggagagagaggaaaccgcgcgcggagatctcggctccattgaaagcgccggcgaactttgcgggaacgattccaaacggatccgagggagagagagaggggaaagagggggaatcgggagagggaaacgcggggagtaattcccctctctttaatgcgcgcggggacggcgggatgcggcgcaatctgcggcggcggcggcgctagggcacgggcgcggcggcggcgcggcgggaggtaggcgatgacaggtgggtcccacctgtcagcgagagtggcgggcgggcccgcctgtcagcggtgcgcgcgcgcgcggggagccgatgggccgcgggagagcagagatagggagagggaagtgggccgagccggcccaagaagggaagggggggaaagaagacttcttttagggtttttctttttataaaatcttttcaactttgtttatttcttctcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttatttcgggatgaatttatcaggacgtgacacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacctcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagaacgtgtggctcaggtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagaggaaaaaaaatatgagtttttttggtaaaaagatctttctatgcggctggcttaacagcccgcatggaaagatctttttcgcatgcggccggcttaacagcccgcatggaaagatctttttcgcatgcggccggcttaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccggctcccgcgaaaccctagccgccaggctgccaaaatttcccaagtcgccatcgccgtcgtccccgccaccgccggctcctccccaaagtctgcccgccccacgccgtcgccgcgtcaggacctctttcctaggctggattcgagctccacgccaggacctatctccccttgccgatggcgtcgatgacggcaggacctttaccatctaggcgacgcctgcgccgactgtaggtcgacgacagcaccggacgggactcttcccgattgccatgacccattcgcgcaggaggaatgtatcgacaccaggtcgagcccgatgacgccggttacttatattaagcttgcgtctacgtcaccacggttgagctaataacaggagtctgacatcccttgcggcggattgagtagccataaactgtgcaatttacgcgtgtgtcaacaggaggataacctgagccttcaatatgcgaaggctgtggcatggagggtcatcctcgactggagaat

SEQ ID NO: 22 - DNA, 13376 bp, Oryza sativa
  unsure (1)..(13376): unsure at all n locations
cccattaagcttttcatttctgaaaaaggtacacggaagctagcgtgtgcattgatttgaagcccggagtatatctgtatacacatgcaagacgaggcgtctattaggatcatagaaatatcctccgcgcatgtgtgtgccttccggtaaaactgggaataagagtctcccgtacgctgagttccctaccaataccaggtatcaagccagcatacaaatggccccctataaagcgttgtacgggagcaaatcctgcacccatatattgtgggaccagtttgtataaatccaagtgttcggtggtgatattctgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatacagatcgctgtatatgccgccaggtatctgtcgccacggcatggacctctcccccctcgccgttgccatcgccgccgccaggtcatcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagatttatgtataattcggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccgccttgccaacctacaccaccacccttcccttctcaacaaccgcctctcccgaccccgcaaccagttcaagcctctcccacctccccaactaaacagcatgctcccccggctccgccctcagttcaaacctctccacctacaccccaatcttctctggtagaagaagtgcacataccagatggtactacatccgaaccaaagtctaatactttggaacctcgtcgtataattccaaagttgatatcgacatacgacccaaaggagattgacaaggacaaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacgattgaattaatggttatgtattacatgtttgttactgcggcacttgtcgtatcttatatgcttactactccgaaatacgataataaatctctcaataatttcatattaattacgaatcaccaaaatgcttgaataaagccgtcttaagtgaccgcatgcgaagatcaatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgcgagatgcactatgcactatgttatataccacagagatttctgaccaaatttgttccggcgtacaactatgttgtcttcctaacacgtcgacaccatcattgaaatgctggatgggattagcttcggctgagcggcgttggcgtggtcggggcgcaagacgtggccgctagcgctgcgtgcgtggcgcattgcaacgactgcgaacatagaaaaaataattaatagggacccaatacttaactcaccacccgtgcatgtaaaacggaccgatgtattttcttataactaattaagtatttattttttaaaaaaaatagattaacatgatttttaaaattaagcaactttcatatagaaaatttttaaaaaaaacgcatcgtttaatagtttgaaaaacgtgctcttatataagaagagaatgagttggaaaatgttgaggaaagaacgccaagccctattcgatctctcaggtgagagtattttttcagcatacgcaaaacgtgaaaactcattcgtatataatttattattaataaagtattaattatttaaaatttaatttttaaacaactcccatatagaaacactttaggtaaaaacaaattatttaacaatttgaaaagtgtgcttgaaattgagagtacgaggaaaagaactgaacctaatatgtatacgagatagttagctaggatttaatagtttcccaggaatcgtgggatccgatcgaggaaacatagggtgtgtttggatcctcgcatccctttatcctggctcatctctttcatctaggctgagtttagtctggctgagaggatacatatataggtgtttgtttatttgtattgatttaaccagggtagcatgagatattggtttggtttactgtaccggacggttcaaaagagatcttgtttgattgattgtatgaatgatgaattgatttttttttctttcagggtgagattcctacctagaactcactatttccaccgctaaattcatatgataatttttagagaaatttatgacggagcaaaagtacaataaaaatatcacagtgcttattactgtgtaaccaatggacgaaggaataaacataattcctcaatgcattcgtcggttcctcgtggtgcttattactgtcgatggagaaagaaagaaaaaaaaatcctcgatgcattcagaccctgcttggatacaggcactaatttttacccccgtcggatggaatatttggatactaattaaaagtattaaacataaactaataataaaatatatttcataaccctggactaattcacgagaaaaatgtgttgagcctaattaatccatgattagtccatgtgatgctacagtaaacatatgctaattatagattaattagacttaaaaaatttgtctcacgaataagctctcatttatgtaattattttttattattaatctacatttaatacttctaattaatatccaaacatccgatatgacagggactaaattttagtccggatctaaacaccacctcaatcggctcctcgcggaagaaaactcgccacttaggcggagtaatctcgccggctgttgcgccaggaaactcgacgcccaccacccaacgctccttcaccctcgctgctcaccaaggaatgtcgctcgctgctcgctagtcctcctcccacgtcgctcactgcccaaattgacgccgccgccccaacactctatctgctcctttgtggctggtggagcagagctcggagccactggatctggggccagcgagctcactgccgccggatttggcggtggcgcctcttgcagccgtggaagaaagagaggagcagcggtggccggggaaagtggaggccatcactcatcgcccctcgtcttcctgccgccctattatttgctgcagtcgtcggacctcgtggccaacatatccagttcgttggagttcaagaaggagggcggcagtggcaggcgaggaagatggcggcggcagcgtcagagagtagaggaagacgatggcatggttgagcctcaccaaaccctcgtttttgctctttgagaaagtaatgacgaggggcgaaccgaccccgacgcccgtccgttgcacgtgtgggtgcagcctgttgcacgcgcctggccaggctgagttgtgaagctcgatttgagcgtttccgctcagcctggctgagttgctctttcactagctagtacttaaatgatttttctggacggggacacttataaacgattggaagatctgcatgcgaaaatcgattttgaccgcataagaaaatcgctatttatgcgtgcgggtggtacgcgaaaaatctgattttcacgtgcggggtggttatggccctgtttctttcagcttgggattattataatccagattattggaagtaagttgaaagaaacagacaacttattgaagtagcttattataatctggagcccagcttattataatctgataagctcatttaggtgagctttttccagattattgggtgaaaaattacccaccatgccaccccactctctctttagacttgcaaacccaataatctaggctctaataatctaggaaagaaacaactaactgcttattctactacagattataacaatctagcttatagtaatctaactcaataatctagattataataatcttaagctgaaagaaacaggccaatgtcgccgcatgcaaaaataaaaaaccaaaaaaaatccaaaaaaaccccttactcgcagtcgccgtcgtcgtcgccgtcacggtctctgtcgtcgctgtcgcggtcgtcgtcatcatcgcggtctccatcgtcgtcgccgttgctgtctccgtcgtcatcgccgtcgcggtctccgtcttcgccgtcaccttcgccgtcgtggtctccgccggatccgggcaggctactcgtgtttttgcatgggtggagccaggctgggaaggccgtgggacagctccattgtcgtcgtcgtctttcgtcatcaagcagcagaatagaccaatctcatcgtcggcctcttgcttcagcggcgccacggcctccttcggtgtcacctcgcgctccagccgtccgcgtggagacgagacctgcagcccttgccgctgcctgcgccaccccacacgaccccgtgtgggcgtgtggcatcgcgtcgactctccagacggtaccatcgcgaggcgacctgaccaaggcctacagcctgatcggatgggcaacgaagatgcatggttttgattcgtgtgcctccatggcgtgcatgcatggcttcatccaattagcgcgtcaggagacacgaaggagctgggacagtgctgctgccgttttttcttttttccctcttccgatgagagatcggtttgcgtcgcccacgccgccgttcggtttcaccgagatcaaggatgttgctgttttgctacaacgacattgtccgacatcactgtctaccggcatcaccaacgtcttcgcgccgtgatcaccatagtgtttttatttaagttctttttctttattttttttcttttggtcgtcgtgttttgttggcttttcgcatgcacccgcgcactctcgcacctggcaccacgatccctgccatgaaccgcaaccgcacactattatgtgacttgtgctgcatcgagatctgcaacgagtggctactacaactacgacaacttcatctccactacatcgactatggcacgtagggctatcatcgtgttgagtacccttaccagttttttctccagttcaactgaccgcgttgctcacgcttggactgtgggggatgttagagtatatggtagttagagtcatattaggataggattagtttatgtggactccttccatatctataatcctaccttatctcctcctcatatactcctatatataccagcccctgaggctcaatacaatctatccacgttatgcagtatatctctcctccctgtactatccaacacgactaacctttataaaaagtggtatcagagactagctagtccaacatctctggcctgaggaacatagtgtgtgaaggcttaatggaccgtggctgactgcgggaaacggtgaaggggcggtgagcagctaagggacaccaatgtatgaagggggatatatctcttgttgaatagtcccacattgattgtagaagggtaatggacctaatatataagtggggagcccctcacctcattggctagcttttgggatgggaaaggccctttacgatcctacaaattggtaccagagcctggctagtaccgatggttttggttctactaaggaagtacgtggagtagcacgatgcacagcacgatgcactgccccacgacgttgacgacgacacgcagcatccgaacgtaaaggagggatgagccatgatggacgaacagttagcagtcacacgaagcgcttcccgaaaactttattagcgcgttgttctggtgcggaacatcataagctagcgaaggttccgaagaactactctcccgatcagcggtgtactggatggcacacaaattatgcagcaaaacaaagccgtaaatgtaagccgtgtcatttgcaattttaaactgtttatgattttttttaaaaaaaatagaacttttatattgttatttcttttatgtttcccaattttatattttaaacaacaatataaaattttcagaaaaattaaaataaaatctcacagataggaaggtagtattagaacgatataaaagttctcaaaaacattttaaaaatctcagaaatagatgagataatattaaacaaccatgcaaagttctacgaataaacttaacttccatcactataaaagggtttttgcagacggctagatccagttttcgcatgtggttgacctgcccgtgtacgagaaaaggtctgaaaaaatcactattttcatatacgggtgcttatgtgagccgcatgcaaaaataaaaatccaaaataaaaaaatataatcagaaaaaaaatcacgccgtctacttccaccgccagccccccgtatggggccgggctcctcccgccgctgccgccggatccgtgcggggccgggtgagggagaaccaccgcccgccgtcgtgcccacccctgcggccacccgccggctgaagaggagaatatagtagaggaggtgcagagtataagaggtgagagagagacagaggggggtagaaggtaaggttcagtttgaaaatttttgaagtgttgagagggaaataggacacaagttagtcttctagcggctccttaagaggtccgtttgcgaaattgatttctgcatgcggatctcttaacgagctgcatgtccgcgtgcaaaaatcgatttttgcaagcgggcctcttaagaagtcgtatgtgaaaatggaagtcaatttttgcagacgcggtcagttatgatttatctacaatctaacaaggggctcgtctggaaaaatcattttttatagtgttcatttgtgagacataaaattgagaaacattaaaaaaataaaaataggagtattgttatttgttaattctatatcttattaacaaagttgattttgtttatacaattttatggggttatttatttacatattaccaacaagtgtgagttttttcagattttttgctaacttctgtacaaaaaaagttctcatgttttcacctaaggtatcatttacatcgtatatatacattcccagtatatagttacactcaagttacaatatcaaaagttatacatctcccatctatccccgccattaaccccacctatcagcacatcaggataacagcacaataatcaataatgcaaggtcacaacagtcaagactttaggaaggagacgagaatgacagttgtccaatctgtcacatgttcatttggtggatgcggtcgcgcatagtgcttcaatgtagatgctatcaagaatagcatccacaactcttcaatgtagatgctatcaactggatgctaagtacaacgacatccaccttattttcacaccttacaaatcactatatatcttaaaactcaacatgtaaacatacaacatcatctttcatcttaaaactcaacatgtaaactcaattactcttttcgtaaaaataacattttttacatgttttccaaaatatctacatggaaatctatgtatgttttgaaaagctggtagaaagcattaaattttggaactgaaggagtattatattttaaatataatacaatcatatcatatcatcttaaatttattatattatagagcttaaaagtgacggggctagacttttgactatggggtttagaggctttcaacttaagtagaacagttggtaaacattgacaatcattgatcaactaacaaactatggtaagtatttattgaagttcaaatataataaaactagaaaataccatgcgcgttgcggcaggatatttgggaaacaatcgtagctagtttgttgaatgacactttggggaaagaaaaataaaaaagcaaaggcaacctagaaggattaatatttttttacacatcagcacctctatatactaattaaggatgaacttctgcaaaatgattaactcacatgtgaaactactacccaagccaaagtttgtactactgtacatattgagttttctgcgattttctcaataggaacaaagaaatatgaaattaatatggaattgagccttaaaaaatagcaaaacttcatgggaatttcgagaaatttagaaggtctcactcaaatatttattggcaacagacccatgtaaattacaattagcacgttcattgcatactataaaattacagaggaggatcgtcttttttttttaaggatctgatgactgcaaagcctcggtacctcgcggtaccgcgtctccggagaggaggtaccgagagattttcgatggtgggagggtataactgtactttcgcatatcaaattggaggggaaacgccacctccatccaccgtgctaggcgctgtccccgctgcaaatcaagcaagaaactgatgcggtagatgcggcggcctcccaggcggttcgtggtccaatccctatcgctggctcgagtactacccgatctcctccctcctcctcgatgctagtacagtggaggcggcagccgtggtggcaggcgtcggctgcggagacctcttggatggcgggggcggtggtcaggtgacggcgtctacttcagggcaacctcagggaattgttgtggttatgcaaggaagagaggaggcggtcactgccctgccctgcatcatggtacgaagttgaggccaacagaagacaatagctccacgtctaggatgaggcgatggagagatgaatgttctgaatgattgaaaattcttgttgagactggagaggtgacactggtggagaaaccatctttcgtcggtcggccgatttccacaatagtcccggatgcaataaaaaccggggctaaagatgatctttagtcccggttcaaaagggtaacgggcgtatttgatctttagtcccggtttgtgttaccaaccgggactaaagatcatctttagtcccggttcgaatgctgtcagggcctgtcaggcccccccgggatctttagtcccgggttgtaacaccaaccgggactaaagatcgtaactttagtcccggttggnnnnnnncnnncgggncnnnngnnncnggnggggnnngncnggcncnggnggcnnnnngncccgggccnnnggnnnnncccccnccccgggncgcgccgcccccccgggggcgcngggcccggcccgcccgcgccccngnggggccgggcgccgggcccccccccggccccgggncgncnggcccccggccccccgcggcgcnccgccggccggcgncgggggcgccccnccccgggcccccccggcgggccngccggggggggcgcgcccccggccggccgcgggccggcccgcgcgccgcggccgcggcggcgggcgcgcgcgccccggcgcggcccccgggcgccgccccgcggcgcgcccnncgcggccggcccgcccgccgggcgccgcgcgccgggcgngccccccgggcccgccgcccgggcgcgccccggcccgccgcccgcggcgcgcccc

SEQ ID NO: 23 - DNA, 5525 bp, Oryza sativa
  unsure (1)..(5525): unsure at all n locations
ctggtgtcggcacttgtccggcgaacttccgggtaggggagacggtcctggtgaggttcaatagagcctanaggagtctcaagggtgctacgcccaaaagctagcgggccctggagcggtggcgccaccatgcggctgggaggcgacggaaagagaggcgacacccgagaggcggtggcgtcgattgttcaacctatagattggatgggtacagatagcgaaaaggcagtactcggcatggggaatccaattttaccttcaatgtcaaagcatcggcgatggatgccgcgagttcggagctcaacataatcgccggtattagggcctgcggattcttccccgcgtcctccagttaagtcacgggagtagggacggttttgaatagttgaaaaagcttgtaaaggcgcttcaggtgcctccggtctagagcctttcagtggacggtcgaaggaattccgaggttgtaacgtggacgtttcacgccggcattcgataggcgctcaactccgggagagctagggcagcggtggtgtgtgatagggagtcccggattgtgtcgccagcccgcctaagaggtcatcattagtggccgtaagaaagctgacgcgggctgtcaggggcctggcgcatcctaagtggcggttgtcaacaccaaacgggactaaagctcgtaaccttagtcccggttggtaataccaaccgggactaaagatcccggtgatctttagccccggttggtattaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcttccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaagtttttataaaatagttgagaagaaaaactctagtgaaagttaatattaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtttgttggatttgaaggaaatcaaacgggcgaggaggaaatagctgctgatggtaacgacgttgcagatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgaagacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcataatccttttgaagagatgaccancggccatagcacttggccggtacgattgtgtatctacaacctccccccctggctatgcatgaagagaaagtacataatgatgccgattattattcaaggccccaagcaacctggtaacgacatcgacgtgtacctaagaccactggtcgaagatcttaaacagctgtggaagaaggaaggtatccccgtgtgggacgaggacaaacaggaggagtttaacctacgagcgctgctgttcgtaaccatcaacgattggcctgcacttagcaacctatccggacagtccaacaaggggtacaaggcttgcactcactgtatggaggaaacagaaagtacgtatcttaagcactgtaggaaggttgtatacatgggtcaccgtcgattccttgcagcaaaccacccggtacggaagaaaggcaagcacttcgaacataaggccgaccaccgtacaaagcctaaacatcgcagcgggaaaacagtgtttgctatggttaaagatcttaaagtagtgtttggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagtaatagaagttcacaaacctaaagtctcatgactgtcacgtgttgatgacacaactgctaccagttgtaataaggggtatccttccagacaatgtccgggcaacaataacaaagcaatgtgcattcatgaacgcaatttcgcagaaggtcatcgatccggatagattagatgcccttcagaatgaagtggtgcaatgtctcgtcagttttgagttgatatttccaccttcatttttcaatataatgacgcatctgctttgtcaccttgtgaaagagatccgtattctcggtcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaattatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgacttgtggaggcgtaatgattgatgacagtgggatgacaaactgtgaccttaacaaggntgggatactcgacgaaccttttgtcctttgcaatgatgtaacgcaggtctttttcgtgaaggacatgtctagcnaaagaaaagaaggccagaggcctgatgagcctaagcgtcaagtgggtcttccaagccaaaagaaaatcgtcggagttgaggacaagactggacaggatcacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataatggactagaggatttttaaaagttttaaaccacgcaagtggcaatttcatatgttaattacagttttttaacatttaatttactatcattcatatgctaattataattgactggagaatttctaatgtattaaatttaatatatatttaaaactatcattcatatattagagtttttcacaatttaatttactatctttcatatgctacttatatatatatgactattcgaatttttacaaggtttaaatcatgcatgtggcattggcatatgttaattagagtttttagcatttaatttaatataattcctacgctaagtatatatgatgatcacaatctttattcattttaaatcatgcagtatgtacatacatatcttaattagagtttgtaccaatataataatatcattcatatatatgctaagtgtatatatacattggaatttttattaattataagtcatatatttgctcattacgatttatccacttaatttattgcagacaaaaataatttttcgaagtaattgtcattaatctttgtactttaaatgttaatgcattaacttctattttataaacacatatgtaagcgaaaatcatatgcagtgctgtaatctttagtcccggttcttaaccctaaccgggtttaaaaagaatttcgaaatagcgggaaaagatatttactcccggttggtgagaacaaccgggactnnnnnnnnnnnnnnnnnnnnnnnnnnnnnnnnnnnnnnnnnnnnnnn

SEQ ID NO: 24 - DNA, 1886 bp, Oryza sativa
cccaattggaggaatattttaaaagcatttgggtcccaacattttacttccgagacgggtttcttccccccgaaatggattgtaccaatatatttcccttttcgcggccaacatatggttaaaacaaggacattttgttaagtcgcgacacttttatgtttacacaatataagcagtgtaactaaaggtgaaagtgtggaccataacaccaatacgaaccctggggtgtaaagtaaaatcccaaaccgggatataggttaagtctgtgtacggattatccccaacccacgcaagtaaataataccatattatgtctaatgccaaataaagtattcttatattaaaactcaaataatataacatgctaagcctaaattagtcatctatgctaagtgtttcatgcgtatatgctaagtctaattaatactacaatagtcaattgctccttgtcgcactaattccgttgtcaataattatacatactaagtctaattacaaataaagtattctcatattaaaactcaaataatattacatgctaagactaaaatagtcatctatgctaagtgtttcgtgcgtatatgctaagtctaattaatactacaatagtcaattgctacttgtcgcactaattccgttgtcaataattatacatactaagtctaattacaaataaagtaatcttatattaaaactcaaataatattacatgctaagactaaaatagtcatctatgctaagtgtttcgtgcgtatatgctaagtctaattaatactacaatagtcaattgctacttgtcgcactaattccgttgtcaataattatacatactaagtctaattacaaataaagtaatcttatattaaaactcaaataatattacatgctaagactaaaatagtcatgtctgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattagaacactacacaatcttatatgataagtctaattacaggtctaataatcttaattaattgcattacaaatataacaatcatttatattattacgtcacttgcctgcgccaattccttctagggctagctcttccactcaggcttgacggacgactccgacaacacgtcttttctgcaagatacaaaaagatgtattaggataaatgcgaagtaacatatacatatacatatacatatatatatatatatatatatatatatatatatatatatatatatattgcatttcacgttaacgttcgtcctcgttctcggtcgctcgttctcggtcgcttgttctcatacacgttcgttccctcgttctcacttgtcttgggtcgatcgttctcgttatcgcctctagttcggttagatcggttatcgatcctcgttcacggttttcgcggcaacagtacaggtgaccgagttcggtcttcgcttacggacggtcgaacgggtatcgatctcgatcacgttctcgcggcaacgtacattggaggggtcgttgtcggtctcggtcgatcgatcggtctcgagctcgatcacggtatggggggaacgtacggtgacggcgcgtcttagctttcgttcggtcgaacgttaatggttctggtacgttaaacggggatggggtgaacttccgcgcggcaggtggccccagcggacgtgcagggtgaaggaggagtggcacacagccgttgcgtacggaggtatgatatgagaacaggcgtggaccatagcagacgggtaggagaactgtagtgggaatatggccggagaggacaacgctacg

SEQ ID NO: 25 - DNA, 1252 bp, Oryza sativa
  unsure (1)..(1252): unsure at all n locations
acaacggaagattagggcgcgacccaagggcttgacggcaggcacgagctagacacaaagcccttatcttaaagaggctcctcatttggctgtgggaaaattaagcaagactgagtacaaccccggtactcaccaagacacacccccaaatgcagaataaatgcaagggagttcaaaggaataataacatagaggggttagggttgcagtaaacagcatttaaagacatttagttgctcaaggccattttgtaaacacgatcctagaactaaacaatattattaatcaaggccgtgaacccacacgaacctgccttaacccaaggcctatgatgattcagaccgaactggcaacccgaccctgggtcccagctcgtcctaagccaacccaggccaaccattccacattttagttgttgagcaaaattttaagaattataacactgacttgggtacattgctcggcttgcccatatccgagggctcggctattcgaatagatttactctgatcagaggtgtacatctttacccacaagacacatcttcctcacgtgttgccacgtgccacataccaccacggtatacggacggaagatgtgacatagtttccaacccatcctagccttagacaagagtaccgacccaattccgcctacggccggaacccccgggacaggcagacggaactgagcccctagcattgggcaccaaccctccgccgtatgacatctcgactaccgggccgcagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgagctttagtccttataggggccggggtgctactttccacaactggcatgcacccaaaccccaaccgaaaacaggttttaagggttttgaaagaggaagagaggtgtgtgtccacttccaacataagccaaccattccatggtgtccaaatgatatgagaatttcccaagtctaaagttataaaaccacctaatgttgcctaattaatcagcgaagcatctacctaaattcatactagtggaaccatgaatagagtgtccactagttggggttttgtttattctagggtgaacaaggtataanntatacaattacaattattatatggtcataacacaggtaaatag

SEQ ID NO: 26 - DNA, 746 bp, Oryza sativa
  unsure (1)..(746): unsure at all n locations
cgcgtggtttgnattagtannnnnnnnnnnnnnnnnnnnnnnnnnnnnnctttttcccctaaaccccaggacagagagaaaaagggggcctctaactccaagttaagctccagtcgaaaggtcttcacatagtaatgtttttgcttaattaaacgcagattttacattagtttccggtagcatgtctttaagctactaaacaatatgtttcataaaaaactttctatatagaagtcgctataaaatacagatataataattaaaacttaactaatcatgtgtattaatagctttcttgtttacgtaatttccgtctttatttctctttagataatggaaacttccatcttcatatttggtgcttctgacatactatttttcttctgcacaagatgcaaaagtcaatataaactcgctggctgaagaattggagcaatgcaaatatgttcttgttttgagcttgttcacgacctgtatgctcactgttaaggttgatatacaatttactagtaaaaaacagagagtccttttctttcttctgaattttcacttgaaattactagtgtacaactgtacatcaacaatgtgaatgctaactgagcgtgaaatgccatatactcctatcttttaccattcgtcactaataaaaatatttcgacagacaatgggaaatagtatgcaagagaaagagggaaatcgtttgttttttatgaaactgggacatagtatgttattgtacgcataan

SEQ ID NO: 27 - DNA, 746 bp, Oryza sativa
gtgggtttgttgtacttgctcctactcgatggtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatcttcacctttcattagatccctattt

SEQ ID NO: 28 - DNA, 704 bp, Oryza sativa
  unsure (1)..(704): unsure at all n locations
ngatgtcgcgtggcaacttcatgctgaccgtgagtcccaaaaagtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccactgcagtgtagctcaccccaaattttccatc

SEQ ID NO: 29 - DNA, 5616 bp, Oryza sativa
  unsure (1)..(5616): unsure at all n locations
cgtggcccnnntttgagtagcttgcnnnnnnnnnnnnnnnnnnnnnnnctgtcctgtaaatgggcctttatgagcctccaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaattctgcgtatttggaccaattcaaggtgaaaaaaggggttgctccttcggcaaaactaggataaagttgagccaaaaggtcgcgattcaagataaattcatgaggaagtggtatctccttaggatcaaccccagcgtcaagaaattggttaatcggtaaagatacatggatttggtgccccgcccaagaaagagacccaagtcctaataaccctgctaagtgatgattcaacatggattctacgtcttggaaccaggctaatttgggagcggctttgtgataatggaaccacccagcaaaaagcattaacgatgcaaaaatcaatgcaccgattgcggtacaatagagttgtaattcactagttattccggatgctcgccaaatctgaaaaaacccggaggttatttggattcctcggaaacccccgcctacatcaccattcaatatttcttgccctacgattggccaaactacctgagcactgggtccaatgtgagtaggatcacttagccatgcttcataattggaaaaacgggcaccatggaagtacatgccactcaaccaaagaaagataatggagagttgaccgaaatgagcactaaagacttttcgagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctacatatgcgagctggcagttgacctgaccatgcagatggcctacggcgtacgtgtttgttcatgcaatgcaacacgtacgtaatgagctagttaataacgtcgacgtcgtcgtagactcgaaagtgtgggtggtaattaacaaattaaattagtgtgagcaacgtagtaagtaagattacctgcacatgacatgatgagacaacacgcggtttctatatatcatattctgttttactcccaaagcaatgcaaaaaaataattataagtgctaattaagctagggaaattaaggcgttcaaccgatcgagagcagagcactacactatatactcctactccacatagttagcttagctatacctgcaagtgtactgcattactaattataattactttcactgccttaggtagacgaccgaaagaaaggaaggcgttgtcaactgggttgctgacccatcacgaacgcattaatttcatggtcaacgccccccagcaatttgttccttatagctaagctagctagccacttaattaagaagacacagctgctgcattcgtcgtatatatatatcgatagatcactagctagctaattgagcataaccaaccatatatagtgttgttagtatacttgatcaaattaattaagcttttttccccttgattgatcgatcgaaagagtaccgcgaatcgatcaataatcagattcaatggcagcgccgcggtgggcggcgttcatggcggcggcggcgacggtgctggtggtgtgctcgacggcgttggcgtccgccgcgactccgccgaagccgagcagcatggtggtgatcactccgacgaagcagggaggagtggggaagcgaaacagcgcgttcacgtgcgaggacacccggcggcggcggcccaagtgcatggcgacgtgccccgaccggtgccggaccaagtgcctggtcctctgccccacctgcaagaccttctgcctctgcgacttctacccgggcgtctcctgcggcgacccccgcttcaccggcggcgacggcaacaacttctacttccacggcaagaaggaccgcgacttctgcctcctctcagacgccgccctccacgtcaacgcccatttcatcggcaagcgcaacgccgccatgtcccgcgaacttcacctggatacaggcgctcggcgtcctgttcggcgaccgccaccaccgcctcgccctcgccgccgcccgcgccgcgcgctgggaccccgccgccgaccacctcgagctcactttcgacgacgaccgcgtcgacttgcctcgccacgacggcgcgcgctggtcgccgccgggagccccggcgctgtccgtgacgcgcaccgcgccggccaatggcgtggtggtgaagctccggggcgtgttccgcatcgtggccagcgcggtgcccatcacgcgggaggagtcgcgcgcccacaactacggcgtcgccgacgacgactgcctcgtccacctcgacctcggcttcaagttcgaggcgctcaccgacgacgtccatggcgtgctcggccagacctaccgctccgactacgtcaacaccctcaacgtcacctccaacatgcccgtcatgggcggcgccgccaacttcctcaccaccgggctcttcgccaccgactgcgccgtcgctcgctttgccaaacctgccacggccgccgccgccggcgccggcatctccttggtcaccgacgccaagtacgtgtagacacacgaggagacggtcgctcgctcgcgacaattaatgtataatacgtaattacgtatacgtacgtacgtacacaaaattaactgtcttgctgtcgccagtatacgaataattaacacatctactactactaccaaggtatttgttgtattgacaattatatttaattgaaatatcgaggaataataattttgatttgtttgcaagtactaccagctagcactactccctttcgtacgaaaacaatacagttttacagtttgacgtttgacaattcgtcttatttaaaatttttttataattagtatttttgttgttattagatgataaaatgtgactatcattttttattttttcataattttttaacaaaacagatggtgttgaatacgaatactcactgctgtacttattgtataatggagatgtatttacgtacatgtttaaaaaatagcttgtaagaattccctctttctgctaatctgatttcgttaagaattcattcattcatttttaaaaagcaatttactactactaccacctctcagaaaaagaaaaaggaaaaaacaaaaaaaaagctgtaataattcgcaagctaccgtcattgaccgaggaggcgccgaaagttgactctgtgcgatttcttcttcttcgtgttgttgcattgcaattgcaccccacccccatctccccctctcgcctcgcgcgagatcaatcgagaccccgccggcgaatccctcggcggagcggtgcagcgccttcgactccgtcttcgcgcgattaattccggcaaccggggagtacttcgaccgcgctcgccgcatttcatgccctaggaggctgccgtctcggccccccatggtcggaaccctgcgcgaccccagcgccgggtcgggcggcgaagcggcgcccactcctcctcctcctcccgtggccgcgcccttcgcccagtacctctcgctggaacctcttggctgggtggagcccaagcactcgcgccacggcgagctcaggagggcgctccagcaccaggcggacgacaagccccaagagctcaggcggatccgctccagcgtagccgactcctcctccaaggccaggtactccaaaccctcctccacattgcaatcccctctcaattcctcaattttgccagacacagtgtacacagtgtcagttaattcgactcgattttaatttgtggtggtgttgcatcgagtcgagtagggagaaggtgaggtcaatgcaggaggcggtgcagaaggtggacaggtgcaggaacgtgctcaatcggaagcgccagaggagtgagcctgctgctgctgctgctgctggggctgaaaagccctctggttccggtgcactcaggattggagcccagaacagcaactcttctgcggtcatgagcaagcgtgtccgctcctcgctggcggatggacgggttcgtgtgctttctccattgctcgcgtcgccatctctgtttaactctactatacattaattgtgcttgctccaatcaaaatcatgtattacattggggtagtcgtagtcactgtgtgagtttgggggtattcaaaaccaccgtaagctcatcaactacttgcatgtctggcgagcgcgattccgtgacctgagcgtcgcatgttagcagttggtgcaaatgggttggatggaaaccagaaccaacagccctatcttgtattgattccccttggagtttgaaatgtggggtgtcaacattggtttggtttgataatcctgaatgtctttactcacttatggcctcaacgtattgttttcaatttgcaacaatattagatgtaatgtataggttgagttcactatggtagtctttacagtcctgatcttccttataatgtgtagcttaaacatgtagtaccttttgttctgctaaagtgctgaactgctagtccctggcttcgtgccatctgcactgccctaccattattcttggttatttagtggtggaaatcatttaaattccagttaactttattagttgagatattgaatgatgggatgattgcataataaaccacacagttatcccagaagaccatacagtacaagggtgtgcaggcggtgattgtgctttaattcaccactgaataacctatatttgctatcagaccttgaatctctctgactaatttaatcattacataattcacacacagtcctcaaacttgaaccaaaccgcaaacttgctagtttcctaagggtaggcttggtctgtgaataatgggttcctggcactgactgaacaaatatatctgatatttttaattactgtggcccagcacatttcagtgccagaagacatctaaaacctcaagttctaaaagacacttgttgtcttctgcattttatacaacttctataatagattatttccatgtatccatattccctgtgacacgatttgccatttttcagaacttatttcattatatgtgtgatgaactgcttgcagtcaancgagaagcaaatcaaanntnancccacg

SEQ ID NO: 30 - DNA, 26295 bp, Oryza sativa
  unsure (1)..(26295): unsure at all n locations
ggacgaatactggttacagtgtattgtaatgtgcgtatgtaactctgtgtgaattataggacgatcgtatatagttgttatgtctcatatattctttatcagaatttaatnnntttnnnnnnnnaagtgtggnnnattgattgtcantcgtacagtacntcatcaaagnttttttttttgtgacagaccagccatgttcaactttctctcaggcgattagtctaattgaataccaaacttaagctcaatagtctggaaattactcacaaataattaggtgaatgagttctctactaattgagcggtagtacactgaattgaatagggaacggggctgacatgcactacattgttaagtcaaacattggttctattactatatatatgcccctcatcagaagactggttttgagattttatttttgacctctaccttgggctgatctgctgtttattttgtttggcccatgtagattgtattaagctgcaattgaatatatgctgtttatgtttccacttttaatcctcttccagaactatatgtggttatttgatctgttccagcttattgtctctactcacccttctttatccttacattgcagacatggagcatctgccgtagaatatgcaggtagcaggatggatggaagttctcagcagaatagcaactcatcccgtattctatgcaagacagatatggatcatgccactctgccaaatgaaagaagagagcggtatgttggaattgaaaaggagcggggtatggtaaaaggaaacaggtaagcacagttcattacttcattctggcgtatacccatagaattcctctcctcatagtttacaattattgttttttatatatgtgtgaatgagcagtacaatgctatcattgttctaatgatctgctaactctacatgtatagagcacaagcttctgaagatatgcaaactggaagcatcagtcctttgcccaaggctaaagcatgcagggcaccgagaaccggttcacacggcatgggttcagcttctagtttccaacgttcaactggaggaagcgacgaatgggaagaaataccatactcaaataaagcatcacttttgggaggcatgacaaaccgcaaacgttccatacattcaaatgcttcttcacctcctattgcttgggtcggtcaacgtccacagaaaatgtcacggacaagacgagcaaacgttgtttctccggtctcaaattttgatgaagtcctatctgaaggatcaccacttgatacagctattgctgctaaaccaacatctacagagtcctgcggtgttgtgcttacaaaaaagggaactagtagcaatacacaaatggcaaacacaatgaatgatatcccttctcctgttggattgtcagaaagtgagggatcagctgttaaagaacgcaaggtcaaggagaaagctacaaacaatggtgaggtggagaacgaggctgcaaatctagtccgtaattcagcaggatcaatagtttcatcaaacaaaaatacgattcctttgaaagaagagcttcaagatggtggtgtccgtcgtcaagggaggagtggcagaggtactatgcatgttaaagagtactcttcctcttccatatcgaaagaaaaattagatgctgcagagacaagaaagccaaacaaaggtgggcgacctggatctgaaaagaatgaaaggtactcatgcttccttttggtaagggttggcaacttgctgcattttactttcgatgtagaactgatttgattctttaaacgtctgtacagtaaggtggggcgtcccacaatgaagaaaggttctgatcaaaacaatttgtcatgtttccctcaggctcttaattgtgagtctagacatctaaagattttctgaaacgcttatctatgtactttggccgtttacattaaattttggcattagcttatatatcttactaactagtggtgcaatgcaggtgaacacacagatgaccgagaagaacttttagctgctgtaaatgctgctcgcggcgctattggtgtgtatacagtcttatctgatttttgcctgatgaactttgtcagcatctctttggattgacactttatacctttcttattcccttttttttgtgcagttggtgcatattgtggcccattttggaagaaaatggaacccatgctaactttcataagctctgaaaatttgtctttcttaaaaaaacaggttggtacccagtatgcttctgatgtgtcatgatgattgactacttatttccttgttggattgggatggattctcacttattgagagtttgtggacagattgacattgttgaagagcttgatttgggcatgtcttgcgtgcctgatggtgaatatgttttagcacccaccaattacagcaggcagcaaacgacggtatgttactttttgtgccattagctatttgaagagagggaaatctttccctcctttcatgcaattcatctctcatggagtgtgtatccttacatcgcatgtcccaaaaatctgcaggagttttcatgtcaggagctagttccatctaattcgtctatcttacctgagcaaagcgaaaccaatggagttggattaaaaggaactattgactgtttttctcctagtgaggaaaaccaacaccatgtaccacaaaagatagaagctgacaaatggtttcatgagatggtcccaatggaacacagactcctttcagctatagttatggaagaggacatctcggaacccaatgttgtacaaagggatatactttttgaattttctaatagccatgttccttgcgctgcaagcagattcttaggaaatgaacttcaggctagtgccatatcatctaattttggattgagtgttgatttcatgaactcaaacaattcttcggttgtacatcaaagcctgagcaatgggttcacatcttccagcagtttcatcagttcaagtagtcaaagttcagtccataatgataatttgtctgatgaagtcaatttcgtataccctgaaaatggcccttttgataacttgataccgcagacttcttcactacgtcaaaagccaggaaaaaacttctcttcatctccacatgaataccaatatggacagatgtctgtgaatgataagattttcatcgagcttcaaagtattggcattttcccggaggcagtggtatggttacttaaaactctgcatttctggggaaagtatctgcatcgcaatacttcagttctgctttctgcagttcttttaagtctgtatgccaaaatttcaggaaacttgttaaaatttaaaagtagcaactttgtaattgacaaaattttagcaactttgatggtgattatagtttttctctttctttaatgttgcatctatttaccctgccatccttccttatgtggtttatgcatagaattattttttgtcggacagtgtgaatctcatcatgagcaagataaaggttaaagtgggaagctgtgctatatggttgttatttgtcatagtttaaggaatcttgtaaagtagccatcaacactgatgatttctgaatgatattcagttctttatcagttaagcctaaacattggtagtcacagtatgcagtcactatactctgttagttatccatgaaaaagaatctataggattgtatttagtgcacaagtgttatttatttctggtgactaatgtcattttctgttgcattctttgtaaaatcttttcacaggatgttgaagtttatgtaattacctagtaaattcctattgtgattcttgtcttatcttgcaaatactacccttttcagccaaagctagatgatggagaggacaataacatcaataaaatgatttcagagttgaggaaaaggctgcatgatcaggttacatcaacaaccactcctagtattatgtcctcaactctaattatatctggatgcttaccttattactcttatactcatctattattttacaatgattgcgttagatccttgtaaaatgtaaaccatcaaaatatttgtcatattactgaaacttgttttgttctaaggacttcttttccaaaatatttcttgaaacacgtggacaatttgtgaagttggcttgcccatcttgtatcaacatgtgctagaagtataggagccatgaaaattatgcattaagtgacatcaattggcatgggaaaatatagattgagaatgtgccatcgattattttctgggataactatcagatgttatttgaatgccatcgtactttgattaattcctgcttgtaatgctggtagcgtcacagccgcttgaccagattggaatagtatatatcaaggtgacaaggtaggctgccagatcactataagatgaaagggtatatatgcaaagtggaataattcaaataagtcatttaaaaaattccaatgactggctctaagccagtaaaccttctagatttaagccagtaaaccttctagattcaacctactggctaaggccgatgatccttgttatcctgttttgagatcagttcatgtattactatattctggaagattaaaatacttttatgattttcactttacctcttatttatgtatatcaaaatggtaccattgcaggtgaagcaaaagaaatgtaaattaagtaagttagagaaagcaattcaagatacaaaaagtatcgaggagaggtatggattttatgttcttggattagatcttagaggcttagtgcattgagttgcttcactggctaacattaagattttctgtcaggagcttggagcaacatgcaatgaataaattggttgaaagggcataccgaaaacttaaggtagtataaacttatctctacatgattggtttttcaatgttatgttggactacttgttcttctaaaatccaagttcccttaatagttatgcaaagttaatcagttgagtcatagatatttttttatttctttattaatccttgtgaggtcaacccatgttgatgatgccttctaattgcaatatttttgttccagcaaaaagaaagggtaatgcagatgaaaactgtttgacttggacactgactgtatctttatgaattgtagggtgggcgaactggttctagtcacaaggctggtgctagtaagtctgccagcaaggctgcaaaacagcttgctttggattttgccaagcgtactctcttgcggtgccaaaaatttgaggaaacaaagaaaagctgcttcagtgagccttccctttggagtgttctatctgcgcccttgccaagcagcggcacaaaatctacagaaggtaatacatgtgcaactttgataagagagattagtatgcatttttttctgcccaatcaaatataatttcatgccttctttcgttctggtattaaggcgtagagagactgaagcatcaaaagcaagacagaagtactttaaatcatggtaattcttacgctccttgttagggccctaggggaatcatgagggaaaatttacaaggtgctatttgcagtactagaagtccactcgtgcttcataaactaatcaatttgtcctttatccgtttttaggtggcacaaaatggaacaagtgtgatagggaaagggaacacagcagagatgcatctgccaagggttctggtacgaagtcagggcgtcattcatcaggcagtgggaggagtggtgaacgtaaaaacaagacaaagccgaagcaaaagatagtacagctattatcgacttctggaaatgttcttgatagagctgtggagtcggttccaacaccggcaatgcaggagccccctcgaccgtcagttcctctgggtgcaaaaattacccagcaaccaaggaaccatcctgagaatgctgcttcacgattgccggaggctcccctgaccaatttgcctggattatttgatatatttgctggaacagaagggcttggcgaacagggcaacgatatcagttcttggcttactgatgatcttgatgtaccacaagactttgatctttcaggcgccttagaaatcccactggacgacattgctgagctgggttttatgtaagtaaggaaacgaaccaattgttctttatcctgcgccgtgaatatgtggggagtttggacatgatgttagtaggtttaccctacctaatgggtataagtagagttaaccgattgttttctctgcctcaatctggcaagagctttaagtgtttaactaggttggtcggtcgttttttatctcattgaactgttgatagccgctaggtaaacttattggcagaagaagacgaggtattctattgattcctcgtgattgtgctgagtttatcaacttgtgaatatgaatgagcttggttcgttgccaattggaaagaagaatcgttcttgtaatcaatgtgacttatgtgcataacaattttccttctatctaagttgtctcggtagcacgcaagtttggtaggaaaataaaaataagctgcgtacacacgtaaaggtaccgcaaagttatttgcaattaaagcaacaacgccttccttttcttttgtcattagctttgctggacacgcaaatagttctaagcaccacaccattatctaatctaatttataaaataaaaaaagtgaactgggtccatagctcagtagcactatacagtataaataaaatacaatcagtactaacagcaattgggtccatagctcagtggtagagcaattgactgcagatcaataggtctccggttcgaacccggatgggcccttatatagttgtcttttttaaaattttccaaattcaacattgatgtttagatatatcaattttttagttatctaattatttggttttaagtaaacttcaaacattcctcttttttgaacttcaaacacttctaacattcaatttttggtccaaaataacacccaaaatttgtaccagaatatgacaacttctttaattacctttatttttgcttttttgaacttcaaacatctaattattttttagctaaataggaaactccatttaccttaaaatacaacttacagcatatagaatttgtctagcaacttctccacggactttctcatctaatcatcttgaaaatcacaaaaatctcacatttaatttattcttttactttatcatcacaaccataaattttagttctcttttaatctccatcaaaaacttcaaaaatgcttacattgtagggcagatggagtaggaaacaaacaacatgtaaaattaatttagaaatacacaaatatatgcgctcacaatatacgcatattcacccctatgaatacacaccttactcctacgggcactttcaaaagactagaccaacatatgtcaagattaacgaagtcactaaagatacctcactgtttgtgggtatatcacctaacactaaaagaaacagcaataaatacaagcattcttttcaaggacttaaatcccggtggacaggttccattataagtaagctaatcagttgaattatactcacttcgtatgaaaactcaattagaacttcaaattcaaaggctgcacaatacgagtaggagtatggctataaaacactcaagtttctaacgtgttttaacagtaaaaatcatcttttgttgttcttctgtcatgcagaaactttagtcaatccagttttttataaaccatttaaaataattcttatatgcagtaagccagcaaagacagtttggccgagtggtctaaggcgccagatttaggctctggtccgaaagggcgtgggttcaaatcccacagctgtcattttttttccttttttgctattattcttgctttaattttctttttcacaaatgttatgaatctcccagaacagtaattcctcctttcgcaactattcttgcttttattttatttttcacaaatgttatgaatctcccataacaataatcaattacaaacatttttcaaaaatattacggatctccaagagcaataatttattacacaggcattcatgaggaaccagcattgtaaagacaaacaaacccaaagcttgaagaatcgataacgcagttgcaagaaggggacaagaagcagcagtctgatactctgatacaacttcaaacccaatattcaagaatcactaggcatttacatgcaatattttcatacattatatgccataacttgatggcagcaagaaggaagccacattattacttatcgaattaatattaacaatgccggaagatctgtactgtactatcaccttatcatttattatctacttaaaaacaaataccacatctctctatgctcatccctgcaactcccatcacctacctccgtatgaactaaactacaaatgccatgttctacgccaaattgtcgacaaggtcttttttttttctttcttcaaagacaatgagactgaaaacctgtacttttcactcacaacagctgctttgcaattgtacacacttctagacagcctgacatcaacaagcagcagcaggccagcagctgggactgggaagccgaatgccgagaaatgcgaaccggtcagacaaatcattggtggatctcgcatagctcccagtttccttctccgtcgatgagtttcagctccaaggaatggaaggggatcaaagctggcctctgcaaacaacagggtaaggattcagcaacactaaaagctaaggtgtctggtagctagcatagattcagccattcattcaggatggacaagcttcagtgctacagtggactaatgtttgctaccaacaatcatgatgatcacagcaggtcattatcacaagaatcatgtcaatacttacttgcgaggaagtaatcacagtgatgcccatgctagttgctagcttgtacaaatgctcttcaacatcaacgcttgtagcactgcaatgaagtatcttttaggaaccgcactaatttatcagcaaataaagagaagaaatgtcaatcaaagtcatggctcagcacatacttcgtgcattcgtcaagaataccaaatttaggatggtggaaaaacaaacgggcctgcaagaaaacagcagctccaacttcaataaaaagggatttaagcggcaactggtcatcgcaattaacagactgaaacagagtttacactgaccatcccaagcctctgctgttctcccaacgataaaacatcttcccagtttgaagttgagtcccatccttctctttctagaagatagaccaaccgaacattcactagaattgtcttcaggtgatcatccagcagattagaagcactagacccgttacctggattgccgttgagtttccgtatcattgtaaatagaacaatacaaggttgaaatatacagttgttatttattcaacaccagatattccaataggtaagtgacacctaccatcattgtataacgaacaaatcttcatctctgcttcctcccttgagagagggtatatgatctgatctctcagagtacccaagctggtatatggacgctgaggaacatgaaacatcccatctgaaggtttggtaactctcccagaacacactggccataaatctctcagaactctgaaaatagagctctttccactaccgttggggcctgcaggaaccaaggtaaaaagaaaaaaaaatgtcagcataccgttactactcaattaaaggtattcaaaggttgccagaagaaaggccacataccagtcagaagaaggcttttcccttgtaccacattgcacgacagcttgctagccaacagtttctgcgatggtgttacaatatccacttcgtgaaatgaaatggtttcttctgcactagtggcatcggaaggcacaaaagtatctagggaaacaacagttcgaaagtcaatacttagctaccatgaatagatataatgaaagctcaaaaagtgagcatatcatcagttgattgataacgttatgaacatgaaattgtcattcaaccgaatcagacaggttgtttcacagcacttatagactcctcaagaaaagccatgtcataggataatgtaatagatctttaaggaaaacaggggcataccatagaatagcctcactagaagattatctattgccctgtaaggttgtaatgctactattgaaatgcatgatcactgtaccctactatgtatgaagtactggaaaagaatgctttcaccaagaaattaaagaaaaaattaatgaagtcatagccatctgaaatatacccctttgagatacacgaagaagctcctcaagctcaaaaatccggttaatcccaccagaaagttcaaggaactttttgtgtaagtcaagaatgtcaccaaaggctatgaaactttgtgacacaacagatgccaagaaccgcagagcatgtgccaactctcctgttgtacaaaataaaagtagaatatttagtgtagttcaagatgaaataatgtggttgtgccaactcccctcgagttttgatgattattaaccttgagttgaagtcaaagctctgtcacccttgtgctctagagcatataacaaactaagaccccatgttacattgtgagggagttgctttgttacaaaatcatcaacaataccataaagccactgctttctcaacagaatctttgagtggtcaagcaatttcatgaatttagcctcaacaatctgatatatgagaataaatcattagcagaaaaactatagttcatcatatctaacaaaatagtgcagaaaacactattgaaaagaaaaataaaaaaccaaaaagtctagctaagtaaaaacttgaaagaacaaaaggtaacgtacaccattgtatcatattatggagtcagcaagtcaattgatactttatggaacacagcatgtaaaataacaaagcataaagcatacaaacaacaaaggatgccttatgaatgttcttgtcttagggtgcaatagctatgtgttagcttctcctaaaagctaacttctgaagatttgttttgataaaaaggattcaataaatgcaagaacaatgggtcataacagggaagctgcattaaaaaacagaaacaggaatcatagtttatttcattacctagaatataaacaagtcaaacagaacagcacaaacttaataactggatatatctaaagaagccaactattaaaatataaacaagacatcatggttaatatatatcgttgttaagtatgaaatacggaactggcattgaattacccattgttattcatgattcacaataaaataatataaccagaagacagataacaaatacaatggcaagcaggcataaacaaattttaagtattatgtatctagtgtgaaggaactcacagctttctctcttgatccaccaccaaagaaagcaattgattcagcatgcgttcgcagtctcgagtgcatgaaccttgtaacatagttcaccaggttaaaactaggaaactagaaaaatcagcaaagcagtcaggtctgcaaagacgaaagaaagtatgcagtattaacctgaaagttccttcaagctcttgttcttgcccagcaagatgaccaaagtctggggatacagctctcaggaagcccaaacctagcagcatgtaagcatacaagatagcaactcctcttcgcccagacaaaagcttcattctccatgtaaacctagtaaatttgttttgatttttatattacagtgagtttttagatatgatagatatgtaccaagtgaaacaaagtatagatatgaatgcttgataccaaagataactcaccaaagaatgtcgacaagtggttttaccattccagtaactaagccagcaaggtcggtggtcaatttatccacatcaagtgttaatctttggtctgcatcaatacttttacctgacatgttgaatacctaaaagcatataatagaataacttagcctgagtcaaaaatcccttagtattacatctgttgcaatatgcattttcattcttaaactctaaaacccaggtccactgcacaccaaactaaaacaaggtgcgaacatagcaagtgttgagacatcaagtgacaaacgcactgtctaaacctcataaaaggggccaagtccggcggacaacccttcctaatgtttaaagaccgtcccttctgagtgtcactgagcatcaactaaaaagaagactattactatgcagtccgctagaggatgtaccttgtagaatgcatttcttttcaaataatattgaagcaaatgattggtcaggcgaatccgccatccaagggcaagtcttccagtaagggttctgtgaaaatacagattattaaaaccatgaattcagttgtatggagaaatagtcataaatctaccagcatctaaacattcacccaaagagcatttcaattttacaacaggtcaatagctctcaactagagaagatgataatattttagacaaagagttgaccagaaagcatcaggtgctttattcatactggaacataaagtgattattcaagataccatgataaaagtgcaaaataatttctgaaatgaaggtactcccagattacctcaaagatggggccacaaaagaatttgcagaactttgcaggacactgataccaatcagacgaataaatgcagctttgtcctgctccaagacaaacttaacagttgtccctgacaaaatgagatgtatcagacaagaaattcatttgcagctcttctgagttctgacattagtaagatattgaacaaagccaaccattcagtgaagcaattcggtctgagatccaagttcgagagaaaacaagtagtgcaacagcaagcaactgccctccttgtttgtcaagtagcttaggaacctggagagcaaggaaatcagaacagcattagaattaagtaatatattaacatctgagacaagcttccatgagataaatccatatgcttggttagatatatgtccaggtttacccagataaattccttatttgcccctgaaagtttacccattcccttatttgccccttgttctttcaatgacatgtgggtccagggacagatatcagtgagacatcaggggcacataagagattgcatggaaattccagtggcaaataaggattaaggaattgtcaagttccataagtatatacttacattagtatactaagaaacaaaaatttctagcatctgcagatatacattaacttgcagacaggagcaaccaagtattacctagcaataatatctgcagtaactagggtaccgtattatctgaatattgacttgttgaggaataacaacgagagaaaactagcgaagtaccaaacagaacatagcataccaatattttgaccattgcagctactctggcaggcagaggccttgggaagcaccgtaaatgcgggactctatgtgtttgtattgtttgttctatttccaacttgggagaagttgctataacctttgtagtgtagcaatgttctttggaccttgatgaagcattgctctagtatggaaaaaaacacataaaacagcggcacagacaatattagttattaacaaaagaatatgaagtaagaaatgttcagaaatcatatacctttgccctgcccataaatgccctttgaacagtaagcgcatcagatttacgatcagtttccaataatgtatagtcagactcttcagtagaaaaggatgagtcatccctgcaaaatcatgagcaaaattaaatttctaccgaattaactttagagtgtaaacattcagtgagttatttcagggttacaaccttctgtgctggacatcccaccctccttcaccatccaaagacaaaacaatgtcatgaaacgcaactaaagctgggcgatgagatatcgttatgcatgatgttcccattgctcgaacctttttgcaaaagcgttcttccatatcaattgtcacagcgctagtacactcatcaaggatggcgaactttggtttatggtagaataaccttgccattcctaatctttgttgctcaccaagggacaattcatcaccccagttaacttccttatcaagaggatagcgttctagcaagtattccaagtcaacctgcataaggagcaaggttacaatccagcaggtccctgtactcagtagtagatcaataaagcataatataaatggcaattgagtatcaatatgaatcctattacttacattctttagaaggtccaccatgccatcgtagctaaggggttcaatctcctgatctgctgtaagaggataaattagctgttcacgaagtgtaccaacagctgtgtatggtctttgcgggacatagaaaatttccttattaagatcagagccaacacccggtttgacaatatgaccagaaactaatggccataagcctccaaggacccgaaaaagagaactttttccgctaccattcggacctgaaataagagaagtcaatggacgattaagtttgttatcatatcatgcaaagatgtatcaaacttgaaatatctgtaacacaacatgcaaaataagataatccaacaattttaagcggtaaatttggagcatgccattcaaaagcagtaatggtttcaacttggtagtagcacctctggtaactaatatgactagcaaatgagtgcctttcgagacagcagcaattttttgttaatgtaatcacagaacttgcaatatgatgctgtagttaaccttgggccagtatttttttattggttttcttttagaaaatttctgacatcaacaagacttttcaattactactgtagaacctacgattttgaaactattgtttatgccctaagagcacagatagtgaattgaaaatagaatagataaatacaaagtaagaatggaaataataacagaatcactttacatatttgatgtgttgggagggaaggcacaggcaatcatgggaacagttcacaattgcatagtggtatcaacagaggctagagtagacgtggatatagcaactaccatctcatgacacatactatttcataaccacgtaatcaaataacagcagatgatttaggatgatatacaaaatataaaggaaatatacatgcacagatgcactggtacatatattcccaatcttctcctgtttagaaggtcaaatttcaatcaatttaatgttaagtgcagcttacatcacaaaagttaaaagttgctaaaccaaattcatttgataggggaggattaccagtgatcaaaagattagaacccctttctactcggagagttaaatcatcaaccaagacattgctagcaggcgtcaccacctgcaaggacctgatatgagaactttggaagtagatagcgactatgaccctccttcagtttatgcagttattaccttaacacccgagaattcgatatggtttgcttcactgatataatttccagcagaggaattatgatttaacgatttatcacgaaccccagacagttcacgtgaaacatccagtaactcacgaatgcggtctgcatagccactgaaaaaaaatagtggaagttcatttgcgtcacaatcatgttggaagaaaatgagtaattcaaagatagcaaatgcaacccatggtggtaaaggtcaccattaagtttgccccatgaacagcatacaatgtcataaattgtgtgatttcaacagaacaatgaaatattaaaaagggcaaagatatgtaaaatatattaggaacaggaaacatgtatacttatattccaccgaaacaatacacacagacaaatatatgagttatacttggaatagcaaccaagaagtgaaatgctcttcatgagaaatggcgactggtttatgatctttatggtttgtgacaaaatctctcctgcctaaagaacctagtcatggtggtgactctgtcatcccaccaccacctctttagttggtagaatcttcactggacaactagttcatttgtgcatgcagcttgtaataagattgggcttgttcactttatgtctatatcgccactttcaaccctacaaaattttggtgttaccaaattttggtaggggaacaaactaaacatgcgcttaccaatgtcatcctaccaaaatttggtagttccgaaagcttcctctcacaaaaacaccatccaaatttgaaaaggcatcaaaccaaacacatccaatgctaaaatttggcattaccagattttggtaatgttgattttggcaacaaagtgaacaagcccattatttctgcattgatgtgcagttgcaaattatcaagtttggaactaacatgtttatctgaaatcattgcaacaaataggtatttagttagcagcataagacttgccaattgataaaatgcatttacagaaaacattaaaacagattcagataattagattggtaggccgcacacagcacccactaatttctgcatgcaaaatgccgcctgcaatgacaaaactggacctatatgttatcagtagtgtgcagaagatatggctttaccttagaatatttaaacgtcttgtgcttatagataggatcccaagagactgaaacagtgatatgattacgcttgtgtggtatcgaagattacttaacatttcagcccttccaagtgtggatgaatcaggtctgaggtggccagagaagaaaggttcaataatgaggacaactgctacagttgcaccaaaatacttcagaaagaaatcttgaatcatgccgaaccaccagttttcatggagtacacaattcaggtgcccaataagagcctggaaacgctgcatgatataatatgcttctctgttctcaccaccataaaatgccacactctcagcatgagttcttaatcgtgaatgaagctgacgataatctccttcgagttgctgttctgtggatttcagctttccgaaagcaggggagaaatttctaattgctccacccgcaactagtatatatccctgaaaagcatttatttttaataatatctaatattctaataagataacaaggtgagaaagcagtggccatctacattacagaatcagtgaaaagaagaggaatgtagcataatttgatcactaatcctaattgttaaagggtatcattactagatgaaatggcaatcaagcttttcaattagaaaattaccacaatccagagcatgtattttggacttgcataagaacagagacgccaggtgtatattaatccttctgcaactgcagctagatcatcctgtacaagttcacttagttcagaacagaactttggaatatcactagcaatcctttgctctgggtttgatattcgatgatccacatgtgaaattttgtagtaaaccatattctgcaattgtccatacagcaaaaaagaagcagtgatataccttattaaggttgtatatcataatggaaggcgttaagtaaattatcaaaagatgggctaatttctatcctaaaagatgcacacacaagttagtctactgtaattccacaataattaacaaaaaaaataaattaatctgatctggaactacataaatataaaaatgaagaaacctcgcaatcttaattatgacaagacaatgtaattagtaacatatctataatttgttgcaaaatccaatagcataggaaaatcactgacaaatgagaaatatgataattcaataccgaaaccagctagaacaaatagaaagttatttcttaaccaatccagggaagataacctcaggcagaaactggtaaaatcaattttctcgatggggtatgagaaacatatgaatcaacaatttcagtttcaggagtcagtactttaaaatatgaagtcaaattcaacaggatcatttaaaagttttccggttctttggatttctcagtgaggaaaagacatctctttttgacatatcaggaagttgtgagcatcatgtttgtacattatttccataccaagattagcacggttgatgatatccgccgagtattaataatacacccttggctatcaactacggaatgattgaaattgttgaatgaaattacacattcttataaataagggttggcacataaatatagcatggtgaacccccagttcactacacttttaggatattttttaaatttatgttctatagcaaagctatgctttgcatgaaaaactctagttttatcagctattatcttggctgcagtggtcactagtttagttcttcaaccattataacaatgtacgacacagtcctcccaggcataccagctggaataattccattgatagacagaagctaggaaggtactcttaggatattacaggggatgaatgcaagtgaggtatgtgtgcaatgggaagtaacaaataattcaaccaataaaaaatcaacattgatccaaaatgtacctgaaaataatcagcatggacaagatctgtcaaaattttcttgaagcgcagactcaaagaccctgttaagtattttgaggtctggtatacggcggattgaagaaagcataagattaggttttcgatgattaggcgtgtaaaggttggaacacgccgaagaaatgctgccctaaacaaatagccttggactcttgctaatctatgtcccacagcagtacgtaacacctgcaaaagaaattgttataatgctgacaataatattttatattattgtttagttaataaggttatgtatagcttttgaaaatccagtgttaggtactattacatatcatagaatgttttctctatgcactacaaattgttcgatgcttgaaattatttcgtgggaactactgataagaacttatcatgatcttctttttttctataaaaaaaagaatgtacatagagaaatgagtgcagcagcagcagcatagaatggcagaaattaccgcagttaacgtcaagccaagaaggtagcgggtgccatttggtccaatcttcttcagtaggatggcagcaaggaaatgaagagatctgaggccaccttttcttcgctttgttccggccaatctaccatccacaccattttggcccatcctgtccccattcctggccaatgcagtggtggcatcgtcaccctctgaacgccttctccgttggccttggcttgagcgtgcatacgccaaagctcctccggcaagcagcgcgccagaaacaaccgcaagagttttcctgttcccacacaaacaagaatgtgtttcttttccttgttcttcttataaaattccaggttggagcaaaaggatgatgaagaagaagaagaaagtattttgggcgaagcacttttgttacctccttgaggccaagagtccccggccacgctccgtcaactgcagcagctgcagggatggcatctcgctcactgaagatcttatctataaaaacagtagattgtcgagcgcggaatcaaggcgccgccgcaaagcatcatcgccgctgcatccaccgaattggaattggaattggaaagattaaacggagggagtttgccccaaccaggccgccacctccacgaaacgccggcgaatttgggcgagttgagaggggtgcgaggagatcgagagaaaaaaaaacgaatctttatagccgggaaagggaagaggagggttcaagtaagtacctggatgtcgatctcggcggaggcagggcggcgagatagatcgccggcgacgaggaggagcatgcagcagcagaagcagtagatgccgcgaaattggcactgtcgcgctagtaaataaatatactccgaaagtaacaaattttgggggggttgatgagatttaagggagggagatgtatgatagcgactgatttggaagcctcctcgccacaaactcttcctcctcctcctccttcttctctctctgcattttgcaaacccatccaaaacttttcttcctttttctcaaatctgcagattgttgtactagcaacttctctctcaaaaaaaaaagaatcttattttcattcttaattttctttgttaagttcctattggctcctgcagtcgttcgagaccatttctgcaaatggtatattctacagagaactaatcaaccttattataataaatctacaactatcctctaattgtcagaattacaatacaactcctgaaaatgatgcagtactctctccgtttcaaaatgtttgacaccattgactttttagcacgtgtttgaccattcgtcctattcaaaaaatttaagtaattatttattctttttatatcatttgatccattgttaaatatactttcatgtacacatacagttttacatatttcacaaaattttttaataagatgaacggtcaaacatgtcctaaaaagtcaacggtgtcaaacattttgaaatggagggagtacaagaatcttgagagggtctggatggaagtagtccattgttggttttggttggttgcaatgtcatttttaatggatggatttccctttctttgctgttgctggctccaagcattattaaagcttctgcnnnnnnnnnnnnnnnnnnnnngtcaagtctgaagaacttaaacggcaagtctactgaactgaacccaggaagaaaggccccccaacccttttctccccgcgacaaactctttgcatttctagaagataaggcggttatttgcgaaattaccaggaaacaaattgattaacccatctgtagctgtcgaatggtaagttgttttattttcctgtctcgactataacgcattggacattgtaagaaatcgaggcatatggtactatattttcgatgaaagctcatctcttgagttgagtgtttgacaaatttgatagagtcataagttctgttttgagatataagctgacatcacaaggtttattttttaaatagttgaatttaacctaaaatttgtactgcaaccctttcccacactccagggaggacccatcatctgaaaaacaagggattagatttccccatcctatactgtagtctgacaatgcccatccgttttctgaagaagaaataaaacaagttctcgatagctgctactagctgttttctcatttcttaaaaattaaaacaatagaagttcgaaattaccactaaataagtaattaaccgatttgtaactgccgaattggattttttttccatcaaaagtgaaagcttcctatctcgactataacgctttggatttgttaaaaaaaacttgaatcgtgggatacgctatttttaaatgagaactggaacatctgagttgaatgcttgacaaattgagttgtaagttttcttgagttataagatgacatctaaaggtttagtttttttttcttttaatttgaatttcctcgctaaaaataaggttgaatttaatctcaaattttagctgaacattgcaccgctacccattcattgtatcaaattagactgctacatacagctactgtagtgtgacaatgcccatctgttttctgaagaagaaacaaaagaatgcttagctgtctgtcgtttcttaatcaccctcttcgtttatccagctttatctttctccaaattctcatcacctgataaaatccgtatgttggatttcatgcatgagcctgcaaattacaggcgtatgttttccttgaaaacactcaattcctttctgattagaatttcacagaattctataaaaccctgcagaattcatattaaatcgatggcttaaactgctgaccgctaattaatgcttcataattggaagtgcttattgtatgacaaaaatgacaatagcgatggctggtactggagcttccaactacaatccttgaacatggttagttgcctaatacctcccctgatgtgcctctgcgatctaattgcttgcctgcagtgaccatctaattattcaagtgtatatacaccttgtcggtcggctatatctctatttagtttatattttgcaaccttaattacacgtaacacatatacgaacacgcaaccatatcatcaagcacagggcggcacgcatctacagcctgcagttcatgctgtgttgtttaagaaggaaaatgatttttttttaaaaaaaaagaagaggaagaagatatgattatctatctactgtagtgaaagtgtcaacatgacgacgtgcagcggaatagtacatcaaacataaagtagtacacctaattatattggtaccaaaagataacccgtagcagtaacaagttgttaattgttgattctaaattttgaggacatatgccgtgaaaacgagttaagtattgaaaactcgtgaaaaatcatgaaaaaaattacattctcaccgaatcttatgttcaaacttagctttattcgagagtaaaaataaatattttttaggtgaatagtaactattttcaggtgaatggtaaaaaagacaaataaactcaactttatttgggaatgaaaatccacttgaaatttgtcatttttattactctcaaatgaagctgagtttggacttgacatttggtgagaatgtacttcaaatctacacatatctctagcaaatgtttcatgaatttactaaacttttaggtatgatttcacgagttttcaacacttagctcgttttcacagagtatttccctagtcgtcgctatgcccgcgtatacttcgtcccccctggatgtcaaggtctccatggatgtgcacagatgataaactgtagtgtgcttagcatatcgcgagactatcgggtaatggacaactcatatttaattgtgctagagaaaaaaaaaagataaattgcagtttgtactatatattcttgaaagtgttcatattatatcatcgtttaaccatttttttcatatacacaacatctaactttacatttcattttggactaccccattctatccatcttcaaggccggtgactctacaaccattccacgcactaactctttctgccttttcctttttccttttgaaagctagggaatcgtcagatccagcaaggaggagtccgatctagcttccctgctctttgtcgggccagctcctgccactccaagtccctgcaaacccgacagcccctaacctcaacggtgaccataacaatagtgtgcatgatgacgggggaggggaaaagacatctcgatgactagagggtgtggctatgcatgtaaaggcggagaggaggaacaatggtggtagctaatggaaaaaagaacggtggtggcggtgtgtgtggagcggcaactagtggttattggtggtctaaggagtttgccgttgatacaatccccaaccttgtttgttgcattttttttctctgagtactatcaatatatttgtccatcaataatcataaagaaatagctagttttaaagtagtaaaaaaattgagataaaggtggagtactcgagtagggatgaaaacgctttggaaaaagacgaaaaactcttttatcgtttccatttccatattttgttcgaaatcgaaaaccacggatacaaaaatggaatcaaatattatcgaatacgaaaatggagcgaatacggtaacagatatttatcggaatataaaagccccttaagctgaacttctaaaatccatgaagagatatagctcaatatctctctgaaacaataaatcgatatttataatttttatcaattaataataatataactaggtgtataatttattttcttggagaaaaagagctatatttatctataattgcaattataaatactaaatatttccgattccgagaaaaagaaaatctgaattcgtttcctgaaattttccaaaattggttttgggcggatagcagcatttccaagagtggcaaatattccctgtaaaataactcgagtaatggttctctttggcgtaaaataaagagaaatctggcgtctcgtcgtctcctccgctcctcctctccttgcgccaacaagccgactcgcgatctccatcgggcaagaagagcagagcagagcaggggaggggatcctgcaggtgaccatcctctttctttctttctttctttctctgaattcatctctctctctcccaccgggactctctacttttgtctggaatttgctcgcgttcgttcgttaaccctagcttctcttctcttctcttctagatctggaagaagctcttaatttcagagccttaacctctcttaatactacaagtaacaacagttttgttgtttgttccccccaccccaaaaagtttaggcgcacgcatcgcccatggccaccttcgagctctaccggaggtccaccattggcatgtgcctcactgagacgctcgacgagatggtctccagcggcaccctcagcccggagctcgccattcaagttcttgtccagtttgataaggtatctactttaccatatctccttccacctattactatctatactattgaaaaattcgactcctcattttgtttgttatcatctatgtgattagtctatgacggaagccttggagaaccaagtcaagagcaaggtttctatcaaggtatctgctcttatcacggagttgccatgttgctgttcctacccccccaaaaaaaaccaagccttacttgtgctgtgcataactttaatctctatctgtttcgagcctactcattatttatgcttgagaactcatatgcgcttgtgatgtaatttctccagtgctagaattgatacacttggttgtggattcagcgttgccattcgattttcttttccgtacacaccttgctaaaggaatcaagtctaaaatttgtttcttgcatatattatattattattattattcataaaggaatccattcacgttcgacacgtacctgtcctgtgtacgctgctctgagttctgagggatattgcacaaactttatagtaatgagtaagcgagtaacagaattaagacctatcagcaacataatacacgggcataaccagacaaatcttgcacttatcacatatatgcttttattttttcggctgtacaagcatatttccacttatcttattttgcaacacatcaagtactccttgagttgctcagattccaagctgctcatctgtgtttggccccaaaaaaaaagaaaagaaagaaaaaccttttattggataaacaagcctgagaaatgtcaagatcttttcttgccagcataatcctcaccaaaatgaaattatgaataaagattagtgtcattctttctgatacccatgtagtttgttattctatggcatgatagagattcttttttgtttgtgaattgggggtaatcacagaaatggactgatatttttgcccaacaatgggtgacttgtttacgtatcttactgtaatccgctttactcctggccccttgccccttttttataaatggaagtcaaaagtatgcaaaatataggcaactcgcacattacaatagcctcagaccctaactaccacatcgcaaccatgtgcgagttaggaatgccacacccggatgtgtgtcctctatgcgatcaggaggagactatacagcatattttggtgacttgtgttttttcctggcaagtatggtttttaatcttccaaatggttggatgggcgctgcagcactgcaaccatcaatgaatcgcttgtctagctggtggttcaaaacagttaaggatactcctaaagaggtaaagaaagggctgaactctttgattatcctagtggcatgggaaatatggaagcatcgcaatgattgtgtcttcaatggtgcctccccgagaatctcggctgttttgcatgcagtggctagagagagttctctttggtgtactgctggagcaaaggcactcctcgaaattctgtgtgggttgctccccctggacggctagtttctcctagggggtgtttcggttgcacgtcgcgttccgtgatgtttttttgtgtttctgtaggggtcctttgggtcactcggttgtacaatttctcttcttaatgaaatgaatcgcagtcctcctgtggtttcgagaaaaaaaaactcacacattgcaatattgcccatattaaaacactgatttttccccataaaccaaaacaagaaataaagtaactaagtgaccctggtgtgtacatgtttattagaacttctttatctgcaatattgtgcaacagaaacaagccgcaaacagcgttgagcttaataacaaaccagtaatgatgctagaaaccgtaccaaacataagccggtactctgctagaatgatgancgacttgcagtagtagtgtatctatcggcgcgcg

SEQ ID NO: 31 - DNA, 10747 bp, Oryza sativa
  unsure (1)..(10747): unsure at all n locations
ccggccatganatgccctgctcgntcgtacagtagttcatcagtgctctgctcctctaactgtgcttgtagtatcaatcagtcctctgggccattcgtagacgcaacaggcagctcaccaagttcgggtgaatcgttttgtcgtgtttattcttgtcccattagtcactagatagttcagcactgttcttgttattctattgatgcatttgtatatgactcattttcacgaaaggtgcatcaagagcattatattactgtagctatgtagttgttatcggtgagctttgctccatgctaaaagagttgggctaaatctatagcatttaagaattagttatagctggaaagatcatgtttgtcttgtagattcgactacctgatagcagctatccacctggatgatgaacagatctgtccatgacaacctgctgggctatggtgcatgcatgcacccatgtgataagtatgtaaaacgctatcctagatatagttttgcaagaattgatctctattgctaccggagactagaaaggtgttatggattggctagggcaagggtccgaagaccgggggatatagcactcgccctctaatagcagaggcagggcttctccctgctgagctaaaagaggctatgaggcttagggctaactttagagattcattgattgattgataagagtacatggggtcactttatatatagggaggacaggcttgacatccaaggaactaatctctagtactacagaaaccagtccaatctctatctctaactttctaataaacctcatctctttcctaattagataatctcctacctatatatgagtaattcgtaatttatgatgcctaaactgctgcatgggcctggtccatgcccataacactacacccctcgcggacagatagtcttcgagcactagcagatatcttcttggaaagaacttcaatggtagcagtcggcaaatcatcaaagcgaagtttgatatttttcttgagttctggccaagtttgaattccgtaggctcgctcaatcaactcataccacattgcggcaaacctggtccggtggcttgatgcaatccaccacttctcttcctccataaattcgctgctcaacaaagaactgctcaatactctccaaccaaatttgcggatcatcctcaccattgaacgttgggagaggttcaaggtggcgaaatctccacatccaattgaaatccccgctgcacgccatcgagggtggagcatcagttggctctgataccaaatgttatggattggctagggtaagggtgcaaagactgggggatagggcactcgccctctaatagcagaggcagggcttcttcctgctgagctaagaggctctgaggcctagggctagctttagagattcattgattgattgattgataatgcagtacgtgggacccctttatatatagggaggacaggcttgatatccaaggaactaatatctagtaccatagaaaccagtgcaatctctatctctaactttctaatagacctcatctctttcctaactagataatctcctacctttatatgagtaattcctaatttataatgcctaaactgctgcatgggcctggtccatgcccataacaaaaggaggtaaacgctatcttatagcttctaaatacggcacacctttatcatccatttctagttttggcttatggaaaaatcttcagttaaagcatttatgatattacaaaattgcagatgacgttttgtcggcatctgaactctcgtgaatctgctgcttgccccttcttagttgttccttaagttgtttcggcctttccaatttagcagtacacttaatcctcatgatccaaccatggccatcaattttcaattttcaactctgagcactctcgaccaatctcccatcagctgggacctattcagctgtctaagacatacattcacaaaggagattgcatgttctgattttcatttttacttgtaaaatgtaatgtttgcatagccattttgtatgtttagcctgaaaatggttgaagcatagttaccagttcatttgttttggtgttttacctgataatgtccagtgtatgaagacatgcgataattgataaattcatatatccggccactcttttacaactgtcactgtgtgggtttaagaaatccctcttttgacaaaccgcagttctctttttcttttccaaagaattgttaatcccacactgaattgctgtattaggaagggatcacctctacaatatgtcatttatgatatgtggtgttgagatgttacgtgttctgttttatttttgacgaaaatgcaggagaactggcattccattaaccattagctaagaaatgtacatggttttatcagtcataaactggacttactattttagaatcatgaactagagttttgctaatggaaattttaccattttaaaaatcatgaactggagtttgaattaatctctgttttatttatttttgagtaaatttcataaaactacatatactttgcatgatctatcacaaaactatagatttaagaacttatttcacaaaactacaaatttaatgtcttcgtttatcacaaaactacaggtattttacacaatatatcacaaaactacagatttaagaacttgtttcacaaaactacagatttaatatcttcatttatcataaaactacaggtttagtgtcttcattatcacaaaactacaggttttagcattgtcaaaacctgtagttttgtgataatggagacactaaatttgtagttttgtgataaatgaagacactaaatgtgtagtcctatgataaacgaatacactaattctatagttttgtgaaacaagttcttaaatctgtagttttgtgatagattgtacaaagtacctgtagttttgtgataaacgggcatactaaatctgtagttttgtgaaacaagctcttaaatctgtagttttgtgataaattgtgcaaaatacatgtagttttgtgaaatttactctttatttttctaacttgctatcctgctccagaaattttccattctagttacatgagtttaagcctcttgtcattttggacgcaatgtcgaacagacctgtatttgatggattttttttgtttatttaagaataagttctctggtacagcttagatacgatggatgattgactaactttttgagcctgtatttcagatattttgtagctgggctgtttactgatgcatgttcttttctcagggccacctgcacacttacaggttctgtgacaatgtatggacattcatcttgactgaagcatcattcaagaacgaggagactacagaacaagttggcaaggtgaagattgtggcctgtgattccaaactactcagccaataaattgataactgcgaggtcagggtttgcctggtatttgttagtctcttctgctagacctggctccgcctgaagtgtactgtaccaccacattgtttgtttcataatcaatgtgtgtcaatacaatcgtatgtgctaccagagtatatcacagcagcaactgttttaatttgtatgcttatgtaattgttatgctactgctgtgttgataatgtgatataaatgactaaacgatgagtagtagaaattgtgcggagtcaccctcccccttcctcatttctgaaccctttggttctgtgtgactctttgtatgtaacatgaacaaatacctcctttcccgtcttttttttggatcctatgttaatggtacctttacattatgatgtgctctttgggcatgtttcatttcttgccaaaatcaaccctagcaacatttggcattaccgaaatgccaaaaaaattgctatggttggaagtggtaacaaatcaaacgtgctggatcttcagaaatgtttggtgctttgtgtttacctgcttttttaatatcaagattcagagtattgtttggattataacttgattaatgttctaaatgatactgtcctgctacccagttgaggtgttctcataatcttgcagaacttggatggatttttgttccccagttgcattattagagatgaaatgagtcagaccttggtcataagcatgcatgtgtggcagaattctctaaggacaaaagtttaatccttgtcagtacaaagtaagtactataattatctgcgacagtttgatggccaattgcaaggtgatcatcaggacgcagattaattaagggtgtagaactagaagagccaccggtcgaaacgtgtctgagaaagttggaaatatcttgccaactctttgctagtacaactagtaccaaggtactcttcctaccagtaacaacaatcctagagggcatgagcatgacaggccagcactgcagggaatcaatcagctcagcacagcactgcacagctgaggctgatcagcattcagcaatggcatgcacaagccaacatggaaaaagacaagcaagcagatggatctgccttcaagaaaggacgatgagagaaaaaaaacatgattttttactctagttgttttccttaatctctttttcccctaaaccccaggacagagagaaaaaggtggcctctaactccaagttaagctccagtcgaaaggtcttcacatagtaatgttttttcttaattaaacgcagattttacattagtttccgttagcatgtctttaagctactaaacaatatgtttcataaaaaactttctatatagaagtcgctataaaatacagatataataattaaaacttaactaatcatgtgtattaatagctttcttgtttacgtaatttccgtctttatttctctttagataatggaaacttccatcttcatatttggtgctagaaacaaacaccaccataatattgcggtgcaacacaacactgcaagactctactactccaacacacaaagctgggcacacgcacatcacaacctcactgccattgagggagtgactgctgagtggacacacacacacacatattcacagagagagagagagagagagagtgagtgagagaatcagagaaccctgacaatggctgtctctatctgtctgctttttgaggatgtaaggtgtgtggcaagagaggccagagagagagagagagagaggaatggcgatggcaatggcaatggtgagatggcttccacaactccacaagacgcctttcagctttcattgctgctgcagtcctgccccaggctagctgctgccgtgctgtgctgtgctgtgctgaccaccaaagatactgtcacacacttcacggagaacggggtggtggtggtggtgttcagtgcactccctccgtcaaaaataaaccaaactcgtacgatgaatctgatatgaactgaggtgttacatctcatatgaaattggtttattttgatacagaaagaaagagtaactgcgagtctgcaacttctttttccggccttccgggttcaccggaaaccgtctcgagcgacgagtgttgcaatgggaaacaatcctcctatactgaagttctcaacattccaggattttgtgattgtttattacattaattaacagaaaattcatccccctataaaggagtatttacttacaaatgcagagctctgtgtgacaattggcatatactacctctctgtttccaaatgtatggcatttttttcaataataaaatgtatgacattgattaattcaacatcaaacaaaaaagagatgaagggagtagaagaaaaatgtatgtgtaaattagtgaaagggacatacataaaagtgttctgttttagctttcctcctgctgatgcttttccattagacttggcttccaagtttccaaaaaggtttatctaaacgcgataaaaggcaaccataaaaggagaaaaatgaaacatttaaagtaagacacgagcaagactggtcacaaagaacactaggctaatcagcaacgaccctctgctagcttgactgttccttttttcctttcactaattagcagcacaagttgcaatgttagtttatctacatgccacatgcccccaatgatctctacaccattttttcttgttttctgatggagttccgtacaatgcagtgtgttttgttagtgatagctgacaaaagatgaaagtgccttgatcaggcttcagcatgtttgtgtaatccaaagtactaactccgtccagaaacaccgtagttttgcaccgtttatgtctaacatttagtcatccgtcttatttgaaagatttctatgattagtattttttttatttagatgataaaacatgaataatgctttatgtgtgactttttttttaaaaaaattaaataaggctgacggtgaatattgaacacggaaatccataactgcatttaaaataagacggaagtaaattaagcctctatattgaccccacatgtttgtgtaatctaaagttggacactctggataagagcaagatgcatgagagtaacctatcttaatacgtagtactaatttctagctgactcttcaaattgctggcaaatgcagatgattactgcattacactattatattactttcattaacacatggagatatttctctacatatatttaagacagcttccatgtgatgttggctcatgagaatgtgcagtggtgtctggtgtgtcttgtttaataatttctgaggaaaagtagaaagtaatatctcattattttgcctttttaccagccttttatttccactttgccttttgagatgcacactgaaatattcctgcagctaaaagggctaggcttcttgaagtcctgacagccacatataaatacacaggaagagccaggagcaacaaaggcttttccaactcctctctttgcatgtgttgttgttgtggaggtaaacaagaggaggatagtgaagactgaagagaggagtagtactagtgaatagtgagtggtgagaggggagagagatggaagtggaggctcaccatggcttcctaccaccagcagcagggaggcagcacctttatggccatccccactatcaactttcaggtatctacatgttggtcactttgatctcttcttggttggttgttgaatgttctttggcctgcctgtatgtcttgttaggtgatctttgttttgtgctgtgccaaggaaattttggttcttggtggatcctttgagctcctcgagtggttcttatggttgggtattcagttcagttcagttctcggagtgttttctcttgtctgtgtttcctctttttttttccatgtttactgatttcttgacaatggcctcctgtcttgcatatgtttgatctcttatcatcaaaagaatcagcaatttttgggaggtttttgtggcgagaatttctcctggtgtttgacatctgttccattggaactaattcaggattcctttcagagaaaaggagaattaattcaggatcattatatgcattttcatgtggtgtttaccggtttaatctcttttgtgaatgtaaatcgaaaggttcgcagtgcggatcacatgagagtgtgtgtgagagaggtattgttggtgtttagtgtgaacttactaccattgtcaaataaccaacacaatgtcacacaaaaagttcagaaaaggaaccttcactgttgcttggaatttatatgcattgtgagcttcatttttttttcctaaaaaaacatattgccccccttttcttttgtttgtttcagatgtactctgaaattgcaggtgtgggagaaagaactgcaattgtgaatttaccggttaaaagttttctccttttttttttcaggagatgatgagtggtgggagtacatcccttgccccttctgctacattgaggtggaggttcatttcctttgtgaccatctccaggaggagcattgctttgacatgaaaaatgctgtaagaagaacgcaccgcacctgctatctattccttttcttctcttcttgctgcaaatgcattctcatgtgcctgtcgatgcatctctgaattttgatgaatcaagcttcagtgttaacttcagtaaaaattcacaaggaaaaactttaaccttgtgccagtctgtaccataatccattgatgagactgcacagtgtagtaggagtagtaaactacacacaagttgttcactgtagttgtgaacttgtaaatagtcctcacctctgttcagtctaatggtgattggtgaacagttcactaagcaaaatattctccaaagatttactgtagattgtgattcttctcagattggtgatactgttgggatcagttcctctatgatgatgatctgatcgaatgactttcctccaggtgtgtccaatctgcgccgacaaccttgacaaggacactgatgaacatttcagggttcagcactcacatctactcaaggtagagtactcaatttctcattgctttcacagtgatttcactgctactagtgccatgatcaggcattgcaatttgcaaaccacattggagctcctgtagattaaatctactactggtagtagctcattgccatttggtattttgatcatgatccacagaggaggaagtcttcttctttttcttgcaagccaagctcagcagcagctgacaagggatcatatgaagaggactcctactttgaagcaccctcacactgcatgggcaggccggctcctgattcctctcctgaccctcttctctcccagttcatctgctgcagcctcgctcctccggtcgattcgccgcgccgcagcgaagccgatgccgagggccatggttcatcttcctcagatgatcaaaaaaggtaagaattgtgcagttggtgctgttggagcagcctgaaatttggtaacaattgtgctgaatctgaacaatgctgactgatccaaatgcaatctttgatgcttgcaggagagagcagggtgtgatggatgatgcatcaaaggaggagcttgaggagaggttgcagagaatcgagttcgtgaagcagatgctgatgacaacaattgcttattagaagactgtttctctagggttcatttcggcagtttgggtaggcttttcaggatttgggacaagtgcagaatgatgtgccatttaatttatgctgaccttcggcacatgtatacctacaatgtttggatatctatataatcatcaatcgtaatcctatcaatttaaccttagttattatgatgagagacaaccaagttatacctttgttggacatcacctttaccagtaataaacattttggcgcataaaaaatatacacgacgctggaactggctcgacaaagaagagatgctactactacattctatttcatcataaattcataatcaagtataaccacattctatttcatcgtaatgttgacaatgttccacatcaaaatttaggatgcatgctacatcaggtatgcatcattgcaatatataaagctgctacatccgtagtgtccagggacaccagaatgaattcctttcccccaaggtctgaaacgtcagattaagtgctgatctctgggttgagcgttactgttggttaatagcttctcagtactcaacgaccaattgcctaccagggaagattggaagaaagcaattgttcgctaagcgctgaaactcaaactgaacccaacgatggctgcaattttgccaaatggcatggtgagtaatcataaatatccctttgtgatttgttcctccagctcagcaaaactccaagcatcattgactgaaaagtcgcctgcgaagtaaaactaaaatatgatggctgatctggaccaaaggaacttatgtcccttaaaaatatgtatgaataattttgatatacaattcactgttgaggaacgagacgttcaaattacagtaaaattaattgatcatcatgcataaccagtcaaaattcacaagacgaaaacttaccaattgagtctctccgcaaggcagttaaatgagcacagctgcaggcaaacatggatatctgatttagtcaccacgatgtaaaggagatgtaaagttggaaacgtccaacaacagcaactcaaatggaaagaaaggacaagtctcggacgtcaactgaaagataagtggatctttaactacatgccctaaaaataagaaaagaaggcggcatttggttattagatcatgatggaaccaacaccagaaactagccgaccacaatgcaatagataaattcaaaatatcttcccctggttcaatgtcatgcaaatacttgtagcaaatgaaattctattatcttcagagtggataaagtgattttctagcctaatatgatgatatcacaatcttagaaacctaaaaaggagatgggttattctgcacttttaaacaattgaactactatgcatagatcaactcattcaatgcagaaccgcctgaagcagaaagaccaaaaaaaaaaaaccaatgaaaacaaaggctgtgtacacgaatatccgaataataagcagaccttccgagcgctttccccaaatctgcacagagggatcgaatatatgttccttttgagcaaataactcgaaatatcagattttgtctggaaatacacaaacaaaaatcatgtcaggtggagtctcgaacagtatgaaccaagcgtatgtagatctgtgctcaaggaagtcannnnnnnnnnnnnnnnnnnnnnnnnnnnnnnnaaatcacaaaggggcccgc

SEQ ID NO: 32 - DNA, 8752 bp, Oryza sativa
  unsure (1)..(8752): unsure at all n locations
acgcgccggatagaagctcctactgcaagtagttcatcaaaccggcatataattcaaatggtttgtagtctgtgttatcaagcataactgtataggagatactgcgaggttagcaaatcccacagaagaattctagcaacaacttctctttatctacaaggaaacaataacaggtttagtgtaatataggagatagtgtaccttaatggcagaaaacattggaggaacttgccatatctcgcccctgaatgatgctgctacctttctaatatcttcatctttaatgtgttcccatggttctctctggataacctgatgatacatagatggttaggcataaccatcatgtaaacagaaaaaaagcataatttgaaccaaagtcaatatagatgtagaaagtttaacaaggattaaatgtagcaaaaaaaccagatttaacttaattgttccccaataaaaatcttccacacttcaagttctattaatcaagattggccaaaccaacacaattgtattaattgtgtacttaataagttgtcttactgtattaatttctcacgtgtcatacaagttaaaagtaaacccgatttgaagttcctaatagaaatatatgcagtaggtcattttatcagaatacaagatacatactggtgaatctgcatcccaggttgatgtagcttctccaagtcgaaaaacaccactatagcctttaaccattccttgatatctttaaaagcatatggacattcactcaggaaagttttcaagaatgctagaacaggaggtttactgcaggtcaaattctaacatagcagcgcttgaaatcctcacaaataagaacttgaaataagataagccacaggaaattgtcccaggcaatctgacaaaatagctttcactgagaatattagagtacctatcaacaactttggttgctttacccacacaaacaatcaacagtccagttgccattggatccagagtaccagcatgcccgacctgacatcatatattcaataaacatgtctgtagagcaaagatctaaaaccacagtattctaccataaaaatcccaaaattaccttttgcacattcactaatcgccgcagctttccacaaacagtaaatgaagtccagcctggtttacaagaaaggcatatgttgagctccataaactggagtggaagacaagaaggttataagtttctagcaatatccccaagtctcttttagacatttactaatcacctttgttgtgcacaaattaacaaaaacggctgctagtaggaactaatctaaaagtccacatatgtactgctcatactcagataaatgaattgtcagctcaaaaatgtccaccctaacatacataaaatcaacaactctagttctcaaggtaagattctcatcatgaaaccatgacataaactatatttgtaaacatacagcaaattcaaatgtacgaatgtattatatccatccagtcaccattttaaacaaaggctgtcggcaagcattagtgttggcacacgatgtactatatctacctatttgctaataatttggcacgaataactgcaatgttgcacacaagctcgcaattgtgtaaatagtggtaacatcaaaatttcttacaccagaaccaaattttgatgcaatctcttaaaacgtgcattagaccgttaatcaagagaggataaagaggcatcacctttgggcttgtcgatgagcacgactgtcccggtcgggccgttccacctcggcggcagctccgttctcctgctcgcgagatgcggctgcggccattcatccgcctcgtgcctcacttgcggaggctccttcttcttcgccttcatcacgttagcctcgccatggccagggcctttcttcaatgacctgaagaaatcctccaccttcctctccaacacctcccctcgatcctcgccatccttcttcttcttcacctccgcctccttgttgttatcgtcgtcgtcgaagaagacgaggcccttgtcggcggcgtcggaggaaggcggcgaggcgtcggcggggacgaaggcgttgtcgagggattggtccgggaagtacttcttctcgaggcggtagagcatgcggtagtgcttgtccttctcccagggtagcgcgaacgcgtcgtggaagtagagcgcctcctcccgcgcgtgcagccgcgggaagtccaccacctccggcttcagctccacgaactccgacgaggaggaggaggagggcttggcggtggtggcgtcggggtcggggagaaggcggctgcggcgcttccggaggtaccggcgcttggcgcggtcgaggtggtcgtcggtgggccgggtgtgccggtcatcggcggcggaggatttgggcggattggggtaggagggccggtagaggaggaggtcgtagtagagcgggtagggggtggccgtcagcgagaggaagcgtcgggggaggcggagcggcggcggcgaggaggaggaggagagcagctgcgccgccgccgtggctcgcgctccgccgccggtgcgaagcattggttccttatccggcagcgagtgacggcgaggaggggagatccaacggcgatcagggtggacacgcacacgcacgcggccaatctattttgcaggatagcccctgattaagatccgaaattgtttgcagaatagtccctgtttcggatcaaatagcatttgaaatttcccaacactgatattagggcctcatttttttacgcttatgtttatacttatcggacaaaatttcaatttccacccttaaagttaaatttgattttttagggttttttcaccgaagtttattttttagcatttgtttttagatcgctaagaacacacacacacatatatatatatatatatatatatatatatatatatatatatatatatatataagtttcattcacaaattattattcgtttgcaaatatgtacgatagggccgtcgaatttgaatgacataatgggcctatttggtttggttccaatttattaccctaccaaaattttggtaactttaatagtagcaaatgtacgtttagtttgctaccaaattctacccacaatagttcaaattgaatactactcaatttgatagtgtcaaaatttaccaatgttttggcactaccaagattttggtagggcaaaaattggctccaaaccaaacaagcccgataccacctcatttggaatggatatcacaaattccaggtaatttacaccattttatgtttgtttctcagagttcttatgctccagatatcatattgcactctctctaaagcgtgcatgcattcctttcattcctcagtaacaatcagaactcaaaaacaatattaccaccacaaaaacacaaaataatcgattttatagatggtatgtataacaccctcctcatgatcgatggccctccctccctcatgtgtaaatgtatgctctacaatcatcaccatccaatccacactctatctgaccacctacctacacactcatcagttcatcagaactgtctgtacagcaggtaaaacacatcagaatcctcgtcattcagacagaggcagagatgggagtgaagatgaagatgaagaatcagcctagcttagatctacaccagtgtggagttcggaggggtgatgcccatcatcttgtagtacgccttctccgcctccgccattctcgtctgaaacatcccccattccttcctgcaccgcgccctcacttgaacgaacaaacattatggttacaaacaaggggactcgcagttctagtgtgttcatgtctgcggaaaatttcaaagactcttaccccttcccatgctggtcttccattctctgacttgccctgttaatcgtttggatgcaaaaacgtatcaaatgagcatactttagttatgcaaacacttggttggaaaaataaataaaaaggaagatgtctcatttacctggttcccgagagatggaaccacttggtgaacaatccactgtgaatcaacaaccccaatcttttcgtgagcaggctgaaatgcacaaagcatttggtgagcatattcataatgaagttctaccaggccggtgaaatttaacagccaaaaggtaacctatacctccacgcatttcctgagagcaaaatcaaggccccatccatgaaccaagtcattctgcagaggaaattaacacaatcaaataaatgaagaaaaaaaatgaatggcccgaagatactaattgagcttactatgaaatacaaacctgaatcatatgccatacacatctccatgcatctctagagaagactggagccattatttcaacaaagctgaacaacagcaatatagattagttagcctaactcaagtggatagcactttcacgccatacatattgggatgtactgtagacaaaactcaggacagagaaataatcacatacgcagcacaaggcggaagatgagggtcagaacaccagcccggcctctcctctgtaaccctatgacaagaaaagattgcatcttgagttgctaggttccaaaaaggtagtagtattaacagaatagcgggtttctgctaactgaaaaatgtctattgcagagcagaacatgtttactcacttgtggacctcgcggtcacctcttctttttgtcatctgccatgtcaatccccgatcaggctctaaaccaggttgagagatctccagatggtatttcttgacaagtttgatgtatctatcatatacatcgacagacatatgttagtgcggcatgatggcatatcaacaagtggtcaactgaaacatcaagagcaaaagcgtactcctccgcattgaaatgctccaccccaaggtcctcatcccagatgaatatgtactcataagctgccccaatatcaggatgcaggaatctttggcataccacctacatgtatgtgcataaataaatctttataagatatccttcaaaattgagcacctgagagaatgacaatagcatcagagcaaagtagcagaccacttagtttgtttcttggcacttatatggatggctcgtttcgaccactcgaactcgtcccactcactcacccgaccatcataatggaacaacagaatagcaaaattgtcagagacctgcagaacggaacaacaaaatgatcagaccctgtgagtttaatgaaatgggatatagactgaaaagcaaattaaacaaactggggatggcagcattttagttgttaagcaaactaaagttacaacaacgttaccttcttcactgctctgttgatattttctttctgtgcatatccaacagtgaaagtaacaaggtactttggtttgaagggcaggtcctacatatgcaaaatcataatatcagcatgccaaccaacacagtcttggaaagctacagagtttaggtcttctattttgaactacttgaaaaccaggacatataaggttaacgtttcttagtttttacttaatcagaacatgatgaacaagaagagacacatggtaataatatataacaacaatttctcaatagcaggacatattaggcacagtaaaataaaacctttgaaaaaggattaaggagtatatgcttgataaaagtaagaacaaataacaaacaaagataagattccagaattccaaatatttttggcaataaaatgatacgagtatgttgagcaagaaaatatacctcacttggttctccccataacctgcgcaaatggaagtcagtttctggcacaacaatagctggtgctagtctctctgcacccttggggttcgttgggacataaatctgtgaaagcaaaatctttgttacaatggaccttatacttttgggatgaacagcggcaaggaatacaagctattacttgcaaaccatcatttactcaagcagaggattttgtgacaactatcaaatgaatatacataattctaatggttcatggtactctacagctaaactaatagtgcagaaaagtaatataaagtaccttcaaagtagtgtttgaacttggttcagaactgttttcccttgcatttcgggcggaagtccaggcgtgattaagcaaagcttgtgttgtgagcccagagtttctgtcttctatgtatgatacaaagctagaaggaaagtgaagctggcataattcaaacagagataattaagttattctcttacggtcaattgacatgatgcagttctgttgacaaaaccattgttatacttacctttgttatgctgactgatgggaatgaaattccaatgaagaagcccaagagcactccaataattgttaccataacaatcctcatgctttcatttgttaatctaagtacactgcaaatatcaacatgtcagttgaacaaggagatgatattagttctggtgctgagggtgtagggggtcaaaataaaaagagaagtatacaaacctgcgaacaacagctgcaagttttcccatgctgtcgtgtacgaatgtaaccgcaggagatggaaatcagcaatgtgcaattgctactcattgtccagcgagttcataatgagggcagctttagcaggagtggtggtgtggcattagcatcaaatggctccgaaaaattgaaatcctagagtgcatgcattcagagggtcagaagtctttgaagaagttgtcttatgtgcataacttgtgcatgacatgatgataaagtaaagatcaaacagaacccttttcaactgcttctaaaaacagtgacgtctaatttaatactactagcaaaacaagagacaaggcgttttcctcaatttgcaagtgaaactcaagtgctctaagaaatggcatcctgtagaatgaagagagaacagctggatgaaaactctaaatttctttgatgttaagtgaagacacctgcctgcatctatttatgggaataaattacttactattactcctcctaagagatgccaggtaatacaatgatgtaagagtgcaaacaagttgaacactaattatgcttacggctgcagaaggtaggcagctccagattcaattcccaacattaaaaaaatacaatctattattatagaaaaataatattgaacataaagagcaaagggcccatatgaaattccaattccaaatccaaacaaaccatctacctactactactacccacagggtgagcttaagttaattttatttttgcctccagaaaagaaaagggagaaaggaaagatcttttcttttgcgggcggggcgcagaagaaggaaagaagagcataaagaatgaagattgatgatttaatctcacctccggcgacagctcctggcctctgggcccccccgggatggtaagaggggggcggcagcgccggaaaccgggcggaaaggaatgggaattccgctcgatcgccggctgtgcggcggcggcggcgggcaggagggggcaatagaacgtgatgcgcccgccgcctacctaaatacggaggtgggggagagagagagatctcaggagggtgggaggggcggaattcgtgggatgggaggcggcaattcaaggacggcgacgatgagatgagccaactcaactcatcaacacaatggaatggaagaagaaggaaccaaagtggacaagggaaagttggcgaggcgagaagaaacggcaggcagccaaaccaaccacaggattccaaccaaccaacgccgacgtggacccgcccgccggttacaggccaccacgcacccgatgcactgcacggcccagatcatccactccctccaccatggaaatcgtgtatgcaacgaacaacgtgcatgtgcatccttgtagacttgtagctcatgctcagcagcaggagcttctccaaaaattatgtttctttgcttgtttctttgtttttctagctggaagtagccaaccacctaacaatataacatgttcttgtctaatttggggacctactgccaccgcttcttcttcttcttctttggataattttgaagtaataccatgtaaaacttaatgtggataattttcattaaatttaaatttgtgctatcttattgccggtcaattagacaagcccatcgtcaggaaacagtagccgtttgcagttcgcctttgcgggtggaaaaatgaaatgaaatcaataacgcacagcagctcatccaaaattaatcctctagatgcctatatggatgggccatccaaaaaaaattcttctttatatccttnccacnntcatggatcatncatattacattctncatatcacacatttctatattntagtaatatttttaactaccatacattattatatatttgagcacttttttcagnctttttttcattttntctatcctttcaaacttcttttttctcttnttntttgtncgaaacgcggcaacactgagtaagcaaacaatctatggttgcggcgcgttaaggcccggcaattgatggnacaacgcgcaggtgcaaacaaagacgncccgccgagaaccgggcccgcgcgggttgttaattccccccgagaaccgcgcccggtttggaaaggaggggtttttcaaaacttccacaccaattgtggggccctttacccttttcttttcgaagaaataacggaagccctgctcctgttttatttgtggctgaatcaatgggggggtccccaacaaggtgtatggctagagaaaaccaattgttccttccaagggggcccaataaaattggtttttgcn

SEQ ID NO: 33 - DNA, 10510 bp, Oryza sativa
  unsure (1)..(10510): unsure at all n locations
catgggnnnnntttgangtcaatgcggtgaccgcagncgnttatcaccgggcgatggagtggcgacacggcggcgaggtggcgagcagaggagcggcgcgggcggaggagcggcggcacggcggcggggttgctgacagtcgccgggcggaggagcggcggcgcgggttgcgggaggcggcggtgcttcttctccaataacctccccagcccagatctggttggtgccacctctctacctcccttcttccttctccgatagccaatctagccggagatgcccctgatcctccctgtttctcatcctctgctgccgctgtgaattccagatgggggcgggagctcgacccagatgcagaggttgtgatttggcgtgaggagagagaatcgccaaatttggcattcctctctccggaatggcggatgcgcgaaaattagaggatgtgatggcgtgtttgctggagcccgtttttcttccctcatccgctattttcgggatggcgtacgtgatagagtagctgctggggatgctcttaagtagatgaaaccttgtgtgttgttgcaggaattctatatgataaatagtatagataacatataaagtgtaaaatagttagatgacataattatatatatactttactagcaaaagtaccagtgcattgcgatgggtgaaaaataattttgattatatatacatagcaagatgcggtgtttcatttcttctgtggcatgggagctcgagatgcggtcaatgtgagaggtgggaggttaggactgattcattaagcagtcccatccaatggcatcccatggtctagtatccctcaaaagcattctaaagtactggatatagcgaataagagaagcggcaaccgacatcagcgatagcgagaagaagaggatgaagatgtcaagatgatggcggaggcaatgacgaagtctcgagccggttatcgtcctatagccttgctcggcctcttcctccctccctattctctctagaatctgtagagcccaggcttgtggtcgctactactgttagtaggggtggaaacgagctgagccgagccaggctcacaacaaactaggcttggcttggctcggctcaattagggaaacaagctaaaacttgagctcggctcggctcgagccagctcgagctggcttgcaagccttcctgttgaaacacctcttcatatatattttataattattaaaaaaagcaagaacaaatcatcaacttgtaaaatttaaataagttttgtcgacagggggatacccgtagaccggatatagggggtattggggtccgttggtacgaggatctacgtagtacgacatcaagcaaacaaaagacaaggattatactggttcaggtcccttggtaggtaatagtcctaatccagttggtatgagattatatgatggaaaccacagattacaaagggaatagcagaacttgatgataccaacgagaccgtagtcgagttgatctgactagatctcccggcgacttggctcttgcgcgctccggttccataggctgtggtgggtgtgttggcggtgagattcaatgccttaggtcctgcccagggggtcccttttataccacgggtcagttgatctccaagtaggactcggagatatcggacccctcacaatatggtaaagacccagtcttgtccgagtagaactccttccatccgtaaataccatccctatcacatgatagatttccttaatgtatacggaaactatccgcatacgcgcgggtataccgtatcagtatacaacgtacatctaaggatagagggtataccttatccgtaaccctgacaagtttatatattcaattcttcaaaatcttaatgaaaaatttcaagttgacaaataataactccataaaaaataaataatcgatataaacatatgatggcctaggctccagctcgggctcgtctcgtttcaccaacgagctgaaaaggaggcttgggcttggctcgtttggcttacgagctgagccaagccaaccaagctcgagccaagcctgagctgagctcacgagcccgagctttttttccacccctagctgttagtcaccgcgtgcattgcatgcatgtgctcaatttcgacgcacttgcaactggtcagtttgtcggtttctttttctattttttttatcccaatctacaaatcagttcgtttatgttcatattttacaacttcgtttcttcttctcatctttccgatagagagttctttggaagtccatggatctccttttctttttatttgtactggagtatcatttggaccaaatcatcttgcagtttatttgagaaatattgatgattgatatggtaggagtaaatttcataaaactccaggcatttcgcacaatttatcacaaaactacattttaagagcttgtttagcaaaactacagatttagtatgtccgtttatcacaaaactaccggtactttgcacgatctatcacaaaattacagatttaagaaagttttgtgaaacaagttcttaaatctgtagttttgtgatagatcatgcaaagtatatgtagttttataaaatttactcatatggtatataaacttctaaaatatgagcagataggtggttatgggcaaatattaagccttaatccaaactaacacatatattattcactttgccaataaaatggcagggcatgttttggtatgaaataaatggacctatattttggacagagggagttgttcccataaagttcccttgatttgtggtggagatgatctcatatctgttttctagtcggagtcagggcatatgccacatacatgagtaacttgcttccaacgagtcatcggctccctccaaatctctgccgcgatcacaaaataaatcccaccctgagacatcatggcgtcgtatagagattgagagatgaaggccaaagcagtggcggcgacgtcatggaggatgaacagcagtgattcgacgtatagagatagagagatgaaggcccaaagcagttacggcagcgttatagaggatgagcagcagtaattcgacaacaccaggctacatttgggaatccttaccttgatgttaagttcactgatttcgagttggagaaattgctttcttggatttaacaaaatgtggacatgcaaatctcctccgtcacttaccatcatcaaattcccagttggtaattttttttcaatttttttatttatttatggattaaagctcgaatccgtctatccatgatccagttgagggttttttctttctttatttaatttatttatgttaattgcgttggagaatatgtgaggatgggacaggctcattccttttgagcactatgcggattcatttgatgacatgcccttgtatcagacctatcttgattagttttttcatgtcaatgccaatgaaattgttactgctgcttatcatctttattttaataatgttgccttgcatgtatctatacctccctctctcaatctgtctaaaaattttcttcttcttacactaaactctgtacttcaaataaggataaatcttctcgctggcaacaaacagtttctcccatagtgatgttctatgcctccctctctcaatctgtctaaaaattttcttcttcttacactaaacactgtattgcaaataaggataaatcgtctcgctggcaacaacaaacagtttctcctatagtgatgggatagtcaaattatatatctaataacttatcttaagagtttaactggtggccaatacaaaatcgtgctgcattgcattcttataagtatgcaaaggctaataaattcaagtttaaagattaggtagtactattatatatcaaataagatattgttacatttgtatttatttttatttcaaaagtctttccatccttattttaaacaatttacatatttaatcatttattgtttctttctcgtgtttaaggaataagaaaaccttaatctccgagtgaacaaagatggttaaatgggttaaagtcatttcttttttacgtttagatagcagcggcatccaataatgcatgatacactccaggataacacatcaccaagacgtccctttgtcacctatgctattgcagtatgctattccaataatgctattgcagtatggatagatcgtgttcttttatgcatgtgttttatctctaacaattagaataaataagtaatgtatccaatcactttcactatttcaactttataaatcattgtcatttatgcttgtgttttagtagatgattgagtggttaaggcaacagaagcgtattcccatccatatatacgaaactaatttgaaaatttggaacttgtccttacatcttgcaatattaccgtaattcttgttgtatgtgtatttcttttgaagagatctttggtttatacatgactttacttgatgataattttagtttttttatcaactgcaaattaaactaattatctcaaggatataacaataaaggttgtgttgttgctgcagaatacgtaaatattccaataaaacatgtgtgtcataaattttctactacgtaaagtgggtgaaattagatggaatgaaatacatacctaggttagcgatgaaatggtttctgagattgataatatgctattgatcaagtaaaccgacctacaaggtatatatgtaacaattatgcttcttttatttttctacaacatacatatatttttatgtgataagtgagatttatgtatggttattttaataagatgcatattattattattatcattattattattactactactaccactattattattattattattattattattattattattattattattattattatttacttacttatgttgggatagcaccgagaattgtggcttcagaaaaaaaaaaggtgtagaaagtttttgtagacacaaagaggaatatgaggtagaatattgaaaggaaaatgtcttgtaggagacctgatttctttaggtgaaattattagggtttgagtcccgattttttaccgttatctgttgggtgggtatcggctcaccgttactatgtctgaacctaaacaatagaatcttgctttgtgtcattttgttggttaaaatacactgtaatatactaatattattaggccaaatctaattttagagtatgtgtgaatagttataatatatgatgagtctagcatgggtttcctgtttcacaagtgttcgcgtggacactttatcgatacttatccctttccatcagcatttacttatcctttccatcataaccacatctactcttgcacaattctgaatctaaatttttttggagatagggattattagctctataaatccacggatttagatccacgattacattgataacatttggataaattattttgtctctattttagataaaacttaaaactttaataaacactataatttaacatattgttgtcgattgacaaatacgttgttgaaaggaaaactacactctattatgtggaaatgtaaagtggaatatatatcgatttcttaaaaaatttaatgtcctattacgtatctcttggagtctatttatagttttacaacccttggtttgcaaccctagggtttgtttactcgggaatttacttaaccatccttataacaaggatatttacaagggtaacaatagtctttttgcccaactagcgggcccatgggctttaaagatcccgtcctaagtttcttgttgggccttcttgagtggtaggcttgtttcaagccaaatttttttattttttatttttttattaaaatatttacaaaactaattttgtgtttcaaaaatttacaaaactagttgcccgccgccttttgggagggtgattttcgtgacgtggcagacggtcgttggctcatgcctaacggctggctataggggcctgcattttgtaggcggccccttgccgcccttagggatggcggtttaacactgttcagggggctgcctgcaaaagagtggcgagggctcctggaattttgcgggcggcccccttgccgccctcggcaagggtgattttcaactgtgcgggggccgtctgcaaaagggcggcgagggcccctagaattttgcaggcggcccccttgccgcccttagggagggtgattttgtactgtgctgggggccgccaactttaagggcagcccctggcgattagctccgttcatttagaaaatgtagtaaattgtcactttaaaaattgtgaaaacaagaaaaatattattagaattgaatggtaccttgtttaggctgtttggagcccaacgaagggtgtttttacatcgaaatatttaattgttactttaaaaactacgtaaatcatcgtttcgaaatcgaaggaggaatggttccaaattattcagtacataaacctaactattttgcacttaaaattttacgaaataggtattttacataaacctgattttttagcacttaaaattaggtaaaatatcgttttgaaacgaacaaagtacgtacatttttataaaatttgaataatctaatttttcaaatagattggagggtgatgagggggtttgttacctataaattgtcagttatgtataattctcacgtatgttgaatcatgtacacatttgaaggtagaagttataaaaatataagcatgtacttataaattataaggatacaacgtatcgtggcgtcaaagaaactttggaaattggaacgatacaatcacattaatttataattcgtgacgcatacaacaacacaccataataatgaaacattataatgacaagatagttaagaagtgccatggataaaagatacaaatttgtcggtcctgtcaaatcgagcctgagtttatctaccgaccccttctgcgtcgttcaacatgtattgcattttgatggtccttctctcgctggtactctacctatgtttcagactcagctatcttttggccatcatatgttggattgacatcgtcgatccataaagtgaatccgcacctccttggattgccctaagaaacatagttagtcatatagaatagtaataataagcagatgctagttaaatttggaatttgttagacgtacaacgaaattgtcgtctacattggggcaggcaaaatatctcctgccaattgtttgttctgcaaatgaggtagccacttggcagcgatctctacaaccgcactttggacgctccgaccatttaggtaaacctaatggattgttcctccagtctaagcttgcaatttgtacctgatgttcgtactccatccatgcctaaatgaattgcgtggtcgtctcaggttgcgttatcgtttgaccaatggaagtaactctgaccgtattgatccattgtacgaattgacatttcctaacctcctcctatttgaaaaattgcgtaaggagaggtaagtgcatgaaagtagtgattagtggtacccaaaaaaaagatacttacgacgaaatcgtcgtcgtcaatgttaggacacacgaagcatctttgtcctcgagttcgttatcttacggaccttatcacctgacaacggtcaccacaacgacactctggacgttcccgccatgtggggagtcctagggggtttacctgccattctagagcttgttcttgaattgcttatagaaattagcacccatgtgacgcatgcaccaccgactccgaaggtcgggccacttagctggaattcccttctcatcctaaccgttctgcaagtagtcaatagcccgcaacatgcccgcatgatgatcatgtataaggcagacattgggcctcatatgcacgacttcccttcgcactctatccaagaaccagtaccagctttcagtgttctcactctctacaaatgcaaaagccattggtaacacctgattgttcccatcaactccaatcgctgtcaatatctgacctttgtgtttaacggtcaaaaaagttccatctatgcataatactggccggcagtgcacaaatgcgttgatgcaagcacccaatgagaaaaatgctctttgcagcacactcttggtaggatcaacagtaaaatggaaatgtatgcacatcatagtatgtattgctattcctctaggcaatggtggctaacagacgctgcaaattatcatatgatgcttcaaaagtgccatacctcatctctaaaaccttatgttttgctctccaagccttggcataggttatggtgtacttgaatttgtcttcaatgtggctaataattgctcttggttcaaagccagagttaccgacaacactgttgtacatctcacttgcaacaaaagctgatgtgatgttgcggtgatacttctccaccccttgtaagtggcactggtgctcggtcacaatgctaactttccaataatctttccatttacccttatatgcatgaacccgccacggacaatcttctttcacgcaacttacttcatacacataattggttgacttgaccaccctaaactctctcatcaatgagactgcccaatgcttcactgctgtcgacgtttgatgtcgcgattccggtatttatatagtatggggatcattggtactaggatatatgcgagattgtagtaaaaaagatggagatgaggatttttatacaggttcgggcccttgaattgtcaggtaataaccctactcctgttggccgaagccggtcattgctcttatttaccataatcacaccagtacaatatttggggtagcctatctatctgttgtcgacatgccggtctgaagtgctgacacgtagtcgacaacagggtagccttcctcctctaatccttgtccggtgagatcagagacaacgctatgtctctcctatcagtatccgtagacaccataggggactagccatgcttacctctgaagtccatatccgacatcttgtcttagcgcatgttggcttgtatgttgatcttgtatcttgatctattgttccatgtcccctctcctcctagggggccttgtatttatacccataggtgtccccctgtccaaatagaactagggaaaccaatatggatacaatccgagtagtccttgttgtttccatgtagaactctagttgtctttccttatccggaactcctcctatatccgaaggttgtttccgtataagacatggtatgtggtgggtcctgccgagatttagtcaactattattaggtatgtggtatccataaccttgacaactgccttcttcatatcctccttatgagcatatgtagcaccctgaattacctcgttgtccttgtattcccagggtacatgatgcccctctgagataacaagtcctgagaagtcctcgtttgtctaatcagtgggcattacatcacctttctcgtcggatgatgcatcgctcttcgcttgctcgttatccgaatcttccctctccatttcatcaacgattgtactgattctctcctcctcatccactacacccatggcctgcatcaccccgtgtcatttccctcattttcccccgatggttcaatataatccccaacatggcttggaccctcgacatctttggtttccattgcaagatttctatcattttcatgcactgacacaaaaataaccaagggccatgacctttcaaaagccatctccagataccgtttccaagcaacagtgatatgcatcggcatgagttcccaaaaataaccttccgttgcacgactcactacaaacagatactgacattgtgtggacttttaagtctattctaaatcctcgcttcaaccaattataaattgacttaaatgatctctcaatagacctatcgatgccctttaatgtcattacaaaatctgacagatcaacacatacattggaccaatctaaggtttgccttcaccgtgaactattttgaacatgaccttactttgacattgttgcttgatgaaaaactaactaggttaactaagttcatatcatactaaccagatctaacgccggattcaataatacatactacgccctatcttttcaaaaacataatatcgcctaaggtaaagacctacacattagtggtttggcctatgtttaaattttaaaatagggngtgtgtgctccagagtactaaaggtattgggaataaactaaaaggcaaaaaaactggtaacactttcgaggaattttactctggatgagtaaaaaccacaggggttgttggtcccttttctcccctacacctctcttttttttttggttttggcgaaaaggaaaaccaagggggagggttttattggggggtaataccctcctagggcgaagggcctttgaaaaccagggtcccgcctttagggcctcacagttacacctctagaggaggagggcgtgaaaaaacgccttccctctttgggggctcaagtaaacctcttaaggaggggccttaaaaagctt

SEQ ID NO: 34 - DNA, 18114 bp, Oryza sativa
  unsure (1)..(18114): unsure at all n locations
tgtcggagtcggcgtccgtccgcggcggcgcgtgacgacggatgttgcgacggcgcggacgtcaccggcttgcgaggggcagtgtcgcggtgcgggtgatggagccagggcagccggttgcgcggggtgactgcgtgtggtggcgttgcacggctcgggtgggctccggtgagctcggcggctgcgcgacgtcgcctacgtgagctccggcggggttgcttgctggcggtgagcctcctgctcggtagggggtttcttctgccggtggcgagtctcgtgctcatgtgcggcgatgtgcggatgtggagttggtatggctgcttgtgagacgtcttggactaatctatggtcatcgatgtgggggtgcttgtgtgggtgatgtgaagatgctagtgaaagccttgccgtgcctttggccagttcgacgaccacggcgcccgcgggcgccgtttccctttttggaggcgttgtcatggcgttctttcatatccccgcaatctccaggtgtaaacctagttccgaattcggacaagcggcggcggcactacgcgtcgtgtcctccttgggggcgtcgcttcggagaagttccaacgcatcgacgactattgatagtctttttcggttcaaaagctttcataccttagttcggcgaggccttcgccttcttgggtccgtttctttcttgtggtcggtgacaagctcttcggttgtttttgctgatgaagtcgaagctgctcgctgatagggtgcggcgatgcttggcaacgatgacatgttgcagtatcttccaaggagttctggtgttggctgtgtgaaggaagtggctcctcggtggcttcgctgatgtccattgttggaggtcggagctgcttttcgctttggcaaccttcgtgccttcaatgtcgctgcggttgtgaagtcggcgctgctgggtcgcttgggcggctagctcggcaacgataacacgtcttctacgatttgggagctgttgtgtcgcttttgtgtttagcctagcagcgacgtcttgcgtttgggctccgctgtcgttgttagatctgtagcggtgggttttagccggttttcctttaattaaccgtgcaattgtacggtttttgggtccggtttttcttataaactgggtcaattctcttcttctaattagaaacgtggaacaaagttccgtcctaggtttcaaaaaaaaatattaagggtaaaagccatgtgaaatgttagaaatattagctgaaaacgtcgaccatatactcctaattgactgaggcagtagaggctagacataaacaatttgcagaggttggtttgcctttgaccacagcactcaaatccgggggcgccaccgggaaaataaaattcagccacaaatttcttctaatttttattttgaaattgtttcagttatcctctccctgtcaagattgtccagctaaccttccaaattatgatctactcactccagaagcttctgttgtcctgttaactgatagcatcttctcttctaatgttctgtggactgtgtttaatttagcactagcatttaatttggggcctacttgaatatcattatattatattgctaaaatttgatggtttgccatttaatttgtttgtaagttcactgaatcatgtgtaatctagatagtactaagttagtggtaggtgtgttagctccctccaactgaagaagatgagacatgcaaagcaccctgcgtcatgtacaacccacaaagttctaattaacgttcttaactatatataaaatatcataacaataactccttaatgtgaaaggtaaatagcctctttgagtaatccacatgaagatgtggatctgaaagacaaatgaggatgtagatctgaaaacaattgtaaataaattcataggataagaaaaagacaatgcttgatttgatactgctatggtcactagtcataagagaaaatgacttcaaagttggaatatgttttggattgtcaataggtgcttcaattggactctcagctgagccaccaaccttacaacttttgagcggctaacataatattcctttctccaaataagcaagaataaaaaccagagttcaaatacaattagaaaagattaacatttacttgctcggttttacgattccaaaaagaaaaaaaattctactatgttttctcgcatggttattacgacaacgtctaccacatcatgcatgcttttttttcattaacggtttgggtgggacaaatatactccttccgtcctcaaatataagagattttgatattttccttgtactgtttcaccattcgtcttatttaaaattttttaaaattattatttattttatttgtgacttactttattatccaaaatacttaaaccacaacttttcgttttatatttgtacaatttttttagaataagatgagtggtcaaacgttataagaaaatagtgaatattccttatattaggggacggagctagtagcatatattcgattaaggattttaagcagtgacagtgattatagaccaatccctttggaattatgataatagaaattgaattgaaaagggaaaaggtgaaggaaaagaggtgtgggtttagccgtttattgaaaggtgagatgggggtaggtaagctaatataagctctccactcctacaccaacacaacacaaactccgatcttgtttctctctctctctctcccttgtttcagtggctcagaaattttcctcttttcttattattgctttcctttatttaaggaaggagttgggctctctctctttctctgagtctgaatccccacgagacgagaaacctagcaaaaatctcgtctttcgccgcgctctccctcctctgattcctgctgttcttgatcttggatctcaattcccaaccaagaacacacagacagagaaaggaaggagaagaagatgtcgaacgacaacaagaaggtgtataccctggaggaggtcgccaagcacaactccaaggacgactgctggctcatcatcggcggaaaggtctcatcttttgtttttcttttcttttcacgcttttacttacttgtactattcgatttcatgtttcgattcgtttcgttggttcttggttccctatcctccaacaacgtcctgagacctcgatctggtcggagtccacgaccagatcttggccgcggcgcagatctggccctccagccgccggcgtggggaccttgccagatctggtcttctccgacggtggccaacttctcttgtcccttggttgcagccaccaaacctcttcctcccctcctcgatccaaccttggtcttgttcatcgactggccactaaaccccaaataagcgagatagaatttggattcgtttcgttggttattgtttctctgatgctgtgatggtggctagatcatggcagatctgcccagtaaagtcgaattttgtttgattccaccgcacctcctgaggaatcggtccaatcctgtgaattcttctcttctttcctgctgattggattgtctacatgggctttacctggaaacaggggtgagtgctagcagattcaaacatcatggactgactgctcctaaacaagttccatatgaaaacctgttctacatgctttttttcttttactcttcactcgttgtcagtcaaacactgcaaaatttgtccctgcgcctattctgcaagagcttcttgttagtacaactgaagaatcaatcctctgttccaacttggcatctggacagaataatgaatgtttcataggaaaggctcagctcaactaagtaaatcatgttgattggccttaaaacacacttcattaagagtctgttttttttatattggacatgataagaataatatggctgttttttattattaatgttttttcttggtaacagtgcttctattgatgaacctaccctgtttacctgatctcaccagtgttctgcaatactatccaggtatacaatgtgtcgaaattccttgaggaccatccaggaggtgatgatgtcttgctatcttcaactggtacgccttctcaattctcatgttctggccttctgagtagtgaccactactgatgaattaactgagtttgcaatggatggtttagcttacactttgaaatatacatggaccttctgcaggcaaggacgcgactgacgattttgaggatgtcgggcacagcacgactgctcgtgcgatgatggatgagtattacgttggcgacatcgacacatccacaatacccgcgaggacgaagtacgttcccccaaagcaaccacactacaaccaggacaagaccccggagttcatcatcaagatcctccagttcttggttcccctcgccatattgggcctggctgttgcaattaggatctacaccaagtcggagtccgcttagtgctgttctcttagtgttataagagtggaaggtaccgaataagttagcaagagttttgtgtgattcataccagtgtaacatgtcatgaattcgtcgaatgttctgaagatgctgtgggttttgtggtcctgggatgtccacttcggtaaagatcgataagattcaaagtactcgttaatcgttatacattctgatgatggatctgctcattgttattaattgttagaaacctatacatacacaaggtggtgattttattggcgggtgtttctattgaatttctgtttgttaggaatgcagatttaacaggtgttgcatttgcttgttttttgtgtcgctagcttttctataactgatcgataatgtggcttgtgtagtggatgtttactccctccgtcccataaaaaaccaatcgatgttggctaggctagtttgtttgggacgattcattgtactagaatgttggctagactggtttgtttgggacggatggagtacgtaatggctagactatccatccgtaatactggctagactagataatatagtggagtttcaccagatgaagaggggaaacctaaccaagtcaagactcaagactggctgagttgttaaccatatagtcacgccacatgaattgattttgccacaacagagattacatgtccagctttatacgtaaccatttccattatctataaaaaaatatccagctttatcagaccaagtaaccttcacaagcatatttggagtaataaaacaatggtttccgtaacacagccagttggaactacatatcatcctgattaacaacggtcaacagaagtttctccttacattggacagccatgacacgtcgagataactggacatcaccattgtcatccatcacacagcatgttattgtgctatcaagaagaactactccatcttggatgttggtggtgcaggctgcgatttctccactgaaacatccctcgacagccttgatttcaacagtagcctccactgcctctttaaccactgcatatctcaactccacggtgcctaaatccaacttactcttgtcaaaatatatcccataacaggagatgttatgctaatcatattagagacaatttcagtctctcgaactttgctatccagtatgtgagttgaataaagagttcatgattttttttttaaaaaaaaacctaaaccctaaacttaaaaaaaaaaaacctccacagtgcccagcttaccaacaaaagtgttgttttttcaccttaatttcgacaatttatattactctgaatgccatcaatcataagcaatcctttgctgtgcccttttctcttccctcttaatcggtcatccttaatactgagatcaacctcaaaatacacagcgtcttgtaccaagagtcctcgagttggtccagtcatgaatcgtcctgtgaatcaagtaacatgcatgataatgttgtgttactttgaatgcaactgtaataataaatataacaacaatttcaagtagaaacgtcatataaattataaaagctatcaccgaagatgatacaagcatgcgtgtgttcgcatatgctgattcccaacccggcggaacagtaacacggaaaacggaacagtccattagcacgtgattaattaagtatttgctattttttttacaaaaatggattaatatgattttttaagcaacttttgtgtagaaacttttttttttaaaaaatacaccgtttaatagtttaaaaagcgtgcacgcgaaaaacgaaggagatgggttgggaaaaagaggtgccgaactcacccctaggtctacatctacatcttactaatgccacgacatggtcaacggctgacatgtagaactctaacttgtttaccatataacttttcgacaccgacctcaacatcctctccaacctcccttgccggccgccggctgcgcccaacggccccagctcctcccccaccgccgccacccagttcttccctatcgcccgccggccgcaccaagctcctcccccgccggccgagcccgctacatcgtgcccagcctctccatcacgcccatcgcccgtggaaaggggaggggaaaggggaggagagagaagtagaaagaacatgctgatatgtgggacccacataggtcccatgctaagtcagctgccacgtaggataaaaccggatgcaatactgccctagaagctattgtgaccggttttgattagttaagagacgtcggatatctggttttacggtttgagaacatttttataactcgatgacgagttcaggacctgcggtgtactttttccgactttagaagggaacaagaaaaacaatttgggttacgtgatgggagataaagagaaatgaggttaaaatatttagtgtaaatttcacaaaatctactacagattttaagatattatatcacagaactataaatgtagcgctaattttataaaaaaaaactatggattttagaccaagtatcatacaactacaaatttaatatttaggttatcataaacctatgtattttagagtttaaatctctaacactaccgttatattgaagctatgaacattatacttttatgattaaattagcactaaacatgttgtgataaatttattagttaatctgtagttttgtgaaactccatcttaaatagtagttccacgataaatttgatgctgaatttgtaattttgtgattcaacattttaaatctgctgtttgttttagtttgaacaaaatatttttagttctgtgaaatttactcaaatatttattatttacaccaaccaaatattttacagatcatttaattaactattatactaccagtacttattattctaaggttgaccaaacaactttcacacgcatcttgcaaagaccacagctaatctcctcctcatcagagcctctagtgaatggactcaactccaaactgcaacccgagaagacattgtcattctgagcatgaatattcagtatcaacatttcattcactgatactaccacgacacgtcgcagtagttgaataactctgtcgtcaccaactgtggttgaacaaccaacaacatcgctgtcatacaacaatacagcatgatttgggacatttgttgtgcaagcagtaattttcccatgaaaaacttgagcatctgacaggatcttgatctcaactgtaccttccagtgctttcttaacacagttaaatacaagttccacctcactgagcctactctccaaggtttcactcacaatcttaggctgagactcaataaaatagatcttcatatcaacaagtcctttactaaattccctgtctatgcactcttcatcttccctgatcttcagatttatctcaaaaaatatttcaccccaaaaaacaattcctctacttgggcccgtcagaattagatcttcattctacaaggggattacacaacgtcagcaatgtcacgctaattttacgtacaaaagcagatgccagttattcatagaatataatcctgttactatattgaccaccttaacatctagactcagatcaggaactttcttcagattaaattgaattgctatggctgagctcatcaaatgcagtaatttggctgcaacaattataatataatgacaagactaatgaaattatgataccaaaacatgacttataatgatgatatccacaaaaatgtagtagtcacacaagacatgaatatagacaacttaaatatgataacgtcataatcatatctagctttagagtgctttcaaccatacaggactgtaaagaaataagttcgatcatcaaataaaatagggagaaatttgtagtgctaagacatattctatgaaatacctctgaccgaataacttggcaattgtccctattgcgcgggaagatggtgatgcaattaaaatctaatatgtctctgactatcacagtcccatacaaattgataggatagccaacatctgaggacaatatcttcacagagagtacatttaaggagctagtgaattgatggtcctctttgatgatggaatctgcaaagcgcattggaccatgttgtgctgagagaaatgaaaatatagtaagtatgcgcaaggggaagaatagtacgttaacggaagcaagtactgaaatttactgataatgcacaaaaatgagagaagtttgcaaaggctccaagtgtgggttcggtcaaaacagtaggtttctatatactcctttaaaagacctcaatgggggtggtggagaatctgccaccatcacctatccactgatgtaggttcatgctgtcagtgtaaccacggttgtgcttgaaattcacatgagtgaatccatcatctaccactctacatcaaaaggtgagccatatgaaccagcatcatccattcacatcgaattccaaagaaaatatgttttttttcaattaacattggaaaaagtaatgacataatttatttttaatttcgttgcaatgcagggcatttagctagtagtatttaattttgttaagcctttgtaaaatttaatcacaagatgcagaaaactgatgaaacaatcatcacaaaacaaaggaaaacagaataataataagagtaaatttcactttgggccagttttaatagccaaagtttcactatggaccaggcctaggcccatatttttacataacaccaggtaatatgaccttccattgcactttggaccaggctgcatttatttgggccgccacgtcgtcttcagcccaatccacgtgagcagcagctggtggactcagttcacggaagaatcatacggagcagccgagacacgacgcgtataaaactagcgccagcctcatccgctcgagagaaaactagcgcagcagaaaggctgggcgccccaccgccgccgcagctgccaccgccacgagccccgccgccgtcgtcgccgcggccgtcgcgtccgccaccatcgccatcgccgccgtcgtcgtcgcgtccgccaccatcgccgtctttgccgcggccgccaccgtctccatcaccaccgccgaggggactacacaagctcgcacgatgggagcactactcagcagccaccaggtgatccaatttaccacccttgatccatctctaatgtcaactttagtgattcccggtgaattgacacctcaagcaggttacagtagcagtggaatcgagcaactcgaattggtcgaatcgaggggtgaatgttgaatcgccgataatctcgtgtgcatcaagcatgtccttgtctgtttcgtgtacagacaatgtgccaatcgattctatgattaggaagatgcaggatacaagggtaagttagggttagggatttaattgggggttgtttaattaggataaacttgagtacgttttggttgaaatagattgatttgtgtgtatttggacggctaagcaatggaattttgtccatattgagtgcaggagtatgaagtcgaccagttgccaaagtacaaacatgaccccaattatcatggcaaagaacatgatacagatttaagatgcttgtgtcaaagaaggccagcccgtcgagttgcgagttcaagagttaacacagagagacgatttctaggctgcccccaaaaggtagtactgtgccattcgaagcatgtgcctttattttccatagcttgtcatattgacgcaaaagtcaattaatgcatatcatagaggaagctttcagtaatgtccttcatttatctattatttgaacaaaacaggtgaaataatctttacttatgccaaaatgttgatccatttgtactttatttaagtcatctacctagatatctaaatattgtgtgcaaaactgattttatcagcatgtgttttatgcagtgggttaagtgccattttgttaaatgggtggatcctgaataggatgagctggccgcaaaaacaattttatcacttagtgagagaaacattgtgcttgagaagtcgctcgatgatgtgaacaaaagctggatgtctttgtacgcgaggaagctgtgcgaggatgacatctggagacgcaagttagccgatgcaaggatcaatcatgtcgatgacctagataagatcaagtcaattggtgatgacctagtcaagatcaagttaattggtcttgttgtgatggtgaccctttttgtaagtgctgttgctaagttgtttgtgactctgtagtctgaaggacatcacgtagagtagttgtttgtgatatggtcctttggtaatgtggttcttttatagtacgatcagtatgctggtgaacttttagtttgtaagtatgaagggatggtgaccttgtagtttgtaagtatcaaggacatcccatggccagttgtgatctgatcgttttggtaatgtgttcttttgtagcccagccttgatagataggagctgcttggaaatgtaatgataatactatggtcaggatattattatctcttgaatataatgtgaacagtatgaagttgactgtgttgtcctcagactaaaccatctttttttttagaacttaacaactttattaagctagaagcaaagtacatggtttaggtaacatctccaaagggattggagaataacatctccattgtaggacaagacgttgaaattttctgaagattatgatctacatgagttactgacagaaggtgagacaaaatgtcttgaatagctgaaaaggaactgattgatccatagtcaaaattaagatctgaaagaaaccaggttagtttggcaaattgacattgaaagaacagatggatatcattctctggtagactacaattggagcatttattctcaatccctgtaatacgaaagttaagagcagctgcagttactgaaccgtgaaggaaaaaaaatcaaccactgagaacctttaatatatgagcaacttaacatgtacacaatagtagcatccaaatttgtaggtgcaagggtgtgcctctaatggtttagatgacacagggagtactcaaattgacatcaaggattcatgactaaagctatataactacaagtccacaaaagtgtactgcattacagatgttgagcaaaatagaaggagcaaacccgcatgaagcactccatcctattttaacagtttaaggttgacaatacaatatagcagagtactattacaatatattagaagtctatagttatataactactaggattttagtttatcattgtaactataaaccaaaaggcctatacaagtactacagcctgcactatcttatgtactccaaaacaaaggccactttctttgctcctagacttctgttgagacaaaataaattgcgacatcactgtgttgagaaccaggtgttcaatctgcctctgcccctccctcttgcacttggtcggccccttgcactacccctaccaccaatcatgccaagagaaggagcctcgtttgagttttcatgggacgaagatgcaaccccacgttttcttgcctatacaacagaaaagattagttgtttatataaaaattggccgtaaaattgataaagtcaaactaaccttaatgtttgagcatgtgtgtccatcccttctacagtttgagcatgtacttgtagtcttcctcgctggtccttgcaccctaggaccctcatctggtcctctacgtcgacttttctttggccttccaacatgtttgtcaaactttggtggatcaatataaggtgaatctgtttttgtccatctatgctcatcagggactggatagataactgcagtatatgttctcatataagcatccttcctaaaataatcagcgacataatcttcaggtgtatgccctgccttgtataaagcacaaacatcatgtttgcaaggaattcctgttagttgccatttgtgacatgcacatgtccttgcacttatgtccactgcgaaagatctatctaagcaatgaacttcccaagtagttaagttagactgataacaccagcaatatcttgcatgattcttctccatctctagttttcctgccacaattggtgtaatctcccactgtgcagcatcccctccttgcctctttaaagataaccttaccattacttttctccttatgtgttcgaccatagtgacaatgggtttgtcccttgcatctagaatatatttattgaacacctcactcaaattattgacaactaggtctgactttgctttaggtgagaaagcatgcctactgaagtgttccttgccaattgcaataagccattcccaagctttcaagttcaatttttttaagtcttccatagctttatcatagtcccacacggttgtggcataaattgcagcatcaacaaaacccttgtatttctcacctctccaacctttgttgcccatattttgcaacaaatgcattttacaatatctatgctcgctgtcaggaaaaacaattgggattgcattcataagaccctacaaagtaataagatcatttttattgaaagaatatcattacttaacgagaaatgattttaatctagacatgtaatgtaccttctgcctatctgacatgaaggtccaaccaccatgttcttctccagatccaattgcacacttcaacatttctaagaaccatgtccagttgtctgtgtcctcttttccgacaactgcaaatgcaattgggaacatgttgttattctcatcccttgctgaagctgccaacacctgtgcaccatttgttagcttcacaaaacaaccatcaatacctgaaatttacagtcatatatatattagtacagaaagacatcatacaaaggtaggtcatcaattacttacaaatactattaactcacttatgaaaggcctgcaaccatttataaagccttctttctgagcactgaaacatatgaatagtccactaaatcttggtgctaatcctaaaacatctctattgatggttgtcaccactgctgtagtgcctgggttggtatcaattaatgtttgcaaatagtctctaatcctcttgtattgcttttctttattgcccaggaccttctctgtagcctttctccttgctctataagccttactttttgatatgtatgtgcctgtttccctcagacatctggccataaaagcttcaaccttccaatttggatcactccaaaagtcatcctcatatctttcgcttagccatgtgctgtcaactcgggtgcagtttctatgacttggacatgtgtggggagcaatcatctctctaaccatgaaggttttctcgctcccaacttgtgatgctctaatgaagaaatcacacttaaccttatcttgactacacttcacttttatcctatcagctttattcctggtgtacttataatccctcccttttacaatgtggtacgacttcaaagcctttctaaattgtcctgcgtcggtgaaacacatgcccttgcacaattggcttgtgtccatcatattgctctcgtcaaaataaatcctctgaacttgaattccttttcctctcctccttttccctggtggtggtttgttctcttcgtctgtctcacattcaagtgtgctcaatccaccatcctcactaggtggatcagacagctcacatgacatatcgtctatgtctgcaacacccaaatctacatcagcgtcctcaggggtatacaaatcatcaatatcagtgtcaccttcacaatgggtcattggatcttccctctgcctcttcatctcatttagtttctcaacataatcgaccttttcttgttcatgatccgtgtcaccacttgaaatgctatgttggtcgtctgccacgcctatcagttcagggttgtaatcaatgttatcttcctgctgagatgaccctgcaatgacctcaacattatcaatttttagaggagaaaagggtgttctctgtattgccttgaacaagtgtaaatcagccatcttgctcttgtcattctccatgatcatgtccttcacatgtgtttcaccttcaatcttggtcaaagtgccacaatagtatgtatcgctacttgtgaaaaataactcatcacttgcttcataaccctctgtttccaatagcctgatcaagttggagtagcatatattatttctctctatctttttctccaaaatatcagtgtttggtccacgatcatgtttgaaaaccctgagtgtccaatactcaccagccatcctatatcagcaacatatgtatatatataaatgttatttgcaataattgtttaaataaatcataggagaagctaacatatataatacaacttcatttaaaccaatataacatcggaaactatgttataggaaaaaatgtttaaatgattagttattttaatttataagtagtttactagccaattaagataccagtcacttaagttgttttattttgtaggtaagtaccactaaagacaagaagtcaatgcaaggggaaattgtcccaagtacaatctttgctatgttgtggcaataattcagtgtacaaggcctcatctcatctctccatcaggtatatgcacatataccttccctcctttgtttgttttcagtggcaaaactgacagctacatcttactacatagttggttgcaaccttacttgtgcaaatgcacacacattcagaaactaaactaattcattcagtacacaattgcagaacctctgttattagtgcatctatatagtgtgtgcaatttatgtaataatcctaattagtattgcatcgcatacaaagtgcactgattgaactttgaaagatgctccttctgggaccaacacacaggagagaagaagattaaagtagattacctttacaatccgtgcaagaatcaagaatgatggagccactgctgcttgatggctacaacagatgaccaaatcctgattagaggagagcagccgagcggccacagcacactgagcagcgctggcgaaatcctgattaggccgaccaaatccaaatcagggcagtactgcagcctgggggagggagggctgccgtatgctgagtgggtggcgacgctgccggcggtgcggcgctggaaccctcgctgcgtcggtggcgcggcgctggaaccctcgcggcttcagcttcgcgccctaccgcgtgacttcccgcgcggttcctttcgccataaccagagtttttcaggccatctgttttacagagttttccacgcatcgtgtctcggcggctccgcataattcttccgtgaatcgagtccaccacccgctgctcatgtggattgggttgaagacgacgtggcggcccaaatcagtgtaacccggtccaaagtgcaatggaaggtaatattacccggtgttatgtgaaaacatgggcctaggcctggtccatattgaaactttggctattaaacctggcccaaagtgaaatttactctaataataataatacttcagatgtcacgcacatttactgtatatcgctatgggtgaaatattggatatagttaagttcagttcataactatgcttttttttgtgtgtgcttattttctaggtgacgtatattttgcccctatcaactatagccaagtcgaaatcaacccttcactatgaaatcagatattctacaaccctcagctaactgcaatcccacctgtttaatggtgattttcatgatttcgacaaataagtgctaatccgatgtaccttgtacctcatgctaatctggtcgagcaaactcactctctttgtcgaggtcgaaggtggtgaggtcgaggaaccatgcgcgggtgtagaagctggttcctgtcttgggatcatactcgaacaacttggacgacaattcttttctcctcgcccacctctccttcgcctccgtcgacgtcatttgcctctcccgctggggctttaggctttcctcccgccgcttctgcttcgccgcttccacctccgcctcctcctcctccatgaaaaacggaagatcaaagccttcctcctccacctgctgctgctcaggcttcgccatggagattccttcgcggacaccctaatccataaataaaattaaaattgaaaccctaatccataaaattgaaacagatcggactgaaccaggttggaagctagaaagggcaaaatcctcctacctcctcttctccgccgccgccgccgcactcgccctcgtggagaagagggaggttggattgggcttttagttttaggattgggaggtagaggtaaaatggcctttacgaaccaggcccaatttatcgtttccgtaaggaataagttcactttggctcccttaaaaagtctaatatgtgaacctgaaccgcaaccctatcttgacccctactctgttaaaaccagtggttttggagagcagtttcactgacgtgcgtctacgtgaaagtgttgacctgatctgccattgacgtggcgcataggtggcatttgaattgaaaacatacacgtgggacccattcgtcattcacacgaaagaaaatatatatatggggcccactgacatgtggggccaacatgtcaatctatcccgtctttctcctccctctctcttccttatctcactcccccttcggtgagcaggggccagtgatggcggcgcgggggccggagtggcggcggcggagacatgggacctacgcgttggcccgcctaacgagtgcgaggccagcaccttcgtcttcttcgaccaaatccaccgacgagcccacctgttacgtatgtcgccgccttatcctcctccttcggttggctcatcccctcctgtgagccgcggcaacggagacagcagtgcggtgctggcctggatgtgagccgccagcccgccaatgccgctattatcgattggggtggggacaagattgggaatcagcgggaaaagatggaggggtggtgagagagagaggcggtggcgggacggagctcggtgccggagctcgagggtggtggggacgatggtgacgggagcaaataatctcacggacacggatatgggtaggcactacccgtgcccgtcgcgcccgattgccatccctagggacagcggtgacgggagcaggctggggcacctactgctcaccaaggcggcgtcggcgtcaacctctccgcgacatcgctgtctcaggctcctctctcatcgaccgaagtggggcggagcggcgaacaaggaggatgccgcctcctgctccgggctctccttcctcctcccaactcaccagccacgaagcttgccgcccgcggcctcctcaacgccgctcccccatcatcatcccgctggtgccacagcaggatggcgcaactccgcgctcgtgtaatatgtttatcaaggaaataaaaattcctagatttctcaaatatagatatcagaaataccatcgccaattaccgtcacttgattcatttttattccaactcgtagatacttaaaaagtactccctcggtcccataatttaagggattttgagtttttgcttgcactgtttgaccactcgtcttattcaaaaaaatttggaattattatttatttttttgtgacttactttattattcaaagtactttaagcacaacttttcatttttttttaatatttgcacaaattttttaaatnnnnnnnnnnnnnnnnnnnnnnnnnnnnnnntcaccntcaaaggcccac

SEQ ID NO: 35 - DNA, 12796 bp, Oryza sativa
  unsure (1)..(12796): unsure at all n locations
caggncatgacatgcagatccacaggagcccancaacaaattttttaaataagacgagtggtcaaacaatacaaacaaaaactcaaaatcccttatattatgggacatataatatttatgagggctgctatataccggtataccgttcggacagtataggcctacaagcagtttagccggacgattccttccgttcaattagtatgtcatgtgtattgtcatcgtgtctcaaaaggtgtgtcgtgtcaccccatcaacccatcatttgtcattttgtccacgcgcatacgcaaaaaaatttttcatgtgatagctaagctagttcggtatagcaagtagtagcctacctagctaccaggtgtcaaatctgatactaggtaggtatcacatctgataccgtcggatgagcatcaagtctattatcaggtatcatgtctggtaccgagtgggtgccatgcctcataacaggcatcgtgtgtgataccggttggtatcaagtaccagataaccggatggccaggtatcatatttgatacatggtgggtatcggtcttgataaacgatacctgctggttatcaatcccagtatcatagctgctatataccggaattccattcaaaaacgatatgataccggttagtatcatgcgtttttgccacatatcaggtgatacttacgaggtatcagatgatgcctatcaggtatcaagcgattcttaccacgtggtgagtgatgcttgcgatgtatcaggtcctgatacctagccggtatcgggtgatagctatcaggtatcatgcgattctaccacgtatcaggtgatacttgtgacgtatcagatgatacctatcaggtatcatgcgattcttaccacatggtgggtgatgcttgcgatgtatcaggtcctgatacctatcaggtatcatgcgattctaccacgtatcaggtgatacttgcgaagtattagatgatacctcatgcgattcttaccacgtggtgggtgatgcttgcgatgtatcaggtcctgatacctaaccggtatcgagtgatacctatcaggtatcgagatgatacttatcaggtatcatacgattcttacaacatagaagaggtatcatgcaattcttacaacgtagaagataattctaccacactccatagccaaccatgaccaggtcaacaagctctttgcaccccgtcttgtctctttgctcccctgaagcagcagatagataggatgaaggcccggactcgcagcgggatcgacggccggcgacgaaggcggcgactggagagggctcgcgacgaagttggggcgctggcgaagggtgcatcggccggccacgcagatggagctggaggtgagtgttaacagcggccccgtggatggtgggcggcggtgctgaagctgcagacagcaatccgacgaccacgtcactgtcggccgcatcctccgccgtcgctccccacgccgggctcgtcgccgcggccacgtcctccgccgtccgtgcctaacgccatgctgaagctcgtcaccggagtccgcgatgccgggggctcatgggggcggccgcgtcggagctcatcgccagcgaccgcgtcctccgtcatgcacacccatgccacgcggctcgtcgccgcggccacgtcctccgccgcccgtgcctcacaccacgctgaagctcgttgccggtgtccgtgatgccgggggctcgtcgggggcggtcgcgtcggagctcatcgctggcgaccgcgtcctccgtcatccacacccatgccacgccggagctcatcgttgacttagttgcagcagcacgcgtgagagagatgttgtagaaagaatagctaggtagaagaagagtggattggttggtgtatatgctatcccgtcgggacggtataccggtatttagcatttccgaatatttatatatacattctgaataaataaattataatatcacgccaaccattttctagttggggggatccaaagtgaacttattccttctcctgtgctagaattgggtctacttcgtgaagggctcaacccatctacagcccatacatccagcctctccctctcgtttcctctctggatcggtcgatctccacggtggagatggtgagggcttcggcggcggcggaggaggagaggaggtgggaggctcttgctatttgccaccatggcggacgtgtttgatcttccattgttcgtggaggacgacgacgaggatgcggcagcggcggcgaagcagaggcggcgggaggagagccagaagccccggcggccgcggcctcgggagccgtggtttctggacacgccggagatgagggagaagtcggcgaggcatagtgctttggcggccaagtattgggagcacgaccccaagatgggaatcagctactacacccgcgccgttttctgcaacctcaccaccttcgaccttgacaaggagagtatgtactctacacctcaactagtatgttgttattatcatcgcatcacactgcaagattactgggatgatgttgttcctataattattcgaattgtatctatctatctattatattattaaaacagttttgaaaggagacaccacgttcgctctgtggaggctagaaattcccacattaatcgtagaaaaagaaaaatatttaaaccgttagatcatagtagatctagattacaacggttgagattgattgtatatatatgtaagtcctattcagattttagaaagatatagcacgaacaatataaatcatgtttggactcctgttcatagtcggattcccagccggacaaagcagaaaggttcttttgagctgattacaacaagctcttaatgactagcacatgctaattttaaaaatatacttgcaagttatatgggttctcttttgctttcaagtttctaatcttaaattctaccaagcaccttttagatattcaaacaaataagaactaagatgtacacgacaaattaaatttctacagacaaatcatccctgcatttttatatgagcatcattaaaaaaatactcccttcgtttcatatgataaatcattttgactttggtcaaaatcaaactgcttaaagtttgaccaagtttgtagaaataataataacattttcaaccaaagacaaatatattatgaaaatatactcaattatcaatttaatgaaactaatttggtgttttaaatattattatatttgtctacaaacatagtaaaacttaaattagtttgactttgaccaaagtcacaacaacctataagctgaaacggaggaagtacattattaagataagtttaaaattagacatcacgttcgccctataggtctataaattattttcacgaaaataagagagaaatacaaagtctacatcattagattataatagatctagactgtaagagttgagatttaatcgaaatatgtgtaaaggcttgactatgtatttatgaaagagcgtggaaatagaatttgacgtgtgctctacgcaataccctttgaaatcaaaatcagattagcaaacttaatttactgacacgagacaatcacgtcctgtacgcataaataaattagaaattgtatatacgcacaattgacacgtcatgtacaaaatcatgtgcatggaaggcaaaccagctggacagccaaactccttcaaccatattcaagttttgcactatcccgtgatctctagagagtagagacattatgttttcttctttaaattttcttagtaacgagcttccctaatagttttctctatatttaggatccatatggcaaagttcttactctgaggatggggcagagctgaaaagcggtaaaaattaccatattaatagtaaaagagtgaaatatttacaggatctagattttaatatgatgcatattgatcgatatagttttatacagataaattatatctatctattatattattaaaacagttttaaaagaagacatcacgttcgctgtagggctagaaatttccacattaatcaaaaaaaagaaaaatagagtccatgtagaaatacaattcagaaatatctaaaattcggaattaaaaataatcaacattgatataataaccaaatacaagattaattaaaatttgaaataaaaaataaaataaaatccaaaattaaaaaaaagaaaataagatttcaagtggaaatacaacttaaaaataacttgggaattaaaataagaaatattaaaagaatagtccatagagaacacaatacgagattaattaaaatttagaataaaaaaataaaataaaatccgaaattagaaaaataaaaataagagttcaactaggaatacaatttataaataacttaaattcgtaataaaaaaataaagactattgaaagaggagacaatgtagaacacatgaagagattaattaaaattccgaataaaaataaaagaaattccgaaaatagaaaaataattataagatttcacgtaggaatatgatttataaaaaaatattggaatgaaaagtatgaaattttcaaacaaaaatttcatctagaacacggatgacaaatgacaataaatattagagaagcaacatatctgtaaatgagtagagttgagatggttgatgggacatccaaaaactattaacaaaaccccaaatacattcccaataatgattaaaaggagagatgacagatatgtcgctaagcaatacagtcacagtggttggcaagacttctaaaaagtaaaaagtaaacctcaataataattatgtttgattaaatctcaatgacattaaagatgggaggtagcgagcgagccgtagatgtgtccagtagcaaaaccgttgatggtttggtgggacttctagaaagtaaaaaatgaacccaaatgataattatgtttgatttttaaaatatcagtgaggaagcagccgagccgtacatgactatagtggcgcgtttgacgagacttctaaaaattataaaaatgaaacccaacgaggcaataaactctaaaaactataaggtccaatttttaaaggttcgggacttctaaaaagtaataaaaataaaccccaacgataatcatgttcgattttaaaatctgaatgacaataaagaggggaggcagcgggtgagctgtagaagagtacaggcagtgggcgagccgtagaagagtacagtggcaaagccgttaacggtttggcgagacttttagaaaataaaaaatgaaccctaacaataattatgttcaatttttaaaatcgcaatgacaataaagagaggaggcagcaggtgggctatagaggagtatagtggcagcatttgacgagacttctaaaaattataaaaataaaacccatcgagacaataaactataaaaactataaggtccattttaaaaggtttgatacttctaaaaattaaaaataaataaaccccaatgttaatcatgttcgattttaaaatctcattgataataaagagaggaggtagcgggtgagccgcagaagagtacaatggcaagccactctgtttggcgggacttctagaaagtaaaaaatgatcccaaataataattatgtttgattattaaaatcccaatgacaaaaaagagatgggacaacggacggatcgtagaggagtatagtggcagcgtttgatgggacttctaaaaattataaaatcgaaacccaatcatacaatttactatataaatcattaaaaccaatttttaaagggttcaagcagaatgaatagaaacaatggtagattgagccaacaaaaaaataatggatgacttttaaaaactataaaatttaaaacacggggatgataaggtttggtccttcaaaatcttaatataacgagatgactatttaataaattttaagtaaaatcatattaaaagtagataaatttatatagatgctagccgcgcaattgcgcgggccacccagctagttgtaataataataaaggtagtatgtggccgtctactaatctctagccatatatattccataaagcaatgcctactacgcaggatcaaattgttgacacctctcaaccaggaaatccgattgaactcacacacagcgaatggcaggtcaataattttcaactacatatggacaggaaacaacgcaataagcaccagaaaaaaattaatacagttcattaaatgataaacattttgttcacattctatcaaaaatagattagacaaatatattcttaccattccaaccctaccatggtccatgtatctgcttgggagctgttgttagtgaagaaaactgtttccttaagattcactatctaggtgggatcctcactaactggggaaaattgattattcctttcttcacatgatcattcccccctccttatgttgcaattgatcacttgaaggcagttgactatttgccacttctggtatgaaatggtcgtctgtcccaattccttcctcacctcccatgcagcatcaaactgcgatggtgactgagaagaaggaatttggttcggtggcacaatttcaccatcttgcccttgatagtcagtgttaggaccaccagctgccatgggccaatccacatgctcattgctaggggccttgtttctgcagtgattgtgaattagcggtgagttgtatttcttcttggagaccttgcactggagggcctagacgctggccatgagctctagatgcgggtgtagaggcataaaatgtttgactgcttaatccagggtggagggtgaggagggaaatcacggtgctgttgtctgcccacgcatgctacgtctaggaacgctatgtcagggatgaagtggaataccaggcggagatgttctagtttgcctcaggtcaaagtcaaacacagataagctgttatatatatgatgaattagacagctcatactggctttgctaagataagcagggattggcaatccaatcataccccttggtggtaaaataccagaatttaacttgcatgcagtatgctattgaagctcatagatctatttgagcaaacggacaggtgcatggtaggaactttctcaaccatggtagattaaaaatggctgaaatactgtcccaactgcaataatttgattcctgaaacagctaaaataattttaacaacagctcaaaacaaaggataaactctatttaccctatgcagacctatgtcctctagagacttttgtactccagagacattatctcgtgtatacttcagttaaattcttccctgttgcaaactaactacattttcatttttctcagcgcaatatggtccaatgcgctttacagattcaattatcagagaagaccacaggttgactggctcgttaaatgtactttcgctgaaggtgaaatcgtcagatgttggttaccctatcaatctatatgggactgtgatagtcagagatggattagattttaactgcaacttcatcttccggcgcaataggaacaattgccaagttatccagtcagaggtgtttcaaagaatatctcttaacacttccaattttccctatttcacatgatacattgaactaatttctttacagttctgtacagttaaggcatactgaagctagctacttttatgctgtctatatgcatccaccgtacccctagtttcatatgaaataccaatacttatttctttttcgtggatttgaatattaagtaacattattgtattatactttcgttagtcatgtcatttaaataataacaatattatattctatggataattctataatttatttttatataaagcattagtatgacatattgctaatgtcttatgtaatttttcttgcagaatgaaaatataattctcacgggcccaactagaggaattgttttccatgatatcttttttgagataaatttgaagattaaggaatatgaagagtgcaatgacaaggaatttagtaaagggttgcttgagatgaagtttcacactcgtaagtctaagattgtgagtgaaacctttgagagtaggctcagtgaggtggaactagtatctgcttgtgttaaggaagccctggagggcactgttgagatcacgattctgtcaggacctaaagtttttcatggaaaaattagtgcttgcacaacagatgtttcgaattatattgtactgtatgatagcaatgtttgtggtgcaacctcagttggggatgacagagttatgcaactgctgcgacgtgttgtagcagtatcagcaaatgagatattgatactgaatattcatgcccataatattcatcagaatgataacgtatccagtcgcactttgaggttcactccacttgctagaggggcagatgaggaggtgatcaattgcgatctttacaagatgcaggtgaaagttgtttggtcagtcttcaagggttagaatagaatatactcccttcatccaaaagtctaagacctattttatttttttgtttttaagtctaagtcatatttatagttactatgtgctatattaaaataattaaatgctagtcgaggtggaaggtggtgaggtcgcacaagctatctactccctccatctcataatataagcgattattttaaggatggaaaaaaactgcaatacccatattaaatgtgattttggttgtggtgagtgggtagttgggggttaaaataggttttgaattggagttgatgaatatgacacaatcttttatactgtagaagtagaagggataatgggtgtgtttggttgcaagtcacattttgccacagtttgccacgcctaaggttaggcaattttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctggaaaccaaacagccccaatatctcttatattactagacaaaggggtaggggtagacgtcttgggatgtgttgttgctgcttcctcctcgtcttgctgctccggctccatatgctttctctgatgccgggtggttctgtcatggtgggcaggatatgggccttcaggtggcaggcccaatcctccttttttttttgtgacacctataactcacgtaatctgcacagaaaacagtaatgcatgttcaagcacaaaataaaaaacaaaagtacatatataacactttccatcatcagatcagagacaagtaaaagaaagaaacttacttgcaccgaattaacagtgcatcaacatcatcctggattacattacattacaccatagtacagtacacatgactggattaacaacacacaatgacacggcagacacaacaaattaacaaacagttcagcaaagctgatactaataacttcagcttaaactgtaaaaactaaaaacaaggcttagggcttaggctagttttgtgccctgagtagtactctagttatgttacagcatcaacaacaacccatcactcactcatattgacagctaacagcttcctctctcttttcttttcatctctctagtgctaaataaaatttgtacagcagagtacgtatactcatcttcttcttcctcctcatctttacaacttcttccttccatattggattagcacttgcacacatcactcactcaatccatcatccatccctgctgcctgcggcgtgctcctcaactacataatatacactctccagtgcaagcgattttaagatgcgtatttttattatttctcaaataggccatactggcctacgtttttagttgcaaaaaacgaaaacgtgagtgcaaaccaaacctagccactgttagctgtacagcattgcttgcccttcaggcggcactggtgcatgctggttgaagccctagtcgcttctctgcatttgcgtcgcaacaacgaatattaaacattgttagtccctatggcagcaagaaacaatggctgaatgacaataagacagtacaatcatacctccagcagcaacaagcttctctacgcgtgctactatgtgcttcccataggtatacttcttcagcgtgttcagatgtgcttttatccttgtaaggatcgcctccctctgctgatcatcacaagtctctagcaccttctgcaccacatagtttgcaaactgatctttcatcattacctgcaacaggtgcagcgcagttaacttccatcaggtctctaaaatcagctttccatcttacaagatttagcaaacttgtagctggacaaatcttaagccaaatttggtttgtataagttttaagaatgcaaacctcaaggtgttcactctcattagtggatccaagcatttcactgatcaaaatctgtcgttctacaggattcccaaaggctaagcacttctcaatgacatttgaggcaaacttttgctggctcatttgaactatttgtccaattaacttctcgataatagcagatctctcatgtggttttccgtgctccagtacatgctgtaaagtagtgtgttcaatgttaaaacaaaaaaagagtgaaaataaaataccttcaaactaacataggatgccaagattctaagaactaagactgaaaagtgaagcagaattcaacattagcacactttttttttagataatggaatgcattctggtctttacttcagagaagctacaaccaattcttacagagtttacagggtgaataaccgtggattacaaaattatggcttaattaaaaactagaaaaactactaggaatatcataattgttgtttcaacaacagcagatagttagcagtaaccatccattcatttacatattactgtgacaggacgggtacgatactggaagatcaggaaaaaaacaacctaaagatgctactgcaaaatcagaaaatggtctacctcacttcactgcaagtcaccattaagaaagcataagactagaaatatctaaatcttaagaaagcatcaaacaactagaacacacatagtaattgcgaagcagtaaaatcattttgaagtaattacgttacactatgtaaatggtaaaacaatctagaagtttggttaggttcaaaaggtatatgatacaaatcatacaatttgcaacaatgtcatggggcagacctgaacaacgtagttgccgtattgatcttgagccagcaagcaaacggactggagaatctcatccatcattatttgctgtgttgtaggatcatcacaatgctccagcaccctctgggagtttcacatgaaggatgacaagtgagtttgcatattaacatctgtaaacctcaacataaactgattacacgcatattatatgcatacctgtataacccgacaaccatatggatgagtggataacatcacaacttgaccatagaatgttgagacaatgaactggatagcatgttgagggatgcattctatgcatttctgtattacatggttcccattttgatcacgtacacagcgcatgacgtgtccatccagctcagcaaccattttagtctgctgatctaaaccaacaacctctatagcatgcatatatatcatccatgacatcagattttgccttccttgatatccttcaatcatttatgcattcatacacttaacatagggtctgtactttgtatagataagagcaagtcatgactacatcaatgcctataaaaatatttcctgaaagtgttccatagtttggaactgttgttattgaatgacagagaatacatctgaggtgtcttacatcagaagtgaggaattgtaccattcactgataaaaatacactcaacctcaatcagtcacgacaattttgttttgctctgctcttccaatggttggttctgaccatttatgtatttgtataagtaagcaaaaggagttgtttatggtccttgggaagtattgagaggtagaacaagttttcagtgcattaaatagtaaatgcaactaggacccattcaaaagggcaataacacagattaatcagataaaaaattccaaaaaagcaagaactcttaataacttccaaggttaaagaaaagatccagtaataaccaccttctgtataacccggcatccatacatctgaagactgagagcaagaacacgtccaataagctggtcggccaattcctttatctgggtagggcttccgtgctcaaagaactagtcaaatgacaaactataagaatatttatcacaaagtaacacttgaagagattatgtttttccccttaacccctttaccttctgaacaacataatttccaaatacatcggtcatcaacgtgagagcttgaggcatgatttctgaaaagaccatgtccttctcttcagtactggccgtttctagcttttgctgtatgaatcggcttccatattgatcagcactataagtttgtcaattattagtagataaaccatgtaacatcaataaggacaaaagcgttgtcacaatcatagttaacaagagacagatcagatggaaacagtcacatgtcttgatgtcttgtactaatgtttttacatactgtagcacatgtcaaagcatatctctaacattttcttccccggaaatagatagaaacatgttgtaagaaataaatggagaacaaactagattaaaccaaatcattgatgaactacttgcagtagnagctctcatcgnncccac

SEQ ID NO: 36 - DNA, 779 bp, Oryza sativa
  unsure (1)..(779): unsure at all n locations
ggctgtttnaagctagantcattgctacagcactccatcacctatgtctcaaattctaaaaatagggtgtgtgtgctccagatctactaaagtatatggtaataaaactaaaatgcaaaaaaaacctggaaacacatttcgaaggaatatattacctgtgatagagtcaacaaaccagcagggcttcgctgctccccttctcctcccccctcacccctccctctttctcttttttcggattttgagcgaatagaatgaaaaatcagagagggggaaggggttttatacttggaggggctaaaatcgccctccctaagggcggcaagggggccgcttgcaaaatgccaggctgcctcgccgcccttttgcaagggcctccgcacagtgttaaaccgccctccctaagggtggcaagggggccgcctgtaaaaaaagccaggccgccctcgccacccttttgcaggcggcctccgcacagtgttaaaccgccctccctaagggcgcaagggggccgcctgcaaaatggcaggcccttttgctgtccgttacttatgaggcaacagccatctgccatgtcattaaaatcgccctcccaaagggcgctgggcgactagttttgtaaatttttgaaacacaaaaatagttttgtaaatattttaataaaaaattaaaaataaaaaaaatttgttcaagtctaactgggcttcgccacatgctggtgaagggactttgcttcgccgctcggtaaatgcttcgccgcctggtatttacctttaccn

SEQ ID NO: 37 - DNA, 18912 bp, Oryza sativa
  unsure (1)..(18912): unsure at all n locations
agtgttaatcgctgactagcggtacagtagttcatcaaacacaatatgatacggagtcaacaatctttaaccataccgttattacctctagtcaacagtatatgattcaaacaagccacaaggagaaacaatatcgcaagacaatgtgagtttttaaactaagaatttgagaaattattgatggtagaaatttcaaaagtatagttaaatctagtcctaaacgtcaaatattttagaagcatacatactgttgcctaatgtgacatgaagttacgcattaacatatgacatgaagttaagcattaacatactgttgcctaatgtgacatgaagttacgcattaacatatgaaggtgatatcgtatatcataaattgctacaatgatatagttatcgcctacaaacttgctatgtaaaaactcatttctttaatactatcaataagaatctcttgatttttcaaaagagaaaatttatctcatctctgacatttggcgaagagtgtctcatcattttgttagttggcttaggaagaggatcctctaacttacttccctctgactttgagtcactgagggaagtaagttagaggatctcaatccgttgggttatcaaccatgcacaaccatgatctaaattttaaaaacttaattcaagtttattttctgttttttttcaccataattttttccatcatttaattttaagtccctaaaaatatagttataaaagtttactcataattaatacttttttattgactcatttattattttcatggtttatcattcgtagagtaaacgaccgaaagtgagaagcatacgacacacaagatttatccatgtaacaaaagagtttatcatttatttgatcgatgattctatgcccttgtttagtcctcaactttttttttcaaacttccaacttttccatcacatcaaaacttttgtttagttcccaacttttttttcaaacttccaacttttccatcacatcaaaacttttctacacatataaacttctaacttttccgttatatcgttccaatttcaatcaaactttcaattttaatgtgaagtaaacacaccctatatatcaatgtgttggattaaagctggacgaaggattgaattgtgaaatatacaaaacaaacaacttagctgcagtcaagagtgtgggggtaaaatcgagagaagccaaatttggaagaggaggaatcatcaaaggagtgtccatctcctttgcaagaagcagtgatgtgatgatggtgaaatggaagaagttggcgtttgggaaaaaaggtcgctttcgaggtcgagcagagaaaaaagggaggcctttgcgaggcgaggagagcgagacccctgtgatcccaattaaccacccgccaccggcacgccgtcggcgaccccctcctcggtgagatcgagatcgagatgccgcccacgccgccgcctgagctggacctcctcgacaccgagccggagttcgccgaggttgaccccaccgcccgctacggaagggtaataatgccttcttcttcttcttcttcttcttcttcttcttcttcttcctcgattcgcttctcctcccatcctttcgactcattcggtgatgcatgccgcctcttgcagtacacggaggtcctcggcaagggcgccttcaagacggtgtatccttcttcccacgctcgatttctgggctttgacgtgcgattccgtatggttcccgggccgttgtgctgcgtctaagattcgattttggtgcagctcatggtgtttgtttcggttctggatgcatttttttcttggggaggataaataatcttcagagctttttgatgcgctgaattcacattccttcgactttttttacctctcctcttttgggatttgaatactagtattttgttttgttgatttcaatgtgtgtttggcattgcctgctatgattacttgaatcaacattgccaatttgtcatgtcaagctcccattacctctttctagactgaatggatctctttcatttctctcttcttatcgggtgcatttgattggttggctagtgttccaatcaatttacatcctcctatgatctatctcacatttgttctaattcaacaactgatttgagaaatgcacagggaagctgctgtgaatctttggttggttgttttgtcatagtgtgttttagtatgtcactcagaactgtccacgtccattaaggcattaactaccgtcaggattccaactgctcttatatgtaaaactaaactatgttgctactttacactatatatgcagaagggtaatcttcatgatgactaccagcttgatagaataatttcatattatcatcatgtatttgtagtgttatcaaggttatgtacttatgtcgttttcatgtgcacagttcatttacttatgaatgtcaaacctgatacgatagcaaaacaaacttcttcctaggtgtttgcagtattagttcttttttttttaaaagatgtttgcagtatgctcaaaacaaagcatgtatctttgtgaacttctcctgttattttctccaatttcgacatggacttgagatccttaattcaaattttactggcatagctataaggcttttgatcaactggaaggtctggaagttgcttggaaccagatcaaagtgggtgatatacttcggaataatgatgacttggagagacttagatcagaagtccggttgctgaagaccctcaagcataagaatataatcaagttctacaattcttggctcgacaagaaaaacaacaacataaatttcatcacagaagtcttcacatcagggacactgcgccagtttgttctcttgctcccatctgattataactatgctctttgaataatatgaacaaactgcactctgtcgctgacacgtcttatttaacattagttagctgtgtatgtcagtattaagtcaaagaaaatgatacattatcaatgaaagtttgtactggttctcaagttcactcttcgggtcctagcatggcttcaataaccaaaacaggcaaattttgtagagccaaccggcatgctagacacatgcaggtctataggatgcccaaattttctcactgagaattttcctatttctctgtcattgtttaggtaccgtattaagcacaagaaggtagatgttagagcattaaagaaatggtcaaggcaaatcttgagtggccttgtctacctccacagtcatgatccaccagtaattcatagagatcttaaatgtgacaacatatttgtgaacggaaaccagggtgaagtaaagattggagaccttggattagcaaccatcctagataatgcacgctcagctcacagtatcattggtatgcattttattttctttttattttactaggaattgaatttatttttcatataacctctgttttcttgtaggcacaccggaatttatggctccagaactctatgatgaagaatacaatgagcttgtagacatctatgcatttgggatgtgtttattggagcttgttacatttgagtacccatattgtgaatgttccaatgcagcgcagatatacaagaaagtatctgatgttagtctacttatcctctccattgcttttaccatttcttttctgaaaattggatttgattaggtaatgatcctgtaggcttatattgaaggtgtattttatatatatttcttttatcaaaaaggtttattcattgcttaccctataccatcctggtgtaggcagaagatgaatttccattttgagaattaaaagcatggtttaaagacagtatctaggattctttttctcaacgaggattgtgttgaaatcatggtttattgccatacaaattgcagaagtagcttcagggtttttcaggtttttattgtgtaccagaagttgacttaactgtaggttttaattgtattactttgggctgtcatagtgggtccattgataaattacaccatcatatgggtggtgtttgaatagtttttctttgtgacagttactaccttggtcacagtctcacagatacaaattaactataactttcagtagctattccttggaacaccattgtactaaatccattggcaacttaaagtttttgatgaaattactttgttttgtatgtgtcgcatatgcccaaggcaattgatttcctatttgatcaatcatcattgtagaaaatcatgttacattctttttttaaaacttgaatcatgttacaccctattactgtctcaatctcttgatgctggtacaacagggtgaaaagcctagttctctggctaagattgaagatcctgaggttagattttttatcgagaagtgcatcgctaaagcttcacaaagactatcagcacaagagctattgatggacccatttctccgagatgatggtgaaaaaatattctatccattgcagtcaaatacgaaggcatcaggtaatgactgaattggcaacactataaaattgttcccttccccatctgaccttagataaacatggcagatggtgctggcagttcaaactcaagcatgggttacaaatatgacagagatgcatcatctatggcaattcgggagcacacaggtagaagttcaatgacgtgacagtgatgtgaacactattgcattgttctgaagcttctctcctttttacatatcaatcttatgatgaaatgcaggtagttttgcagaagaacacccaagtgataggtacatacacagcaccatggatccacaagcagccgctggtcgaataattacagtcgagagtcagatgaaagatctgaatacgatatttttgaaactgagaattgctgattcaacaggttttttttattgtggattcccattttacttctcattatgttgttcggtgtttgtcctctattacacttttttgaaatgcaatatgcaggtcatgctcaaaacatccatttcccatttgacattgaagcagacacttccattagtgttgcaactgagatggtcgtgcagctagatctcactgaccaggatgttacagcgattgcagaaatgatagatgcagaaatacgggctcatattcctgattgggcattagaagaatcggttgaaaaccaaggagatgaaagagctcattctgagaccgacagttcagaagcagatgatgaaacttctgagttgcgtaatgagcctaatgctacacataatggttttgtccaagaacaccttccctccggacataagtattggtcggactcgcccagaagaaacattgaaatgtctcactccgcagtcgaaccacatattggtggtaatatgcctaatgggatattgaagaagaatgacactgatgacacagtcagcaatcttggcacttctgtggacttgccaaacccatctatgattgacaggaaatctggagtagcttctgtcagcaccagtcctcagtcttttgatgatgagcatattgaagcagatgttagcgagaggttagtgaatttgctagctcagcagcaagaggagctcaacgtgctgcgaaggaagcacaaggctgacatagaagtcatcttgaaaggtgtgcctgaagagcatcgcgaagaaaccttaactaggtgccggctgaaggcagatgagagaaacagatcagacaaaccttagctgcaacacattatcttcaccgtgtgatttttttgtaccggtgccatggagctgtttagaactattgttgtgcaaaaggtggtctcagctgttcactgttcttttttttttcatggaatggaggagctgcaagtgtttgtggaatctgtgaccaagcggtgcaatacatatacgatactgatgtagctgtctggatttttgtttttgttttttgtttcttgaaggcaagacaaaaggtttctgctcaccaaacaaaatctgcagataccattgtgttactgtattcctgaattgttcatgagaagtgcacctccttgtttttctccctctctttttttccttgtaatttgatgatttttggaactaagaattaatgttaatgatgtaatacatcagtgtttgagctgtttcatactactacttgcaatgaaaaaacataagttccaattacttccattatgtttgtgccacatgcttgcccaagtccatagagctgtactatgcactgatatctatgattgtttgtacacatacctgcatttcttattgcaagtgtgccatgcatggaggatggatggagctgtggaagtctccactccatctccagcttcatccactgatgagcagcagatctgaagtggccaatggcataaacaacaaacaatatatatgtgcaacacatgctccagtagcatctctcacatgccccagatttgtgtgtccccttgcatcacatttgctgctgctcttttgtgtgcatctatctatatctatcccattttgtgtgcatctgaatctgtgtacctgaaaacctgaggctccccaacccagggaaggtttggggatcctagctgctgcacacagaatttggatctgtgttgatgtacaaaaagtggcatgagccatccctccgatgcaatattttgggatctattgtatatcaatgaatgatgatcagttcctccatacaaggcagggagatgtggaaacttgtggaccatgaaagctgttcatatatattttttgctcatctgtctctctccatgatatttggacatgtagtgtgtacatcacatatactattgatcctgttacatgttggtgtcaaagggctatagctacatcaattcatggtagcctggctttcaaatatgcataattggctaattgcatttatatttaggcatcatctgatcaacgtaatgttatccatttcaggatcatgtgtatggcaattagaattagttcagtccatgatagcatatggatccagtgcatcaaactgagaaacatgtccaagtgcagttgaaagcaaaatgacaacaccccaatccatgcacgtcgctcttaatcagtagtctactgtttcatttttcacacagatagaaacccaaaccaattaaggagtaaaaggcacatcatcaagaacccaataaggcaataaccaaaaccacatctttgtgcagaaagaccaggtttttacccaaatacacatgcaacttgggttctatatataaaaactatactccatgaatgaatgaatccattcatggtactactacagttgctaacaaggaaaatactagctagtatagtacccaagttgcaacttgcaagcaagtccaggccaagccatgaacaaatactctatctattttttaatatacgacgttattgatttttgacgtgacgtttaaccatccattttttttaattatataaatgccatttatttaattgtgacttgttttatcatcaaagtaattataatactaacttatacttttacatattttatactaacatttttaataaaaacaattagtcaaaacttatgaaaaaaatcaacaacatcatacatcaaaagacgcaagtagtacaagctagcatgtcaatttgagtgaatgaagagataagcaatactaataattatatttatatgcataatctctctgtctcggtcattgctagctcaagtcgattgttcttgacaagttgagagctcatctcatcacccaccctatcattgtttcccatcaacctctgcaatataatgcaaccacctctctctctctctctctcttctccgtgcattggagtatatatccccctctcctctccccgccgcccccccccctctctctctcctctctcttcttcgcctccgatcatctaagctcatcgtcgtcaccagctagcgcatgacgtcatcctcgtcgtcgtcgtcgttgctccttttgtagtacgtagccatcgatcgatcacagctagctagccatgcaggaccacgtcgtcgtgcagcagaggagcggcgaccagccggcgccgtcgtgcgacatcgccgccgacgagatcccggtcaacggccacaagccggggagggccgtcacggcgtcggtctaccgcgccaagatcgccggccactcgcgcgtcctcaccgtgtcgtggtcgcgggacatgctgtcgcactccttcgccgtgtccgtcaccggcgtcgacggcgcctccgcggagtgcagggtggacctccgcccctggcagttctggcggcgcgcgggttcacgccgcgtcgagctcgccggcacggcgccggccacggtgcgcgtcatgtgggacctccgccgcgcgcggttcggcgcggggctccccgagccgaggtcgggctactacgtcgccgtggaggccgcgggcgaggtggtgctggtggtcggcgacatgcggaagtacgcgctccggcgcgcgtcgccgcgcgcggcgcccgcggcgtgcgacgccgtccccgtggcgcggcgggagcacgtgttcgggaagcggcggttcgcggccaaggcgcggttccacgaccagggcaccgtgcaagacatcgcgatcgagttcgacggcgtcggcgagggcgacaacgcgaacatgaagatgacgatcgcgatcgacggctagaagccggtgcaggtaaagcacctgcaatgcaagttcaaaggcaaccagtccgtcaccttcagccgagcaaaggtggagatctactgggacgtccatgactggctcttcagcgccggcatgcgccccgccctattcatcttccgccccatcgtcctctccagcgcctgggcgcccgccgccgccatgctcctagacggctcgccgccgccgccgccggccaccggcttctgtctctacctctacgcctggaagctcgactgatccattattgagctagctagcttctttcattggcggctggctctgataccatgttgattagatcggggattcttgatcgaaacgaaaatgcgaagttgtgagccaaaggggaggaggagtaagaatttttttcgattttgtataatttttttgaggaaggaaggaaacatatataattggatataattaattaattcttctaattaagagcccttgcatatacatacattattgctccattctcttgatcagctcaatgacaataacaagagacatgataaaatagtaatgccattgccaagaggagagcaacctagtgatctcctgttgattcatttgagatctcttgtagtagatcacagtactgggctactgtctagtcaaaactctgtttcacctctctctgatcagttagttcctgccagacaagaagttgatgttttagttatgagataaccacaccacatattcagtgatcagtaatgtacatgctagctgtgcgtataacactttataactaagctgtcttacagttaattgcatatgcaagagagagagagaaatcaaggtttgcattgcaaatgtgcaatgtgtttgttgggtgggcagcacatgggatgatgagggagagtgggttccagtgatgagcagcagcagctgtggactgactcatcagactgatgactactgatccaagaaaaaatatatatattggccaccgcaaaaggtgacagattggatccaccatcctaatcttcttcttcttggcccctcccaattgattaattcttccctataatctgccaaatattcacattattaatccagggtatcctaagtgatcgattgatgcctctcacctcttagttcctgatgatgatcaccttctgaatgtggagatctctatgcatattatccttaattaaacacagtttatgcataatttgtttacgaatggtaaaggagtttcatagaaaaaaaaagagatttttattggattctaatattaaaaatcctcgttgcgtacctgacatgtgggctctaccgaaaatacctactgtactgtagtttagttgcgcaaaatgaaaagtttgaatatataataattccacatgagattgtacctagacagtttgtcatgagaaattgatttgcaaggttgtatcctatttattatcttacatatgagacgcgtgtgtgttggtgagatgccaaaatgctgtaaagattccatcaagggaaaacaatggaggaaaatggggataaacaaactacatccaatttgttcccttgctagcagcttgcatctgttggaagatatagctggtgccaatcaacactttgattgatagaattaacaagattatattctgattgctgccatttgtctccaaggcatttgttcaatccccattagttaatatacaacaaaaggatatcattagtccactggtttaatgtagacaagaggaaatgttaatctttatccttccatttctgtttccagagcagtgactgtttgactgacctagagggtgagttcaatttgtatttttaatttgcagatcaacatccaactaaatctatgtcttgttcaggaatgtgacttgataggagggtacaaattgtatctaaactcctaaatgtacatttataaaatgaaaatattcacaatagctacatgtaacaaatcaaatggaaacagcacctaatctgaaccatcccctttgttttgaacctgcaaaacagttttctgacactccactggactcctgcatttgtttgatcccttttcctctgcacaagctagtttggtcaaaccagagctggttgcctgtttagtaaggttcggcctctgtaatcacaattgacttgtacaaaaaaagctactaagataattaaataattacttactgttactattgtctttctcaagaaagtattctatggagaaactactgacttgtagcagaatgggatcgagcaaaatcaacacacattgcagccgaatgtattagaagaaaaaaaagagaagaagctaattaagaatcaaagacaaatgtagtagtagctaagaaagctatgcttgtgatccaagatattattgtagctagctgcaagatcttaaatttggtgtatgtttgtggactaagtaagcagctagtactactaaaatggtgggtagctaagctagctatagcttggaattgtgtgaaactgatttatgggctagcatgcagctggagtactaatttagtttagagtccatgcgtctgtgttttgttgtgtgcccgggatcagcggacaggggtcttgcatttgaggtggcctgaagaactgaaatgtttttaatccaacaacccatttgcacatgcatttgctagctggtttgcaattgctacatgttcatcatatcaattgaatttgataacaagctcacaggtatgactgaatgcattgtagtgatgtagcagccatgtatgacaacaagctcacaggtatgactgaatgattcaacatgaaattaattattgaatttaaagaaaccttttctttcgttacaatacattctctgaatgactatgcatacatatggccatgcatgtatatcgatagatcttgcgtaggcacattagcaatttgacatgtgtggtttcaactatctccagctccaaatgctcaagtttacgcaaccaacgataactgaataaatacagcttgtgtagcttgtagcttatgcaatctagcatgcttgttgccattcaaatggaattaggtcgtcgatgaaatgcagccagacttcagttttaatctttccccttgttctagtactttaaatattaattcatatgtggctgatacagtgatatggaggaggtattaatttgatgataaaaaaaagaaaagaaaagaaagatgtggaagtgaagaactgaagtaactgaagaagggagaactgaggtagctctacatgtgcttttttcttgggatgcctttgtataaacaaagcaaaatgaaatgatccagttattggttatggggtggaccatgagtgacacgtcgccctgcctccccttttgcaagctttcagcagaaagtgtccattttttgttggccatcacccatctttctttaattcttttttacttgccattgtcaatccacagcaggcaggtaggcaccaccatatgcattttttttgttatttttttcttctcaaaaaaataaatgaatttgagattgggtagcattgagttatgtcgttcgagaaagatactactggtcatttcgtgtgccaaatttttttttaaaatacacggacacacatttaaagtattaaacgtagactaataacaaaacaaattacatattctgtctgtaaactgcgagacgaatttattaagctaattaatccgtcattagcaaatgtttactgtagcatcacattgtcaaatcatggcgtaattaggctcaaaagatccgtctcgcatttacatgcaaactgtgcaaatggggaatcgctagatccggatccagcaagaaggagtctggatctagcgtctccactcttcatcaggtcgactcctgcctccgtgagtccctacaatactgtgcatggcgagagggagaggaaaaaaaaggtggctcatggagtgtaactagagggtgcggttgcgcgtgcaaagacggagaggaggaacgatggtggctcgtgaagaaagagcggtggtgacggtgcgtggagtaacagttggtggttgttggcagtatgaggagtttgttgtcgacacaaatcgctaaccaaatttgttactccctccattccaaattgatctatatatttcataggtacaccaagaccaataaatactaataactctctcatactatatttactctagcaacaaactcaatgcatgcataatccccactatttcctagccaatagtaaatcaagatattacatgtaggttataaatacttgtctgcatagatgcatgcatcaatgtccatttactccaatacataaataacgaatagacttaataaatgaacacaaatatatagatcatttaggaataacctcaaaaaaactataggtagatcaatttgaaatggagggagtaatatttagaatgtgggccactagtcattataaagcaacagctagtcttaaagtagtaaaatattgagataaaggtgagagtacttgtatagggcttttaactttttgctatttttaaaatatggtaattaaaaatttactactcacagtccatgatacgtgagtcctcatgtgtatatgacatgtgggacctaatagcaaattcttaattcccaaccataatgtcttccccttccctttgtgtggcgtaaaagaaagaagaaaatctcccgtctctttgtctcctccgctccttgcgccgccgccaagacacaggggaggggcggcgatctccatttggcgaggagagcagagcaggggaggggaggggaggggatcctggtgagcctctttctttctttctgattcatctctctctcccccatcgggactggaatttgcttgcgttcgttcgttcgttaaccctagcttctcttcccttaatttcagagccttaaccttaatacaagtaatagtttgtttgttccccgaaaagtcccaagttggatccgcccctgattactccagtgatctggcacacattctatttgcccaaaagatttataacttccctagctaccaataagaaaccctgttcagtttgtgttacaaggagcaaacttgtgagtgtttgtttggctcattgttcttgccaaactcccttttcccgctttttagtaaccccatcacattattacgatttttacaatacaactgtgctagttgggtacattgccagttttgttgctactccactgatatggtttttctgtgtgccaaccaggtcatattttactgcccagagcacagaaaataaaagatggttaatgcaatcaagggattgttcatctcctggtaattaagctcctaacacaggttaattcgatcgatttttgtttcctttgcataagcagcttgcaatcccttctgcagtgatgtgccaatggcacagttcatcgaatgcttcaatgcccgcatcagacaagttcatcttgcacatgcttgatccaacgcacatgttcgtccagcctcacgtggcggatatgatcagaagtaagatatcagagttcagggaccagaacagctacgagaaaccatcatgaactatcaaggatcatcctgtcctcagactcccatataaacataccaccgtttgttgttaagcctgtaatgtggagtagtgataagttctgagcatcacatctcactcatgataatcaagaatgattgacattcggtatcagaatgccacttttagagtgatagataatgcaactgtgagattgtaatggaataactgtattttaatatcagaaacaagtcgagttgtgatggtggaattcggccgaataaatcttcctgactgactgtctgtctgtccatccagttcttgtggaattttcagctgatattaaatcttgatgtccttttctcttctctctcgacattatattatatcatctgaactccgaaggatgggattttgagcataattggagaagagagtctgatggcaatgctggtctgttggcagctgagaaatgcccaggggtcttccggctagctccacaaggtggtgggctagacgacctgggttcaaagcctcacccctcctaattatttgatattaggtccttccctaatattctagtttttttggtctgttggcagctgaatgcctgaatttcttcaattcgccggagcagattgggggggaaggcgacggttattgggccgggatcaaaggcggcccatattacgtggagctgaacggggattgcggcccatattaattagttgggccaaaagggggatatagattcctcgcggcccaacaatgggatggggggtcacgtgcggcccatattagttgcattaagttctgcgtacaattaacatactatttccccagtttcaaaaaaaaaaaaactatttcccctcttctcctgcctactatttccattgtctgtcggaatatttttattagtgacgaatggtaaaagataggagtatatggcatttcacgctcagttagcattcacattgttgatgtacagttgtacactagtaatttcaagtgaaaattcagaagaaagaaaaggactctctgttttttactagtaaattgtatatcaaccttaacagtgagcatacaggtcgtgaacaagctcaaaacaagaacatatttgcattgctccaattcttcagccagcgagtttatattgacttttgcatcttgtgcagaagaaaaatagtatgtcagagaatgatgtatgcacgcagatgacatggtatgatgaacttgatgcccctgttttactccaagtagaaaccatggtccaacagacaacatcctctttacgaaagagatggcattaacttaacaatggcacagagatagaaatcggtcctcactgtctactatcttcagcagatgcaggaaccactatcttgaaaagcacttactgatgcagatcgttcatccatcaggttgcagttggttccatgtacaatctttctttagttgagacttcgcatgcttgcatccattctcgattgctttctttcagccatgttgatgcgcactcagatagatctatctatctatcttctctcaagttgcagctatgtaaccaagaaaagaaaagaaaagaaagccatcttttctgcagctcgatctgcacccagcattcatgcttgaaagcaaagtctcggcctgacattcagagcaaagcttaaagccttggcatgattcggcaaacactcaaactgttctcactttcggagcctttgcttccaagcaaattaaattgcccggatcaatggctacaaataccccatgcattgcatgcatcctctcttcaattcagaaacagtttctttcgtcttcagttaaaaaaagaagaaggagaagaggaaaaattcagacagagatcgacatggagacgaaggtgaccgtgggcgtcgtcctcctgctgctgtgcctgtgcggcggcgccgcgtgcgccgccggccgcagcggcggcgagttctccattgtcgggtactcggaggaggacctggcgtcgcacgaccggctgatcgagctgttcgagaagtgggtggcaaagtaccggaaggcgtacgcgagcttcgaggagaaggtgaggaggttcgaggtgttcaaggacaacctcaaccacatcgacgacatcaacaagaaggtcaccagctactggctggggctcaacgagttcgccgacctcacccacgacgagttcaaggcgacctacctcggcctcacgccgccgcagacgaggtcgaacagcaagcactactcgtcggaggagttcaggtacgggaagatgagcaacggcgaggtgccgaaggagatggactggaggaagaagaacgcggtgacggaggtgaagaaccaggggcagtgcggcagctgctgggcgttctcgacggtggcggcggtggaggggatcaacgcgatcgtgacggggaacctgacgtcgctgtcggagcaggagctgatcgactgcagcacggacgggaacaacgggtgcaatggcggcctcatggactacgccttctcctacatcgcctccaccggcgggctgcgcacggaggaggcgtacccgtacgccatggaggagggcgactgcgacgaggggaagggcgcggcggtggtgaccatctccgggtacgaggacgtgccggccaacgacgagcaggcgctggtgaaggcgttggcgcatcagcctgtcagcgtcgccattgaagcatccggtcgccacttccagttctacagcggggtcagtattagtcctggcttagttctccaacacttttttccaaaaacatctcatcgaatctttatacacatacatagaacattaaatatagattaaaaaactaattgcacagttaagggaaaatcgtgagatgaatcttttgagcctaattaatccgtcataggctcaaaagattcgtctcgcggttttcaggcgagttatgaaattagttttttcatttgtatccaaaaaccctttccgacatccggtcaaatatccgatgcgacaccaaaaattttctttttgcaaactaaacatgcccttagtatatattattcctatcttactctctctctctctctgtaataaatatatttaaaacgtttaacataagtaaatattctgtcaaaaatttaaaattctaactatcaattttatattaaagtaaattcccatttaacaatgcctaaaatatgttatgaacatagaaaagaaaacataccaagccgcacgaggaacatgacgaacaaacaatcacatgagctgtctaaatccgcttcgttcgctatgggcatcttgaattttgcatttacaaaatacaataagtttataatattatggtagtacatttgaacacaaatgtgcgtttaccgtttgttttgtctatcacactaagcatttggaaaactgttaatgaccagaattttaaactcagactaaattttgttataaacgtcaaataattatgtttaggcggacttcttttttactatttatcatataaaaaaatatttatagcatctttagaaccacatatttgtataccattgtatgagccaaatggatgatgagcaagtgatatttattagtagaattatatgatgatcatggatggtgatatataaatgcagggtgtgtttgatggtccatgcggtgagcaactggatcacggtgtgacggccgttggatatggtacaagcaagggccaagattacatcatcgtgaagaactcatggggcccacattggggcgagaaggggtacatccgcatgaagaggggcactggcaagggtgaaggtctatgtggcatcaacaagatggcctcttaccccaccaaggacaactaaactcctactactaaataactcaattgaatcaacacatgaggatcatacatatgatggtccttcaaagtttctctcttctcctcttgttttattagcctttaattccactgttttttcttctttccaaagatttggaggagagagagagagagagagagagagagagagagagagaagcccaagctgtttgtttgtattcgattttcttttgcgcgctttgaaatcatcgatgaaataataaatgtcagaagcttctttttaagatactgtctgttccaaagtcattcataagggtgcttgtttggtcaagttttgtgtgcatttgatttttgctcctgatggtttggttttctttgcaataacgactgaaatgtgtaggacttagtccaatttagttaaagttcctaatttccaaaacttaaaacacatgtaaacaatttcgatcccgcgcgataaaaattccttgaatcaacttttttacaaaaatcgtataaatttttactttttttaaaccacaaaaccccttttttatattgttcaacacaatatactttactccattcttaaaaaaaaaattcaacatgtgttcaaaacaatgttaaaatgaaatttattttcacgtagaactacaacaacacattgtttaaaatattgtggaagcaatataccccttttggtccacattctttaaaacaaaaggctcatttttgnggccacggcccttaatctctataacacctttaaaacattcccacctacattccatacaggcctctctctacttctttattttagaccatggagatatttctatctgtaatttaggccaagatgtaactaacctcctcctcagtcacacctgtggaaatgaggaactttatggccacatactctctttatcacattacactggagagcatagaaaatctcttcctgtcgacaccgggtttaaacgttttttt

SEQ ID NO: 38 - DNA, 85192 bp, Oryza sativa
  unsure (1)..(85192): unsure at all n locations
cggtcttgtagacngcttctactgcatagntcatannnnnnnnnnnnnnnnnnnnnnnnnnnnnnnnnnnnnnnnnnnnnnnnnnnnnnnnnnnnnnnnnnnnnnnnnnnnnnnttggtttgggaccggccggactgcatcccttggttggctaggctggttgggccgttgcatacgttgcctggcattgttcttgcattttttttgaacttcctgattttgcttgaatatgttgatgcacttattaccggcttaccgccaaaaacttgttgacacaccaaaactcgtggatacattaaggttagtgccaaaataaatacagcatttatcaatacctcatttattcataagtatttaaggagtacaaaatatcacttttagcattttacgggcgtcaacaatgctccatgtggaactaatctcaccaaaccacaccatgggttacatcactagcaagtagcaactactgggctagaatattacattcaaagtatttgtagttgtgtggggatccttatgtctttctcgagcaattactttgtttctttggccttctccatttttttaatgtgtatgtaactacaatagtctccttaatacacaaaacagagcatgatcgggagaaaaatattggaaagccaactgcaaaaaatcagtgttcttggtgacaacaatacaatcagcgattatccggcatttgatgcagattacaaagtttgtaagtgttgcatatgatattcactaaacatgtttgttagtatgtcccccacatttgtctcacaatgttgctggtcctaaacaattgctgacttctttttcagtgtgggccaaccatggcgatgcaataagcactcagtactctggaactcctgccttgaagggagactttgtgcggtaatttgtgttttcaagtttttgtgaattctcttatttagccccttttcctttgcacaatttggacctactaatttcagaaaaagaagtaatgatttgattgcaaccataagcacgtttaagctgagttgctaatgtttccttatgaagcaaaggttttgtaacttgtaagatcctttaacacctagcctgctaaacattttctctagtttcatgttgtgaatctcctcaatagttaaacctttataatggcaacttttaaactgatttatttcttgctcgctgtgaaaagttatcttctcgtcaccatcagaaaaattacttgttggattatgtttagttgcttacttcccagtatcaggactgagctgacacctaagatgttgacacagttctaatgcatgagagtgcagtattataattaaattactgacaaactacatgatcacataaggtgcaaaataatactatcgttctgccaatggcattgccacatgttttcactttttcctctattaatccgctgtctatgatctatttcttcttttggttgttggatctttagaaacaaataatgattaattagttatttgttgttcttaacctaactatatcttatttatttattaggtacggaaagcgaactacacagggaattttaaatgatctgtggaatgcaatggctagatattacctgaacaactttgcagatggtactaaacaggtatgttgcttacttggtctcaccattgatgggctggagtgagttggattttgctattttaggtttgctattttatccaagacatcatggacgagtgaagaaaagatcccttacgttggtaatgatggatcaaggcatagtgataactcattatttgtttattgtcttgtataggatgccatggatcttcttcaaggacatcacatatcctcagttagtcgggatatgccaactccaaccaaaggacttatagagaatcacgcggttggttattttctttctattacttgagatttttttttacagatgaataatccttaagttgcataccgtgaattgcatttattgttcttactcttggttctgaattctcatgcttaaaaggattgcaatttacaatgaatttctatgcataattttgatgtttccatctacttactaggataagttgacagcggtgatgctatgatccataccaaggttttgaataccagtctttctggaaaaccactatatccattttttttaattcacaaaccatttaccagccgtaaccgaccatgaaccagtttttgatggaaaattttgtattaaaacttatggcatggataatgcgtgcttttttttaatgacttagtatttatcacacttaatgctgcaaaaaatatacagctcataatgttctgaccggaaataccagtaactggtttggagctcctggccggtaaccagcagtgtaattacctgcgaagatttccacccctgatgtattccctcaatttagttctttcgtgttgatagagttacatgggcatttgaatgtcgttatgcatatcttagtggagatatttgttgaatagtcccacattggttgtggaaggacctaagatataagtgggggagcccctcacctcaatggctagcttttggggtgggaaaggccctttacggtcttacaattggtatcagagcctggctaggttaacatctctggcccgatggacacagtatgtgaaggtttgatggaccgtgggtgcctgcggggcccgtatacctaatggaccgtgggcctgttctgtggggtctatacacggtgaaaggctgagggacttaagatataagtgggggagcccctcacctcaatggctagcttttggggtgggaaaggccctttacgatcctacaatatttttccatatttaaattaggatattttagtggagaacttacttgagttttcatttgcagtccttccgccttgcttttgctctgcttttggctgccgtgatattcttgataatgtcactgagaagaggtactatttcatcctaccgaaatggcaatgatttaagttaatttatgcagattagaggcactcaactgttgtaaacttgacgagttgtttgcagccaacatattactatgtggaaacaaatacataaccaagtcactaggccaaattcactccaacaagtttaatttgatccttcttcatgctttgtcatactaacttgattcatttccttgcagcacgtaatgatgttttccatttggtgctgtcactactatggtctggtttttgctttggcatcacgcgttatgtcaaagctaacggacggaagttcacgaaccgtcctcgctttcacctatcgcgccattgatgcgaacaaaagggattatatacacactcatggtcgactcacctttctgggcatgcatgtgtgctctcagttttgtatcaagtttaactttccctctttgtaagattttgcacatgttctgaccatcacggctttatattttcttgttgaatgggaacatcaggaattgatttgttctattgcatttatttatttatttatttatttatataaacgttttgcagaaaatgttgcaaagatgtatatgatgatcaaaattgcaaatggtttagggtttcatatattttgggcatcacggcttctattcaatccacacgtagaaacaagactgcagttgtctagcattgtgtatgttaagggtatatatgagatagtttgtatgaaaagtattaaagtaactttctatcactagtgtatataattgatatgccatttaggattaaactccaggaaaagttaaattcccaatttctcctccctgtatattgatattgtaccggagcaagagcaagggagtaaaatcctaaaaatcctagctagccgccgccggctcaacgtctagcaaccctcagttcagatccagctccaattgtccaccatggctcgttgtcacccacgtccgtccgctgctgcttgccatcccccactgcatgaaatttagtgtatgacgcaagacacaaaaggctcaaaagctaagttactttgaaataaaagataatcataagtttgttcatatccattccttggccataaggcatctcaatttatagtacattcagtatctacccttggttccacacgagagctagcttaaaagcagaggaaaacagagaagcgacaaaatgaaatgtaaacagtggttcctgacaacgagcaagctcccagatgcaaaactaatatgcctcgtctattaccagtcgtccgatcttcataatccgctcctgaattgtttccttatcctcttctcttcaattggcttaagcatcctcagagattcataaattcagaacatattcagtccatttctcatctccagattccgacattaccttcccctcgagacaatccttgtcctcaaggattgaaaggtagaaacatacttcggatcacagtggtatcttcccagggtggttcagccggtgataaatttaccaaagattcaaccattgagtcacagcttctccccttctagcaccatcctcctttgcaatacaacaactggttcagttttgatccagccgtctggtctaacagatagcagattggccattggaactgcatgagctcccaagtgttttttcagttggctgacatgaaaaataggatgtatattggagccctttgaagttggagtctctaagcagcctgtccaatcttcctagtaattgtgaaagggccataaaattttaatctcagcttaagagagcccctgataccaaatgatgtacgcctgtagggctgcaattttaggtaggcaaaatttggtataaaacatttaaaaaaattgcaattagctatgggacatcacaaagacatcaatttgccaaggacactctaaaagtgtggtaattttctgtagtatagtggacgcattaaaatatagtatccaccaatttgatgagagagaaaccatataaaatgacaaatttccctttatcttctcccttctctcggtcttcttctgactctcactcgcagtgagctccaccggcttgcccatggtagatagttgctcagcatggtcatgcaacatgtcgaggccaccgctaccggacgccgaacaccataggcgaccgcggaggcggcgcagctgccggagccacttgcactcgcaccaccgtggtggccgtgccccggccagacgaccacgtgagggatgccagtgccgtcgtgttctccatcaggtaccgcctcgccctcaagcaccgcctcccaccgcagttgacgatgcgacgggtttcctccactggattagggaacacaccttggacaatgctgatggctggctcaccgaggctgctgacttcggccgcgtgttcgtcaccggtgactcggacggcagcaccatagcgcaccacctcaccatgcacgccggcttggcgatgcccaatctcactggcgcctgtggcatgatgtgcaaccgcgccatcgactgcaccgagcggttgttcacaatggacaagccaatggagctcactgcgagtgagcgtcggaagaagactatgagaagggagaagaagataagggcaaaactgccattttatgtgatttatctctcatcagttgggtggatattatatattacaccaaatttgctccaagacactcaaatgcgtaattagctgtgggacaccacaaagaaattttcttgaggacactctaaaaatatcgtaatttgatgcaagacactagactcattaaaatatattaaacccacccaattgaatgggtgtacctatataatgctttgaatagggtcatctcgatagttgtatgatatgtggtatattaccactcagccaacgccgaccataaataccaatgttggggctcttggaaggtcatatttctcatataggactcaaagacattgattcactctttctgtctaacaatttgtttcatggaggtgacctgtattgaatctcgaaaaaaattttggaaatacactctttttttaataatttgtgtttatatatctacattggagagtttagcagaaatatatctaatccgcggttcggaaacacgggaccgcaaagcaagtgcggcgtggacatgcaggaacggcggctgcttcggtgccgcgcagcggaaacgcggaataggcccgatcctgcagagcagaagagcgggaccgtatcgttcccgcggccctatcctgtggcaacgtggcggagagtgggaccgatttgctcccacggaaccgtggtgcgctaccgacgcggttctgcatcccggatatgcggcaccgatctggtcccgtcgtgaggcaccgctccctttcccgcataaccatcatgcgggaccgtgaatcaatctctacgcaattggccggcaggtcgtcggtcccgcggcatagtagtgcgggaacgcaccagcacgagcggcattgcgttctggattagaggtcacaaccgtaaaaaaaagcaacttactttgttgatgtgattaggcttttttttttactcttctgcttccggattaatctccaacaactaataagaaaatattatactggctaatgaacctccgttggtaacttaatttgttgatgtgattaaccctgtttgattcagcttaaaattattataatctggattattatgagtaagccgaaacaaaccagtagattattataatctataagccagattagtataatctaataatctcctatggaggagctttttctagattattgagtggctaaagacccactacccttagatgtctctagtaatctagagaaacaaacaactcgcaacttattctatatcagcttattataatccagcttagagtaatctgatttaataatctggattacaataatcttaagttgaaacaaacagagcctaagcttagtttaatattttgtttccggatttatctccaacaagcaatgaaaaaaaatttgtgagctaattaacgatgccggccaaagcggcgctgctcttccgaggtgcggagcagcgggaccggaaagatggcgcgcattcgggacgctgaaccgcgtcggtggcgcaccacggttccgcgggagcgaggctatcccgcacgacgccgctctctaccacgctgccgcaggacagggccgccggagcaatgtggttccgctcttctgctccacgggaccgaggctattccgcgttttcactccgcggcaccgaagcatccgccgttcccgcatgtccatgtcgcgcttgctttgtggtcccgcgtttccaatctgcaaattaggtatatttgtgctaaaccctcccatacaggtatataaacacaaatttttaaaaagaagaatatttttccaaatttttttcgttgaatctcagctgcatattcattgatttgaaatacttcctgaaatatacagctagtgaatatcttgtcaccatcaattatgatacccattggcatcccatgtagtttgtggatgttatatatccatataaagatatccaccacctgctccactgaataatgatgaaacaaggccaaaaagtgagcatacttagtcaatctgttaaccaccaccgatatcacatcctttcctctggattttggtagcctataatgaaattcatggtaatgtgtgaccaagccatgtcaactatatcaaaaggattgaggagtcctggaatatgaacttgtgttcttctttagtcgcttggcatacgatattccctaaccattttgtcagcatccctcttgagaccaggctagtaaaaaaacattttgattctatggcaagtggccctcattccataatggccccaaaggaggagtggtatgcccttagtagttggtttaagatgttttacctgcatatatccttcctttatacttcagcagtccaccttccattttatagttcctatcagtatcgagctcacaccaccattcctacagctcgagtgcgtgctcgtccaaagaggatgtgccgagtgaaggacatgcagaatcttatggccaagtgtcaatgcatgaggatcaaggcttgacgttttgtcccgactccgagctgtacttgtaaaaagatcagttgatgcaggcctacaaccttctcagggatcaagtgttcgctcatacgcgagcatacgacccggagctgcttgctaaaataggtatgaatgttgattctgctactgtgtggaaagcaatatgttgggatgatttcgcgctagtagatgactctggttcacgttttcttaccgtacgatttctctgtatgttgcgatacgtgtgggaaggtattacgttccgattcttcgggacggaatactatctcacacgaaaggatcttagtactcatatgggattcaacataagatgttttgttgatttggagtcagtgactccagatttcaatagaaacaacttctggcaacatattacatgagactttctatgtagaagcgtggatattggatttgttaattagctcggttcgtaagacatcaaagaagaaaaggttctcttcatgtctagtgagtttgatttttctatttggtaacaatgcgtgttatctggccatggattagaacaagtcaaatttaaaacagtagatgtagttgaacatgatttttgaggagtctatgatgtaacaggtagaaagaaattcaatttcacttagcaagacgattgtggtgatataagagagggtggaacactgttgcaggtgcaatcaagaggaagaagttacagggatagcgggagtctcttgttgtggtgatcctggtgaaggcttgtcgggccaactcagcatgagcggtggaagaaccaactcaagttctggcacacggaggttcgagcaaataacaaattcatgttggcgtggcatattcgctaaggaggagtttgttagagttcgcatagtgagagggagcggctgccaacggcgttcgatcgatagttgttataactctaatacgctgtaaatgctggatgggaagaagcactccagggatgtaggcttcggttaaatctcgttaacaaatatcgtacttcaatgcgatcatcgtgtttgaattacctatgacgtttctttcgtgtttggttttcgatagtgatttcggaccagttttataacaaatggaattaatattattgcatcattgaatcctaaagtaaattagaatttaggccatattttattacccaaatttagttttggagcatattcactttggtctgcactagcacgagtcatgtggcaaatgaattacatcttctcattactacactaacatgggatacccttctctatcaactcatcaattttgctatcacatcactcgtcctactacttaattatatgagaatgccctaatacaacgattggaagtttggaaatcaagaactgctcatagggatgctttcacagcaatgggaagctagaatcgagaaaaaaaaaactctttacaggacgtaacgtgaccatatctgtgtttagcatacagcatttgacatgttaattaacttgttgatgtgtcagaaatgctgttgaagtagcagcaaatgcaggattactcccaggaagagatcagtcagtttggtcattctcttctgcacaccaagatcaaattagcttgcacgtgcggcgccgtcttttcccagatatggacaataacctccaaggtgttttatgttcagttagcctaacaggtctgcgaggaaacttctgatctctggtccccatcagatattgcctggacttgtgcagcgtactgcagattccagagaacctcttcgatcgaaggcctggctgaagattcaactgataaacatttgacagtaatggaaatcaccatcgacaaagaatcttgcgaagaggtgctcagcacaaccggatcaagaacttgctcgcgctcttcctgttttgatattgacagaacctgcagatacaggtaaaattttgattgttctggtatgatcagagcatatgagtcatgtagggttttagagagctaaggatcctatcagttgaagttttatcatgccaaattaatccggatattaaaatttgtagttcttactctgcaagcaacattgctcctaatatttgtgcatgtaatgctctttgttgggctaatgcagggaagcagaagtgcttgaaacatacatttcatactcagaacttattagtgtgtggtgtcataattcagcttatgatatcatggattgcagagcacaatgaggacgaaagttatacggtcatacccaaccaacaaaatatctgtattgagttgatagatagcttaatacaacatgaaattagcccagtccagacagcgctcgagctatgtatcaccgtgatattgatcgaagtatcattattataactatcatctggatatttgattaattatctttacgcaaaagacaaaatggaacataccagctcacttagcacagagagatctttcctatgacgttttggccccataagtacttcaagtaaaatacctccaaaagaaagcacatcatcctccaaattttccctaaaaacataaattatattagactttcagcatgtctgatcatttattagttgtatgcaactttgtgtaagaaatactttgctacaagttctgcaggtacttacaattctccaccattgtcttctacacatctctgcccttctcctgctgcctgtaaagtgtaaaccaataggaataagggcattaaaataaagaatggtctataattgagactcctttaaatacaggggaagaggagtaggatcattctatgatatggcaaaccaacctcatgtttgtatatctcctccgtaattatggatagcccatagtcactcagttttgccacaaggtgttcatcaagtaaaatactagaaggctttaaccggttatataaggaaccaggaattattccagtatgtaagaaatgcacagccttagcaatgttcatcagcacttggagcctctcacaccagttcagagtcttctctggactagagcctaccacagcaaaggcattcacgaaccacaagttacaaattcgattgctatcacttcgtacgactttaattcctcattttatttttagttccttaccagaaagatatgaaggaaacgttccactaggtacatattcatagacaaggaaaacccttttcacacttgattcatcaacttcgccatcaatacagtgccccaagaggcaaaccaaatttgggtgacgaagcttcgccagtagatctaatcgaagttttagattccttattgagtatcgttggtgcaatgccaaacatcttatggcaatcagggttccattctctagttttcccttgtacagctgaaaacaaaggaaaggagtaaggaaaatgccacattaaaatagtatgaggaaaaattgtcagaaactatctagcttgcagagctaataaaatggagtaattataatactgttaacaggttaaaagcagtacaattattatctcatgtatacggtaaattcctaactaaatcggagtatcagacagatgttgaagatggcaacagacctttccaattgacccctcgcctaaaaatgccgacctctcaaagctttttgttgcttccttgagctcttccaaagaaaatgctcgatacatgggcattatttgtgtccctaattttacagcttgagatatgtaccctgcaatgaagtgagggagaggagaatttcaataggaggaaatacaattatctcttgtttattattcagggaaataaattttggagttcattccaataccatcatctaccattaggatagtctacatgtatgatgtatctatctgtgactatgacaaacaatcggctggatggatctcaaaacatgggatgcagtgatgcacacatgatccacatctagcacatcattccatatatcataagaaactaggcatttactagcaaaatttcttcagaagaagacttacttgcatttactagcagttcagttgacattcctgatgtcgaattatcttgcatttgcttttgaagtaactgttgttctgctaaaactctctgacagcttcttctgtttgaagccattaatataagagaaagcacaagcacaataaacaccaccccaacaacagtgaccacaagtccaacatccttgtttgatcctctccccttgtgaggttgttgacaatacttagtttcatgctggtgttcagggtcgtcactgaagcaattaccatcaaacttaactaccctgttattgacattaacattaagacagacaggcaggtcacctgtgagttggtttgtagacaaatccacaaagccaagggtactgctgcatgttaaactagtagaaaatgatccactgagcatattcgcagctaggttgagatagctgatgcttggaagagcgaagagcttttcaggaggcttccccacgagaaagttgaatgagagatcgaggtgctgaagtcggttcaactgaccaaactgctcagggatttcgcccttgagtgagtttttgctgagtaggattgttaccaatgctgtaggcagctctgggagctccccatccaactcattgtccctcaagtccagcatctcaagcttattcaagctgcctaattgtggaacctcgccagcgatgctgttgccagcaagagcaagctcactaagcatggtagctttaccaattgatgctggtatgggccccttcaaccggttacgctgcaagcgaagaaccgtgaggttcgagtacaagttgaaccagtccggcatggtaccattgaagaagttcccatccaatgtcaaggtgtgcaactttggcatggctgacagcttcggaggaatcgatccataaaggaaattggagctcaaatcaagcacttgaagagatgacagccggtgaatcttgtcaggaagaggaccccatagccccaaggatactaggataacaacgtgcaaggcaggtaaccttgccaatgtagtaacaaacgaatcgagaacaaaggcttcagagagggtgatattggagacaggatagccactgaactttggtggcttggtgatcctgtcaccgataatcttaagctctgtaatggcgttcccctcgcatgccacggtgaccaccgaagtaggctgggtgtagcaggggtcactgtttgggttattccatacatccagctgccttgggtactccagctgcttccttagctgctgcagcacctcaccctgcgaggactgctcgcttcttgggaataacatcaaacaggttgcgatcatgaaagccgcagtaaaatgccacgccattggaggctcagcttagcgctcacaactgtaagaagtgccaatggttgtgttgtctttctaaattttatcacttcccggacaaaagattcaaaattccagccaagattggagtaccaatgaaggagaaaaacagctgtaggctagccagtggaagaggatccctaagaagatgctcccatcgctctcaaattacagcttcctgcaaaggaaaaagattaaatttacagcccaaatcaatgaagaaactaaggagaagcaagatgtgaatgccacgggactgaatcatacttatttccaaaaaccaaaaaaaaaaaaacaatttggagaccggatgcaagaacatcgcgaacaagttttactccagattgaacagaaaaaacaaggcagtagttgtcatttgttcaaattaaaaaatatggaagctgcagccttaaaaatctgtacggtcccgacatagaaaatgacattctggacagactattgacagaccattaagagcatatgtacagtaaaccgaacagatgaggctcatgagaaaggcatattggtgaacattttgacacaaacaaacggctttatacaaaatcgaggccggaaaaaagaatgctgaagaggcaagaaacaaatccgagctttgaaggaaaaactggaaaggaaatgcagtgaaacttgaaggggaaacgaagtcatagcaagcaaacaactgaactttaagcaattcgaagtttccagctactggaaacagctggaaattggcagaagaacaagaaagagagaatggctaccgctcgggggagagagagaaacaggccaaagaaaatctgaaactgcagaatcttcagttcaaatatctctctcacacacacacatacacagagtacaagaagataacaagaaccaagcaagcagagcatcaatgccatctagagttagaacgaaatacaagaaatttctaaaatcaatacaggctcagagaagcgcgagaggcagcgaactcaccaccatgtccgcatatccacccaaatgcatccaagaacccgcagcccatcagcatgccatcaccgcttcttcttcctcgccacacagccgccaagaattaacgaggggagaggcggagcaggtgagagtagactgtgcagcagcaggagacagcgctccaatgccacatgggatctctcgctcactccacccagcagcaagagcaagagcaagcagcagcagcagcggccctgcacgccattaatggcccctgaacggtggccggtgggcaaagttaagcagctgctaccacggtagtggtactactctccttctactagtacgtcaacagttgcacactattgtcactctgttcagaggccccaatgatttgcttcgtttagaatcagctgctgtcaaattttgaattttaaaaaggaatttatataaatttaattttcaatattgatatttaaatcataacatacatataaaatatttacttataaattatgcgtactattgctaaaagatggagaccagagatcacagtttcctcccccctctctctactggtgattataattagcagtaaaacaaagttattagagcaggtataatagcagactattagtcagctataaatatattttaattagataaaagatgagagagaagagaaatgggctagagatctgtagccagctgcagcacggatttcaaaacacagtgtgtataataggtgggaccatatattaatagtatagtaaacaactattatatcaattagctattagattagctatagataaattgaagccagtaataggctataatattaaacttgctcttaaactaccgtaacagccgcagaacacgagcagacattgcagcagtggggactggggagtagttgggctttggtttttgtcaagaggcacggtagccaaggcaaagcgctagcgatagtagctttaagtttaaccgcggggagagagagcagagcagtgagtgaggccgtggagtagatgggagcaggtttcctttactgccgcgcggttaccatagttatcgggtttatcatagagtacggtaatataaataccataataacctcctgaaatttaaataaatttaaaaaataatttgaatttttgataaattttacacggtaaccctggcctcgacggtttgggaaaccctggatgggagtacttcctccatctatagaaaatcaataatatgataaaatactttctaacacaataaatgtaattgtttaaatgagtctttatctagattggtttctattagacccataaaaggttaataacatgatggaatacttcgtacaataataaatcctaataagtttttatgtagattgaattttttatagaacggagtagaagagagtagaggagatcacaggttgggggttggatcccatgcgggcgggcgagtttgggattttccgcgcggatctgtcctgcttgtcgctcgctatcagatgggctgatggggtggtggtcgcatcatgcatggtccagattttggacaatttggcaatatgagaggaatctaatttatttgtccttgcgttctcttgataaggatgaaaaatattttgtttgttgtttgatttgaaatgcttttagaatgattaatactcctacagtatgttttaaaacttttgaagttttctttttccttttgaactattgcttgcacactcgcgcgtcatgtaagtgggttcgtataatatttacgctaaatttaatggcggaatctggtgaagagtaggcacatgcttttatcgtgagtttgctggcatgtttgtgtagaaatgccatattagtagttgctacgtagtacaatttatagtgttgcatcattttttttctacacctaatctcgtatacagctcctttgaagcacaagattgtaaaaacaaaaaacacaagaataaagtgtcatactcattaaatttctatagaaattaagaacacaagaaagttgaaaacttcgtttaaaagatacacatgacatagcaacaagaaaacataagaacataaggtaggacaaatctaaagcatcaactttatatccacgaatattcatatatacaggtgtttatttcattaaaaacatttatcaatcatgaaataagatctcctgaccaaatgattttttttctctgaggctgaattctaaacagattattttctcacctattttctcgtttatcataagcatatttctcatactgctaaacaatgtatttttaaatgtatttttaaaaatatatgtatatagaagttcattttttaaaaaaggaaaagtctgaattacccctgaactattgggtaagtacgaattaccttctaaacacgaaaactagacaattttcaccgtcaagtattaatactagatgcagaacccttttaactcaatacggagtggttttagctctatatgtggtagttggttttagctctatatgtggtaatctagtcagcactttttttttataaaaatggtgggaccctcatgtcatattctctccctctcaccccctctctcttcacccttccctcctagtctgtccatcggcaggggacgacactacacaacagcagggcggatgagctagagcggcgaaggcagctgggggcgactagcgggggaggcgggtcctcctcagcctccgccggcatgcgcctcctctacgaccgcataacttctcctcggcctccgccggcgcactccggcacatggtgggagacggaggcacactccgacgacagttgtgacgcgtgaagaggatgttgcgggcagtagctctcttagccatcacatgcgcactccggcggaggtcgtcgtctccatactttccgtcgcatctcggtcatcgtcggccacttgcaaaccaagagtcggagggagaaagcaacttgacaaggtggtgacgatggcgatagaggcggaaagctaggagtaggcatccgacttcgccaccttgccggttccatgccactcaacgtcgtcgtcgccgctattgagaactgtcgcacccaaagttggggcagcggatccacccctcctagggccgagggcaccagatctaccaccgccgagacctgccgcacctgaggctgggaacggcagattcgtcccggggctaggaacaatagatccgccgctttgtgagctggttgccgtcgccgagaccaaccgcacctgaggccatcccagagctagctcgacctccgctgcgcccctggtgccgtcgaggcgacgacgaaccaaggccgtggacaatgccacctccattgcagctattgcagagagagagagagcacatgagaggatggcttgagggagagatgacaagtgtgtccatggatttctcttatattttttttactaactggattgccacgttggcgttacgtgtgcaatttcaagttaaaactatccaaaacagtgctcagaggggtttttatctgatattactagttgagagtgaaagatatttagttttcaagtttagggtaattcttagtcacctaataattcagggtaattcaggcttttcccttgaaaaaataaatgttttcagacttataatagtacgtaataatttattagtactctgctgattcgcatggcgctaataagctgagccaaacagctaattcgaacgaaactacggccttttgaacggagaggagaataatccaactcatcttcgagcgttattaaaaagaaaaaagaaaaggagttccagtaggagtgtccgattcgggcatcccgataagctcaagcgaccttgggggaagaaacaagtaccagcttcttttctgctttcaaagacggtgttgtgttgttgatcacgtatgcctcgaatccagtcatctctaaacaaaataactatttaatttatttatattattttatcgagtcaaggtgcttcttccctgttagtctgttgcgtgcgtttttaagggtttgtttgatcgttgttttacttgacttccttcgtcctgaataaggcacatcttaacactatcaatttagatgaggtccatataaattagtagtactatgacatattttatctgatactatattgctactatatatttttatggagagtatcgacagttgataccgcgactacagtatttgatggtttggggatcgttggtaccagggtatgtgcgagattgaggtaaaagagatggagacaaggatttttatacaggttcgagctccttatctgacaggtaatagccctacatcctgttggccgaagtcggtgttgctctttattcatctggatcacacaaatacaatatttgggataacctatctaattgtcgtcgatttggcagctagataaccatctcgtagtcgacgacagggtagtcttccttctgaaatacgaactcatcgagctcagagatggcacttgatccctcttgccggcttccgtaggcacgggatgtggtatgtctaggcttatctctgatgttgatatccggcgacttgtcttggcgtatattggcttatgtattgtgcgtctatggtaggtgtgtcttgtggctttgtggtgtatcccctctcctcctaggggtcttgtatttatacccatagatgccccattatccaagtaaaactagggagataaatatggatacaatccgagtagtccttgtcgtttccatatagaactctatttatacttccttatccggaactccttctatatacgaggtttgtttccgtataagacatggtatgtggtggaccctgccgagtttagtcaactattattaggtatgtggtatccataaccatgacagtaacccccgacttcattgcaaatgaacgagttaaggttctcaatcgaagactttggaacaactattgtcgtgatcgcttgaccgttctcggtgtgatcagaaataaggctagctagattcctcttatcggcctttgtaggcactatattaggtttgtctaggttaatctccgatgtcgaccgagaagatacagagcatgcgactaagtttcttgtcttgctgtaatcgagaatttggattgaagtcaagaaattccatctcggtgggtagaccatcgcttcattccatattccttgtcgagcccaatcaaccgttctcgagtaatcgagtaggcatagaatctacgatagagccttgaaatctgacttgattattttgatgtctaattttcctgaaatcaatactcagaacatttgccatactcgcttagtcaatcccggtgtagaaccgtagagacacggagtcttcgacaatattgaatagaactttcctaaaatcaatactcaaaatagaatattaaatagaaatagccctcgagcgaacactcaagggtaacatgatataatatgtatagaaaaatcgaaaataaattgaatctgcatgtgacgataaaagagtactctcgctagagtcacccttagcaatcggagtttggtaccattcctagcccctagttgtttttatgaaaaagccattttccacagagacaacttaaatcttataacaaaccatgctgaagctgacaaatcctagcccccagctgtgaagttggaaaaatcaatttccgattacacggccttgttaatacgcgtccattgagcactcttacatgaccaggtttgacatggtcgttcggctctcataatccaacaagaccttatctactctgggcgtccctagccaaaattcccttaggtttctcggaggcttgtcagaatagtgtaaagggacgataggaccgacttcgaagacgaggagatataagaaaagaggatcatcggacaaatattgcacatataaacacttacagaagttgatgtagatgatgagacgaccaccacactgggcaaaggccaggtgtatagttgtactcaacaaatcacaaaagtagtgggagaatcgctacaccgttggtcgaagaccagttgtagtcataactcgaccacttgaagtggaggtatgagagatcgctatgacctactggttcgagaaccaggagtaggagtctctcaaccgtttgaaattgaggtgcgaggaccgctacactgctaattgaggaccagttgtaatcgtaactcgacctttggaagacatggtacgaggaccactacgctactggtggaagaccagtcatagtcgcacctcgaccattagaagtcatggtacgaggatcgctacgttgctagtagagaaccagttgtagtagtacctcgaccacttgaagggaatccagagtaatagatggatgacattctcgtgacctgcgagaactgcctcctgatgacgacgaaggcaatgaggaattaccgtagtcggaggttccgttcctggacctactacctcatcctcgagccctctagaagtatggggatctcaagttttgtcgtcgtcgtgtgatgtcgtgatgtcgttaaccttgtccgttgtcgttccgatgtcattagtcctggacgttgtcgtcctggtgacaacggcgatctagtcggtcttggttgtcgctatcacggcaatgttgattgtcgcgttagatgtcgagagattgttgtaaccaactggtcaacaatctactggtcacctgaagatcgctaagatctactggtcgaggaccaggtgtaggcgtatctcgatcacctgaagatgaatttttaggtggtgagagatcactacgatgtactggtcgaggaccaggtgtaggcgtatctcgatcacctgaagatgaaacttctcttgttatccacgacccccctttatcaatatttgccgtactcacttggtcgatcctggtgtaagaccgtagaggcatggagtcttggacaacgatagatggagttcaacggtccacaagtgaatttaaattgataggcgatgagatgtcgctacaactgtctggtcgataactaggattaggcatctcttaatcacctataggggcgctagagttggttattacatgtgcatctcatgtggccagcatgactcacatacccaacttatagcatatccggatgtctgttcgcaatcatgtcggatgatcaagccgacaacgttcgcgggggaattatctgttaacaatattttctcaaatagtctagccgtagccaacgctatatatgagataagtcgtcggtctttgttggtaggttgggtgcgacaactcagcatttttcgagaacgttctcgataatgcggtgtactcgaccacatcgtactcgagtgctcaattgttcctgaaaaatattttctagaagacaatatagtagacaatatcgagtatttactcaaaaaactgcatgaatcttctagagttatagtattatcaggatataacaagcaaattaaatatcgggcattatgtaaaccgtaaacaagcatgatttatacttgaaaaaagtagggcgagccccagtattaaaccgtggttggcttaatattggaaacactcgcacaataaatattgtataaaaaacacggtctaggtaaacataataaattattgatctgataatattgtatatatatctgaaaaataggtacggtaaattgtatataaaatattgcgtatctttgtagatatatgctggatatatctacgaatttagtagattaatttttaaaaaaaatcaatctcactaattaccttgtgtgcacgtgtccgagtagtatagacatgtcttaacgaagcaattttcacatgcactgtgtggatgcatgttggctggtccacgcatgcatgcatgctcttggtttgtatcctcatgtccgtcggcgtactcggtcgatgatagtggatgtcatgtccagcttggactcagcgggccaatgccttgcaccagctagcagcgcgacgtttgatctcggtacgaatcgggccaacgtgtccgaggacaccctgttaggaataagaccgacacatattggatcaatctctcatgtcgtcgatactgttggttttccgctgtgacgaaatcttaaatattggtcgatctcgacggatcgaatatttggcgatggtcccgatctcgtcgggggacatactccggtcgggttagatttccctacagccgaagtcgtcgagtaatttgtcattggagaatccatctcttgaacccatgtcgttgaaaccttgaagcaccaaaaattcccctacctggcgcaccgctgtcaacggttggtaccgcgactacgttatttgatggtatggagatcgttggtactagggtatgtgcgagattgaggtaaaagagatagagacaaggatttttatacatgttcgggccccttatctgacaagtaatagccctacatcctgttagccgaagccggtgttgctctttattcatctggatcacacaaatacagtatttgggataacctatctagttgtcgtcgatttggcggctagataaccatctcgtagtcgacgacagggtagtcttcctcctgaagtacgaacacgtcgagatcagagatggcacttgatccctcttgtcggcttccgtaggcaccggatgggatatgtctaggcttatctctgatgttgatatgcgacgacttgtcttggcgtatattggcttgtgtattgtgcgcctatggtgggtgtgtcttgtggctttatgatgtatctcctctcctccttagagggcttgtatttatacccatagatgcctccttgtccaagtaaaactagggagataaatatggatacaatccgagtagtccttatcgtttctatatagaactctatttatcctttcttatccggaactccttatatatacgggatttgttttcgtataagatatcgtatgtggtgggccctgccaagtttagtcaactactattaggtatgtgatatccatgaccatgacagagagtgtattaaacttttataacaaacatatgacatgacataatttatgtggctaaaaaatctttgaccactagtaaactaaaggatcaagatggatatcccgcgtgttgccgcgagaaaattgtgtgataaaatagtatacacaagttgtaagattttctttcttacttactactaccttcgtttcaggttataagactttctagcattgtccatattcatatagatgttcataaatctaggcgcacatatatgtttagattcattaacatacatacatatatatatatatgtgtatatatatatatatatatatatatatatatatatatatatatatatatattatagcgctatgggcgctgcctaactaggtggagcgacacagcgccaccaccctggtgcaacctccctcctcccagtccacagtatgtagttaaaatttaacttacccctgcgcctcctcccccacgcttataatccgagtaaacttttaacttaatgttacccaattttcagcatatatatgtatgttgttttctcaccttgtaaccaatcacatatccgatcctattttttcttactctctccgggtatttcggatctgagcgcgtggctggccatggcagcaattcggtgacggcggtcggtgaccagcacgcgcaccgacgaggttgcccagtggttctgtccgtgctagagggtgacgggcggtgctcgccctctgtgtggcttaggccaccggtcgacgggcggcgggtgaggagacgacgaactactccaacagctcttcaaacgatgagcagccgtctgcagcgtggaggagggcggatcaggaggacgcgctccttgatctgtggtggtggtcctgaagcagggcactggatcaatcgtcagggaggaccttggtgttaggtcgccttcttcttgctcaccgtgcgtaggctgcgttcaagccagaagaggaggaaaatgttgcgccaatggacgtcagccccggtgaccagcttacaggcggactaggccgctgtcgatgaggatggtgaggaggccgatgaaggtgctggtgagctttggctgcgccggatttgcaggccaaactcctccccggtgtgggatccagcgccttgtcctatcccgacaggaacggcgaaggagtaggtgacggggagatggtggacgtcgcgcggcggtgctctaggccacagcggcgtagtctggctggcagatgaacccgagtccaaccccgaccatgctttgtgcggggctaaactggagccctgtcgccttgctcctgcttcgatgccaacagctgctggtggctgggatgggattggagctgctagtctatctgtctcgagtagtcgccgccaactgctgcagcacgtcagcacctcatgccatcaacatctctgctgtgtctcctctcctcccttggatggagatgttattttttcctcctgttgtttctgtagttttttacgcacagaagattttgtgtgattgataatttcatatgcatgattgaatgtaatactccctaattttgattgtatgtgttaatatgtcccgtaaaaatgataatggttctcatatgttaatgcctgaaaaaaattctctttctcttctccatacgaacagattgagtaaaagaattaccaaaatatatgtgataaaaatattactatgaacgccaatgatgtaagaaatatgctggagtaaaaatttcactaaccttggtcttgatgagtattatccagccccgaacttgtgggagtaaaaattttactgccagtctaaagagggtttgatttcgcttcttttactagttattatggggatttgggagtaaaaattttaatatcggtcgaaagagtgtgatcttgatgagtatctgaacttgtggggagtaaaaattttactgcccgtccaaagagggttttactgattattgggatttggggagttaaaattttactgtcggtctaaagagtgtttgatttcgctaaggaatttttttactgattatggagactctaggagtaaaaattttattgcccatagaaagagggtttgattttgttaaggaatttttttactgattatgggaacctgatttctctcaagaatatttttactcaccgtgtgaactgatggagtgagaaaaggggcttgaggagggcacgtggagaccgggtggcagttgtgcaggaaaaaaacggaaaacactcttggtgggaggaaaaatacgaaaaacccagaaacagaaagggaggaaggagaaacggaaaaacaggaggagatcgctcctgtgagaggcgctacgtagtttcctagcgtgctacgtctgtgtgtcgcgctacgtagcatgatcgtgttatatatatatatatatatatatatatatatatatatatatatatatatgatatccataggggactttatggtgtccgggctctaaggtataaaaaacacaaattctctcaaatttttaaaaatttacaaattgtaagtagatatctaggtatatgaatttaattcatacaaatacctaacaacaaaacaactcaaactcaacttcatttcacaattcattattacatacataacgaattatatgtttagatgttatatatctagaaccaaaatctaaaaaaaaaagttcaaactcagttcaaacttgtttgaacttgttagtaaagaagttaatattcatatctaaacatttaaaaaaaacatttaaacattcaaattgggtatatacgcaatttgaatcttggagcccatactccatgtagcaccagttaatttacatatatatatatatatatatatatatatatatatatatatatatatatatatatatatatatatatatattttgaatctattctacacccctcctcccatgggtcaaacccacctcccccaccctccctagggcccaaaacccccctcccaccttggtcaaagcgtcctcccgccggtcaaacccgcccaccactccctcccccgcccaccactttgctgttctcgtcttgtaggaattgtgcagtaacaggatggtcatcatgcagtaacaagacaactttcttgcagtaacaacgtcaaaaagtagtcataatggatctagtttcgttaaccgtttttttatgaacatcatggtgtaaacggattagaaaaacaagatatgatgtgagagatattgctctctaaagattgagatttacctctttttagttctcgtctcactggaacagcgtagtaacacgacggccaatgtgtagtaacatgactgctttcctcagtaatgacgttaaaaaatagttatgatggttctagttttgttaagaactttttttcacgaacgccatgatgcaaatgggttagaaaaataaaacatgacgtgtacgttactactctctaaagattgagatttaaaatattttatctctaaaaaacattactactatagtgccactgttactatgcatgttctctgttactggaaagttttgtcatgtagttactgcaaaatttcagtaaagacctataaatttcgcagtaaccaactataaatctcgcagtaacgtatcatgttactgcacttttatgataatgttactaccgaattataataacaaggtatgattcctacagtaatataatgagtttgtattcacaaaatttgaacagatataaaaaaacaaacaatgatctcaaattacaaagtgtcataaggtaaattggttaagagagtttgttataagccatgaggtcatgggttctagtctttaatttaccaaattatttttattttttctagaaaaagagaagaatgggaaaaaataaagagaagggatggagagaaaaaccgaagaaaaagaaaaaaaagagaaaaaaaaagagaagatcgagaggaggggtgggggcgccgggacgggggagggagatcgagaggagtggaaggaggcggggcgcgcgggcgcaaaggggagagggagaagcgcacgggaggggagaagggaaggtgggccggatagggtaggatagagggggggtgtagaatagttattttaagggaggggtgtataatagagctactatatatatatatataatgtgggtaatgctagaaagtcttataatatgaaacgggggaagtatatactttttcaattatccaaaggttataaataattgagttatatgatttttataaagttttcaggagaagggatgcaatttgcacccttgacaaatgattcaaaagctacaaataattgagatgatgtgacttagagaaatagcactccttacacttaatggggaatacatatagacatataatatgccattacttaagagttggtggtaccttgtaaggctaaataagtatatcattgtgtgtgtggcttagtcttttgctacatttttgcttgtaacttatgtttgacaaatacaattttcaagtcaagaatttcatatatatcttttgaaatccattgcaaggcacgagtactttgctagtcgtaagaaaagtagagaaggacaaattaagcctgctatacattctacaacatatatgcaataagacgttccatacatacagactctctgtaatagtcaatgaattattgggagttgttaatttgaaatttggaagatgtaattaactgttgccacgaaagtgataacgcgtatgtaaccctttcggaagtactactcatatagtagtacatgtgtactgtgatcggtggtagtaaaatgcaatcatgcatccatagaagtccccacgcataggtctgtactggaatgaaatgtatggaggcattcttgttaacttttctttgttgtacgcagtacaattttaaggcctaaccacaccagtgccgtgctagatgcacccataatttcaggcctccgtactaaacaaaaacctggtctcgtatacttacaaatactactctctccagtaaagaatatacaaagtaatagttcttttcaaacttctaaaatttttaactcactggtacacaacccgaccagtctgtgtgatgggagcgtgtagcccatcacgtaagcctcacctttgaccggccgtaataatccccgacacataagcactcatagagtactacaaacaccacataaggaccggcttacaaataaaccggcacctataatcatttaaccaactccgcacgatgaaaatatacagaaccggcacatttaaatattataggtgccgattctagaggaaaaccggtactaataatataggtaccggttttttaaaagaacatgcacatatacttatattagagatgttcgtcgtaaagaaaagaaccggtaccaatactgtaggtaccagatttttaaaagaaccgacctctaaaatatgaacttgggtgtcggttctttgaaaaaaccaacacctattaacaaaactgtccggacgtcagattgattgaccgagcgcactactctttatcttttcgattgccaagcacatgcactactccgcctcctccttttttccctcctccctctctccccaccaccacttcttctctacccggcggcgccaatccgagccgcactgctcctcctctcctccctcaacccccgccaccactcctgcttctcctcctccgcgtcacaccggatccggccgcttggaggtcggggccgccagatccagccaccacgcgcggcagcagcgcccctcctcctttgcgtcacgccggatccggccaccacgtgcagcagcagctcctcctccggccttcttccggcagcagcaccacggcaacagctcctcctctggtcttcctccagcagcagtgcaaaggtaattacacatcccacctcttctcttctacacttcttttcttggtgattgattggattttgaggcctgatttgtgcgcgcagccaaggtctgcatggtggggttctaaatggggttgggaagggcgtggagacgaacaccgccaaggtggaggaggcagtcggcgacgacctccaagggctcctcctaaaggaataaaacgctagctatgaacttgtagcttgaacaaacaaaatgtatatgaatcaaaaggtcacaaacaaggtatctaagcaatatataaggtcaccaaatatatctactaagcatacaagtagatcgggtaaaatcaagctcaagcacaatatgagagaaggcaaaaatggacaaaccaagagaggagacgcgtgatttgtttcctaaagtttggatccacggatcctacgtctccgtcgaggggccacaaaggccgggtctatttcaaccctttcctcttgaggttgcacaaatacactcctcggtttcactcttgttttctttccttgcggagacgaaattgaagccttcacaaactttccgtggcacgccacaaccttgggtgctcatcgacgatgcctagccgtctaggagaccttagtccccaagagtaacaaacacaatcgaagatttgcttgctatgaacttgagtgctcaaagtatgaagtgaatctcagtagctctcaactttttaatctctcaatccaactctttccccttctcaaatcccactcacaaacaggcaccataatggtaggaaaatggggaagaatatctgatattttttttagaattgctgaaaggcacagagtaaaatgaccataactttttactcaggagtccgtttttgatgatctaggactctatggaaagctcactcagaggattaccgaactgttgacaggaaacatggcggcctagaacatctgcttaactctagtgcaggtccaaggctagcctcgagtgtgttaagggcgtgccaactggtttgattcaaccaacaagaaaaacaacaaacagagtaagtcaacagatagccgatcagccgataggccgatgacgtatcgttggcgatcctagccgatatagttagaccaaatcggctatggattgatatataaattaagcacaaaccctaaatatgcctcatcggccgtgatatcatctatttggtttatcaaatctattttagacaatactatagaaataaccgatggaacaatattcagagcaagatagataaataaagataataatactctagtacaaacttatataaacaaatcaatctatagaaatatatcaaatactgataagttaccaagtttgataacccgactgatactgatctagacttgatatatttatatagggtgatctatctatataagtggcaaatatacataaatccagtaaagaagcatgtatattaggtaagatcggctaaaactttgatactatccttaattatgattaattccaagttagtttttagggttcaagacatgactagggatgatgtatcgcaaattatgtaaagaaacttaaaagtataaacaatcaagtaattaaccattttttaggatggtacatgccttagctaatataatctagcaaaacaatttagctgatatcggcgagaaccctaaagggagaactggccaatagggctaaatcgagatactaagactagattaactaagacatataatagcagatggtcatgataaaagggctaaacatctaaagggacataatagccccgatagtacaagtcatcgaatcaagttacctcttgtcgagagaactcgccgaagagaagaacaaaagggtggtgatgcgccgaagttgtattggattttgtcgtccttttttttacaactagtaattgtgcacgtgcaatgcacgtagtttaacagcatttgtcgcaataaatatatcaacacttcaaattttaagaataatatcagcaataatgatatggcctatttttataggtccctgttacacacttgccatgaaaatagtgcaacgttagagaaaattgcttgacgaacacttgaaaagctggaataaaaaagatttgtctttcagtgggattgaaggtaactccactgtcgaacaaaaagaaaagaaaagcataagcataagctatctaaaagtaaaaggctgaaaaataaacttcgatgaaaaacccccaaaatctacttcaaatttaaggttgaaaattcaaattttggctaataagcataagcctaagcaaaaagacctttgaacaatcacgcaccttttgcgccactggacatgttatatatacataacaaaaccttatttatgataaactagttcaagtatgaactaaattaatatttcaacttcagtagacagtgagttaccttagaacatatgcttgtcttgagggctattataacataataagtaccgtaagtatgaactaaattattttttcaactttagtagacagtgagttaccttaggatatatgcttgtcttgagggctattatagctgaataagtacaatgaactgcaaaaatactaaaagttttctcaaaaccaacaactgcaaccattgcaccatgtagcccattctctaaagaaaggagagatagcagtgaataactaacctacaactacaatggccataaaacatcatcaagtacaaactttaccgagatgtagaaatggtataataattcaacttgtctccccaggcactctgacatattgtctaaattgtgcatgttgctccatagatagcagagggaggcccatatcttctcccataattcctgaaagtgcatacctaaagacatttgtttctttaatgctgaagcacatgtattcataggaagaagtcacaacaattgagatatcagcttcattaacaaaattttttgatacaacaattgtccaaattgagatacaaagaagtacttgcaatacacaacatcaggtcaggaggcccttatcctaattggcttcctcgtaattcctgaagcccttttgtggatgccatggtatattcaaatttaaagcacccatggaacttgctgcatatttcacccaagaatccgcatggccacatcaagccccaattgcattttcagatacaaaatacctgtcagtccataggggcagaactataaaggaaaagataatttgtaaatttgcaaagtagaacgtgatgccatgaagattccatcaaccatgtaattaacatacttataggaaatcaacctccaacatgtatacatgaaatgaaacttgtatcctgctgcatctccttcagtggagctgacaccaccgaccagtggagcaagagaggatggatctaaaaactatatattgtttccattagcagactaacaaacaaaagcttatctccaatcaaataataaattgtagaatatattccttactttcaatagtaagagaaaaaacagaaatgcactgacactgcttttgtgatttgccacctaaacactgcttattcaatatttagaaccaaactgacatatcaaaggtctctaccggttcagaactgcatatcaaaatgatatatccacccagtacatgatcaaaattgaagcaggtgagccacaaatggggtctggatagagctcagagatggtagttcgtcccgggttgccatcaccagtttggcctccatctccgattctctgatccatccctgcctcagttgtttgggcatgagacaagcacagtctgccccagggaggctggaggcatgggcggggtggaaatgatctcgaagactgcgagatggagtggagagccggtcgtgggttaggagggttttgtccatcagggacagcacgacacgcgtgggcacggctggagggcaaccccaagcaaagtgtgatggaggcggagcagccacgcctgcgggagagcggaccattcccaacaaagaagcatctaacatcaatttagatcacaaacataaatcaattatctatatataagatttgcaaaccataaattcacaattaattcaatacgtatattttctaagacacagcaacataagtcatccatgaatcacatatttgcttgctgaactaaatgaagaaatagtacatgaacaagatcaagggaaaaggcctactcgcacttactcctcggtggtggccggttcagcctgatcaggtgcctccttccccgctgcttcttcttctcctcctgcttgcgctgcttcttctactgcttctgcacccatgggaatggcggttgtcttgaaggtcgggtgtcggcggagtgggcgcaagtgttggatagtataggaggagagaggatactgcgaatattggacacattatattgagcctcgggggccggtatatataggagtacatggggaggagataaggaaggattacagatatggaagtagtccacataaatcaatcctatcctaatatgactctaactaccatatactctaacagcaagcaccggcagccaaggggacgcgcaagcggggccgctggagtcgcgcggtagtcggtgacctagggtgcacgtctagcggtggtctagtcacggccatgaaaggagaggggtggagggcagcggcttgatgtccgcaggcatcggtagcaacttggggtggacaataacgatgatggtggcagtgggtgcactgatcttggtgacggcgagtgagtggctggcaacagtgccaatctaagcgagggcgaacaacgcccccactctctcgtcgcccacgggagcacagtcggggtcaggtgggaaggaggaagtgatgttgaggccgtgcttgcgggagcagggactggtcttcgctcacggcggatctccgtcgcgccgcctcaaaccccaccgtcaggcagatctccggcgaggctgtgtgcagttgtggtgaaggagatgaccagcaagtcaagtggaggaagagattgagcgattttgtggatggcgaatcatgtctaggctgagcgattttgtggagggagagctaaggagaggaggacgctatcggcggcatgatgaccgatgaggggaaaactacgatgcggtgacgaaaggagtggggtgaggaatttgctacgctaggttagcgcgtggaggaatttatggtggtggggacgaggatttggtgcattcgcatgtgggcctagtttcctctaatgatttcaccataggattggataggcacaactcctcctttttatattagtatagatgatctggggtttatatttatacctcaagtacaaacttagtccattataaacatgactcaaactttcctaaagataaaatacaaacaagaccatacggaggtctcttaccatatctctaacaaaaaccaacataaatatcctaattaatagatataattgccttaatcgagctctatgtctaattggcaatggcggttatctcaatctaggctcataccgagccgaagccatatcatataggccacttgccatatcggctaaatcaagcttcattccagctgacacgatgtccagccgatgcgcagtccgacttcaaatctaactcgatcttgcatcaaatccgcttcgatctgcttcctttttctctgagtttggtgtaaaattccattgttagcaccaacttaaccaaaaacaaagtctaaaactactcaaaggataggttaaagcttgggtttctcctatggtagcactatgataggtcactctgagcaccgagacatacgcaaacatatcgacgttgcatccctcttaatagtacagcattcctatactcaaatgtaaataggaagagaattataccaataggaatgccttctttccatcttttctttgtcttaaggaatgccaacgtcgaaaccgtttcaccatatattcttgaaatgattgatgtggttacttgtagcttcaaatggctccgcatggtccatcatgacaaagtcgtcactcgtccttcaccattggatttggttcttcagcaccaagccccttgcttgcccttcaccaccacatggtccatcgcggcctagcattgcttgcccttcactgtcttgccatagtagccactttgtattccacatctacaatatattcattctgccatccttgatatctttaggtgtaataatatcacttgagcatcaacacctttgcaatccttgggacctatttctctcattcaacacaataaaattattagcctcaataatctggttgtcaacctttacttgttgaccaaccaatcgcatgtataaaaagatatgaataaatgataagtattaatcaacagtacaagtgtcatatactcaaatatatgcttaaatgttaagatcccaattaaatgaaagtgaacaacttgcatcaattacatgcataaataaggtataggatttgctccccctaaatgcatgcatacaaaatatttgtgtgaagcaagagtatgcataaaatgaatgaaacattaggaacttatcctatacaagaatagaaggcatttatcaaatataggcattaaaataaatgtataccttcatcatcttcatgttcttaatgtaaagagactaaacaaaagaaaaggctcaaacaaaacattagtctcacatgtatattgttattcacgtggaaatattatatatgaacatgtcaatatgtacatggtgagaaatagtgatatatatagattgatctccatgcattttatcattgtgatttaggtccaccatcaatgaatgtttctatctcaactaatatgaagttcaggaatcacctctcacacactacactttcatatccacatgagactaggcaaagaaatggttataaaaacattagtctcacataattggatttataattaattaccaaaaccaaattaatggtacttgaactttcatgatcgacatagcaaagagtataaaagtggcatttcaaattttataaacatagcgaggaaggagaggaaaagaaggaacaatgattatataacttgtccatgtgttgattgtaaaaatgaaaagatgtttaccagaagagtagatatacactctcatttgatatatcgaggattcatgaagggctatacatgttggacaaagcatggagaaaatgaatcaatcgatattatagatgaagggagtggtagataaaattaggaagaaaatgaagttgacatgtttgtttcttatccgttgggcagtgaaatggttgatgtcaatcacaatcttctgcaagcaatgttgcatgatgttgaggagacaacttacaatgcaagattgcaagcaatgttgcatgatgttgaggagacaacttacaatgcaagataccatgagttcaccaggttggttagtgattcagagacacctctatacgatggatgcaaggcaaaacatacaaagttagttgctaccctagatctaatgaagctaaaagcatgtcgtggatggacaaacaagagttttacagaactgttggatatattgaaggatctgcttctagaagagagaacacacagcccaaagcgacacatgaagcaaacattttttgtgtggggttagtggttcgtagaattcatgattgtccaaatgactgcatattgtactaaaaggaatacaccgacttagagtcttgtcctgtgtgtaaggcttcttgatacaaaccaaagagaaattgtgacgaaggttgtgtagtacttgcctatcatcttaggagaatctttgccaatccctaggcaacagagttattacgttggcatgtgttaacaacggaattttgcatcagattcgaagaaggaagaagatcgaagcagatttagtgtggaatctagttgaatttggagtcggactgcgtatcggctggataccatatcagctggaaataaagtgtgagttgatcaaggttgatggagccgatggccgatacagccgatatggtatgacttgggctcgcatgggcctgtattgggataatcgtcattgccaattagagatagagctcaggtaaggcaattgtatctattaaatagtttggttacgtcggtttgtgttagatttggcaagagaccgtcatatatggtcttgtttgtatcttatatttagaaaggtttgagtcgtgtccataatggactaagtctgtattcggggtataaatatgaatcccttagcattgtaatacgagggacaatccaatacaacttcggcgcatcgcgaccctttcgtttttacttttcgacgagttcgcttcgcaagaggtaactcatctcgatggcctatgctattggggctattatgtcgttttagatatcttagtccttgtatcatgaccatcgatatcatatgtctatgttaatctagttttaacaaatcgatttagctctatcggctgcttctcgctttagggtttctgccgttatcggctaaatcgtcttgctagattagattagcttagacatataccaccttgaaaatcaatcaacggcttgattgtctagacattgtgtttcttttcatacttagtgttgcattagtacattcgacctactaagtcgtgttgatctctaccctgcttcttgatttctaacagggataacatcagggtttcagccgctcttacctaatatacatgcttctttatctgtttcatgtatatttgccatctatatagacagatcactttatagtaatatatcaagtagaggtcatatcggctgggctatcaacattgactattgacctctatttggtatattactatagattgatttgcctatatagatctgtactagagtattagccagtatattatctttcttacactaaatattgttacatcggctattttaataatattatcttaagcttctttatcaatcttgatagacaatgttacaaccaatgaggcatatttagggtttaatattctttaatatatccagtctatagccgatttggtctaactccatcggtagagaccaccaacgatacgctatcggccgatcggctatcggctgactaactctgcttttctctttcttgctgattgcaggatcaaatcagttggcacgcccttgatacacttgaggctagccttggacttgcactggagttaagaagatcccctaggccgccgtgttttcacatgaacagcatgccacggatcgaagggttaatggtatgcttaagaaccctgcagattcattttaatggagaaatattaataaaaaataccttaaatttgttgctgaccagagagaatgtaacaccccagaaaaccacataagcctgggatgccactaaacaaccacacataagtgccaaaacaagcaaatttcggcaacaactatcttagacaagaaaacatcgcggaagcatcaacatatagattaaggttatgatacaacaattgactgacatgtagggataggcttgaaaaagtggctaatcaatggtcaacaactctagtatttaattaacccattatgtctaaacacaagtattcttatcaagatattacaataatcatgactaagtgagatcatgtcgtgcgactgtgtagctaatcctatcccttcatgcaaacatgtcacagcaagtacctgaaaagactataagggggtgagaataaatctcagcaagcaaatggctttaacaagctatttaaaccacatgtttattatataactaatttaaataccaagttatgattcacataaagacaagttcaaaatccaaggaactaaaacatcatagcgtcaccaatcaaatccatatactcacaaatcctagagaagaaaacacttctcaaagacatcttcgatcaataattttcataacgtcctgcaatatgtgcatatacaatgcaatgatatgtactcctgccttcacacccaacaaggtgtgaagctgcatcgtattacggcaatatacgatgctgtaccggtacggtcgcaaccataggttcacgacataacttcaaatgcaatgcaagtgatgcaaatgcagtatgaattccagagtataacatcggaaccacattccttcgatggagatcagtataaggttattataaccaagagcataaagtataaccataaacagtgtaaaatcaataagtatgattcagataggtaaatcctcggtgtaatatataataatcttggttgatgatatataatttcaacgtggaggtagaatcaaataacaagtcaaggctgtagcaaaccaccgctacgtttacttgccttcaccgatgatgagatgaactctagttgcattccgaagtggcatcacctaaataaacaccggctcagactcaaacaacatgcataatcattcaagaatcacacatacgcttcctacgctgggatcccaccccaaacaacataaagcaaatcactgataatcttcctataaaagcagcatagattaacaatttgatacctccaattctacatcacataacacagaaaaatatgtcatttctgacatctacagaacaagaattacaactttcatttagataacaaaattgaattcttccatttagctggcctaaaacatggcacaaaacagagaagtgcatctgcccagaaaactgtgcaacaaccattcaagagagcactgacaacaaactacaagataaaagctaacaatttttatgtaggaggtagatcacaacatatgctacaacttctgtaaaaacaagattctctgattccatcattaagatcctctaaaatccctctgaacctcgactacagaaaaaatgcatcgatattcagacagtcaacttcagaaattgatatctcctaaaccacttgatataaactcatgccatttggtcagaagatagatctacacgttatctacaacttttgtatagagacgtttcgcaggaaatcccattatgatggccgaaaaggcatccaaaccagaactgtgcaggggacagatcagcaaaaacctggctgaggaataaatcggttgatcccaaacttactcgcttccaacacttgatctaaaccctaatagaaaaccaaaacagggggaaaagatcatgtattagatacctaggcctccatgggcagcggcaaccaaaacccctcatttccttcttcacctcaattccctccgcttccttctttccctttcttcttcttcccttcttcccaggtctgcagtagggcaggcatgggggaggtcgactagagggggaggtgggcgcccccagggtaccaaatgacggctagggggaggtgggggggacctcctagggttttgggatgtggaggggacagctaggccttgggctggccaaaagctagcccagctagcatatacctattgtttttcttctaatttcaaacaccaaaaccttacggacttccaatatatcctctacagtattctattttttctagggcattacattctcccctcctttaaggaattcgtccccgaattctaccttcaaaacaaaacagtccaaagagatagacaccttaagcatcacacacacttacctctaggtgatgaaagggaaaaaaaatcccatcaaggaaaaaaaacacttgctacttatgccaatgattcacatataaagaaatacattagagaaattctttagaaagagacacatttagaaaccgaagttatgccttaggcacaatcaacttcgaggtcctgctctgtcccatttggttgatgctcgatcccaaactctagttctcctaaacttcaataaggttgtatgaagctctagctcccactcccttcgacaactaattctattttaggaaggtcaaacttttctcgtacccacacccataaccatcaaagccccacaaaacactccactttctattacaattgaacttcttgggtcccttgtcaaaactatttttcttactaccaaaagaacattgctaggccatccaacctccttcccacttcccaaaagaggcaaagaccagagaaaactatatggctcttctaaaataagacatagccaaacatggggcattatccctttgtacactcatgcatgcatgtactgctggaataaacacctattgtgacaccgaaactacacgaaaatatttcgtttggctgatgcaacaaaacctaaggcaaaacatgctcaaacacacaacatattgcaacatcacaagctaacattttactcaaaggtgaacattcatatgagaaacaccattagccacctaggtagaataaccgtgacgttttttctaccataggattcactcaaaggactaaaccaataggctcgacaaccaatacacaaacaatcacacacacaaacaagacaccatgggccacaacttgaggtctgcataatcaacaaacacaatggagagctagatcgagaaaaatactatttttaaaacttgatggcatgctagagaggacaactagccaagcaatcacaagaaaccctactatgaacccaccgactacgtcgatttaacacaacttcaagagcgtatcaaacacttaaccaggataacaaataaccaatgtagataaaaacatgcctttgggccacacaaacattccacatgttcacaaaagtaacagagcgtctcaacatccaaggaaagctttcagcaaccaaaaacaatgtggaaaaagcaacaatccaacttagacactaggtcccaaagcaacatgccaaaaatgtccccaacaacaaagatgcatccagccatggggacctcacaagattctacataggttctatgccatcataactcactagtggcgataatattggcccaatccttttgggaaaaaaaaacctgttctatactaagattttctagggtcatggtgaaagttaacgccccaacctatgtggagaaacacacaataatccaccctttctttgcatcgagagatgcacaacattgtggccaattgatctatcacacactatttgcttcaaataaggacacttgagtcatcaacctaacacttgggcagcgtcactcagcaatgaagaaaaaaaaattgtgacagcccttcatttagcccatctgcatcactagtcggtgctcactctagaggctcctaacttttgtcatcctaaggaccacattaggatctaaaatatatctaaaacaaaaccactccaatacagataaaaagaacatgatggtgcatcaaacatcaaaccatacagcagaacaccacatatgagcaattgtgtataatgaaaaaataataatcaaaccactaggatagaacccatttaaacaataataacaacatcaaacaaggcattcgtgaatatagcatgaagaaatatgaatgtacaagtgagatgtactctacttgagctctacgttttgtgtgttgaagtgtgtataagctcctccttttatagtgagtaatgacagttgttgacagttggaaatatcggtaacaccccttaaacatcattagggagtaatctgggacattcacgtggaaggccaggatgggaggcgccagaggcggtttggccgaaccctgggctccacctcctggcctctcctttggctaggagactgactggtgggccgttatggcggttaggcctatagtatggctggacgaattcgagggcgaattcgattgaaggggggaagaatgtaatgccccgggttttgaattaatatatttcggggaatattagagcgaacgtgcaaaagtttaacttttaaactattgtttgaataggcgatcaggaaccgtggatgcgtagagctcgtcgagtagggcgaaatagactataagtttgtggtaatcggagtcccgagttatttccggttatcgatttaatgtgggctgtttgatcttcattagcctctccctttttaaccaatagaaggggaaaaaaaagaaggcatcgctagcagctagccctagccgccgacgtccgcctcttcacctcggcgccgccgccgctgtgcgtacgacgccggttaccacagccatcgtctccttggtgagttgctgctgtcgatctgatttttgtctcgtgttgctgctgctgccgctaggattgctgcatgtgctgctgcggctgctgccgatctgccgttgctgctgcttgtgcgttgctgctgctactgctgctattggctgctactgcttgttgctgcagaagaacaggaaggaggaagagaagggaaaaaaagttagaagaagggaaatttggggagtttggtggatatttccaaattctttgtttttcttacaaaattagtacttctaggtaatccgttttattccctagttgtttctaatttatatataagacgttccgtttctggtagcttgaatttatttttatagaacgctaggctgaaaccgtattttcaattctggtattaaaccatcgggattcaggttagttgtcctaaataaagtttgtagttatcgtcgatatctttctaacactgctagtttcgttcgattctgataaacagtttgggagaaacaacaaaaacagtactgctgaccgggtccggaaatcaggacagcaattcgttttccttaatctgggattttcataggcataatctgattttgtgcccaacatgaaagttgtagacaattttgtatagatgtccgaagttgtattatttgctagattctggtagacggtttgcaagttacgtataaaacagtaatggaaccgctataggttatttaatacaaatcggtaaaaagtttatatgttctaggttatcgattttagtaattatcccttgtaactatcattggttggatatagtggtttatgcatagttttgctccacaggtgtggagggttccaacgttggagttgagtcggagtatcgaagaagttaaggcaagtacaagatggacttgtgtgatggataaactgtattgctttgttggtttcatttacccaattattattcgaagcttcctattatcaattgtgtggttttggtattatgctacatattcatatttcacttcatgttcaagttcacaacgttattcatgtttcattcttctggaagtttttgtttacattattcaagtaccatgtgtagtcatgggagtgcaatttggatctttattcataatccttgagaagcgctgatcacgcttgctcggcttatcggtaatgctaagaggatattcacatctgcccgggagggaactactactttttgcctccttcgttttaaattaaagaaagtcaaatgtttcatattggtttcttattgcattaaacctatgtatgttttactagttcaatattgtacttgcttagtattctttactcattcttgtatttaatttggtttttaggtacctaatggtattgatcggcatgggacgggagtagcacccttgaactacacactattattgcacactattgaaatttagttttagactatgtttttgcttagcataagttttccgtagaacttgtaactgtcatttaaagttatggtccttactttcacgtagaatttgtggagctaggatggtttggattgcgtggattatattgttattgagttatcttataattgcctgtcgtggatatccgtatttttaggggagactctgccgaaatttctaataatttttggagttagtggtttttgagtgtattttggtgtggcattctaggtacgtggctacctggggtgttacagtttggccccattttaagtatgtttcaactgacttgtgggctctctactcgcgcatgattggtcggaggcttattttcgttgcatgtcgggtgtattttctcctttagtgacctacatatatatatttaccaaaacaatgcaagtggttagaggtaaactcctacttctaagttttggtagtatatttgatatcttttatgcatgagtttacggttaaagtttgcacttaacgaccatcaacagtatgcggaagaaaaagtatatattctagtgactaccatacttgaaggacattgagttccgtcattgcattgatctaatgcacgtagaaaagaatgtgagtaagagtttgatcgggctactgctgaatattcctagaaagacaaaaggacggattaaacatgtgtctagatttacaggagataaatattcgaagtgaattcgcaccagcaactaatccggacacaggaagagtgtacctcccttcaacttgccacaccttatcgaagaatgagaaaatccaaatgttatcctgcttgaaagatataaaagttctttcggtctattcagcatggatctgaaatgccatagttgttttagatcgtgggaatgacaatcatgggattgttttataccgtcaaacaagatgacaagagtacagtacaaaacagcgaggtccatatagatgcttttattgatcaacttgggtctagctcatactacagtcgtatagagcagacctgggaactgaacagtaccaaattcaaagtactgttgtttcgttgccattgggtcaatttacgcactggagtaaaagtagataaggaaggtttcacaactatagatctaagcaaggttggatacatggatgaaccatttgtacttgcaaaataggttatgaaaattttctacatacattacccgacaaacaagaagttgcacgtcgttagggatggcagaagaattgttagggttgacaatgtcgtcgatgaggacgattagaaccaaaaccttcatgtcagtctgcacatagacctagacaatggcaccgaagaggaggtggtgcatgtatgttgagatcatgccgaaggcctatccttataatagaaacattgtatgccatcatcagtttctactattgccatgtaatctggagtttcaataaaacattttgttcatcttagtcatctcatcttcggcgtaccttattaaatatgtgacatctctaagttagaaaagaaaaataagtcaacagtggtctatcctcaaggaaccaaaaggaaccaaaaaaactaacatgttacttttttaaaaaaaataaaaagtcatctatgacgagcttttagtaataaccatttgagatgacatctctaatgggcctttatgaatagccatcacggatgccatctgcaacaatgcttctttccaatccgtcaaggatgactctccatgacggtgtccctttctagcctatcactgatagctatcatctgtggcgacgttaattatattgccctttacgggtatgggttgaccaaatcggtgtaaattaaagatgagggtgagttcgcctccccacagcgctccggaccttttcggggcgacgtgctcgcttccgctgatatccacgtcatcccgctccctccgcacgcgcaaggctggtgcggctatgggcccggttcctgccgtttcccgcgctcggggagcgcctcttcccgcgcggccgcgcctccggcgcttgtgatgaagctgctgcgggcttgggtatctctaaatgggctgttagggtggggcccaaccaagggacagcaagctagcaggttcgccgtttcactgctcgctcgttcattagacccgtcgggcgttttccgccgtccattgcgctctgcgttccaaaaaccctagccgcaccgaagccgcctcctcctcctcctcagcgacgccgccagccgtccttcgccctcctccccacaaactcctttgcgcgtcctccttcgcccaggcgctgctacgatcgttcgatgccgtggtgaaccgcctctaggctgcgcttgacgccacggacgccgcggcggcgtccctgttgagggaccacacggcgctcgacgacggcaacacgcggctcggggcgaggctagatcgcgcccacgcgtcgaaccttgtgtgggcggcgacgacgccctcggcccactcctttccgatggcgtcttcgactccgtcctctggcacgcgctccgcatcgctccaccggcttcacccgctcactcgccggcctcctctgatgcgctgggtgggatcttgttgctacggcggagattgactaccctgatgtagactactccaggcctaagccactgccggtacgcactcctctccctggtttgcgtatccaggtttgatggcttcgattcataataataatttggtggttcaactgatacgagcacactggaaggaatcgatgttgcaacctggaggaacgagtcactgcagtgattaatcgagcacttagatgcagacccaattgaccttattttgcgaccggaagtacaagtagctcattcatcctgctggtattgaagtctatttgtgacagcgctgtggtgcagctatctgcatgctttgcctcctccttacaatatgatctcccttgaatccatcgctcgggcctcaggccatggttgcagccgctgcccaaccgtgctgccccgaactgctcacacctcaatgtatacaacaggcactgattgctcaacgagcaggacaatgccacaccgagtcacaatcacagacatgtgagttctttccctttatttctgtatcattacaaggagtactgatttttttgttaactaaagattgttgtatttatgacggtataagatgtaatccctgacaatgtgatatatgccttgtgctgttctgtaaaaagagagattattttcattccttcttgtttgtgtgtatgttttgttttttccctcagcatcaaggtagattccctagcaattacatactgaatttgtttgtgacagtacccgaggttctagatttggtttggtttggaattagctatgcctcacgccgaactattggataagatgtctttgacgtgacatttgcatcttagcattttttttatttgagaaaatgtgaaatatgtcgatttgtatgttctttgtgtttcctgacatactgattttgtttatgacgattattaaaatacatctctaccataaagggttctacactggtaaaaggaccatatgtttagacgctcactgtaaatgacttattgttacaacgagagcagacatgcaagctttagggactgtccatttattgtatctcatggttgctagcagctatatcctcctccatgttcacatcccattgagactgtcccatgtcagctaaaatagtggcataaaatcctcttgccatgaaccgaaacacctacaattctaaatagtgaggtgctgatgtgctatagaatttcttctaactgatttatgtgttgttattgcagattgtccttatccaagcacatgctgaaaaatctaaagtcaaagtaagaattcatttaaatctccagagactcatttcagtggattatctactgtggtaactcccgtagtcacaggcaactcatttagctaaatgtgttgtaatttatataaaattcttactttaaaactgtctcaggtgatagacgatgatcaaagggatgcagttctgctgactatgaagattgattctaaagaggaaatggaaaggaatatttttgccttatatgtgctcctaaaacttatttcaatttgtttgattttcatgtaggtatttttgttggtttagctacacatggtgctcactgatatactattttcgatgccatgatattgttacatgtttcgtttcctatatacttattgtacttattgtagtgccaagaaagccgaccatcaaaagctttcaatgggtacaagccaaccattgatttcgaggtaactgaccatggactttcaatgggtacaaggaaccattgattctaagggaactgaccgtgaacttgttaaaggaggataaaggtaaactgcaatacaacgccatttaaataaacataatagattctcattgcctcgattattttcgatatgtgttactccctccatcccaatatattacaacctaggatgggattagacccattctaggactacgaatctggacaatggcttcctatgtaccatgctatgctatctaactactgctttggagcatcacttaatgtattaatcgctacactacttatgataagctttgcaaatgtgctagattagttacatatctctatgcgtaatgatttgttctgttcgtttgaactgttcatagcatagtgataatgtgcttttcctatcattctattgctttatatttcaatgcttacttcatatgactaaataataacacctttactcatgatagggcgctgcaaagcgcgcctaatggtctagttaagatcacggtctagggtttaaattcactgtacactcttcactcttcaaccagttcagatctactatgggtgtcctttgctcccttgtcggcctccatcgagccccgttgaggccaccgtcctctccactgctagcctcctccaagcactgacgaggctgccgtcctctccaccgccggcctccatcgagccccaacgaagcttgttatacatgctatatgtagtacaatcttcgatgcttgtgtatatgtttgtattgctaagtacattatttcttgcaaattgtaactcggtgataggtttgatggttaactcttcaagatgcatcgatggttttgtgtaagttctctgaattttttgacaaattttaaattactacaacaatgtgaaatggatgtgaatggaaatgtaactgtgaaatggatgtgaatggaaacgtgattgtaaaatgcatatgaatgtatttatgtatatgttgttgtgaaatgtatgggatctgggattatggggatgctgggaatcatcaatcaataactcccctaaccccaccgtttttctccgatttttgaattatttttgggctatctcgttactttacacgtcgttcctcctcctcccggctcctcgcgcgtgcctgcgtgactgctcgtaagcggtcaccggtccaacgttttttttggcgctgtggggcgtgtgcacgcgccggtcttgacggcgggttagagccggttgcattagtaggctattttgcaaaaaagtcctcgtgtttgcacggaatatcatatatgccttacgtcccattgtattttttaatgtataatctctcgtattccaggaaaatacaatacgaacgaagaagagaaaattccccttctaggggtaacgctgtaaacatgaaaactatagggggttttccgcaaaacgtcctagactaacaccccaatcctgaaaccctcccctcattctctccctctcctctcctcccctccccttctctcccatctctcctctctcagctcagattccggctcgagctgccatggcggcggcagttactggcggtggcggcggcggcttcaggcggtggctgcgcgaggggtggagccagcggcggctcccctccttcctcccagatccggtggaggcggaggtgaagggtggaggcggcgcggagggtggatgcggcggcggccctcccttccagatctgacgcggatcgtcgtccccccaccgccgccgccgccatagcaggctcgctccaccccctagcccgctccctcctcctcaccgacggcgccatacctcctcctctaagccggccggtacgctcggccgccagccccagcttcctctcttcgtctcacgccgcctccttcctccccgtcccttcgttctacttcttcacaacccccacctccacgccatgaccaacggatgacatccgtgctcggataggtgcggatgcgcctagcgatttctcctcaccagatcaacctccactgcagcctcctcctgccggatctgacacctcctcgactcagcatgctaggtgagtccccccaccatcccgcttgcgtccactccagcatgtcagaccctcagcgtctctggcccctccggcttctagctgtctggccttcatcaacagccactcctgtagctgctagaggtcaacgctgtcgactaggcctccatcggccatcgcaggagcttcttgagctacttccctcaatctctgattcatgctcttatgtagccattcagaataagacatccaggcaaagtcaacggaaaaaggtaagctgcaggaatttctctttttaccccaccattaagcatttggcttcgactatttgcattttctaggatctgccattttccctaaggttctttgcatgtctgatggctacagatggttctgaaattcaactatatttttgtgtaaccttgcaaacggtccgctatatattgccattgtttgtaattgacatgtgtatacatcagctactcaatccagtaattgcataatagttaatatttccttgcttctatcttatcatgtaaaaaaaattccctacaaaattaggctttctcaccattgttgccttccagaattaacatggcatgttgcgtacaagaattatctttctttctatttctatgttctatggagttgatgtattgttctatggtttactagatagttgatctatcaaaatcaatcctagcattcccaaattacctataacaagaggtattcatggatcggtacaacatatatatctacagcaggttagtttcgttctgttttgtcaacacagaatcatgaggaattttagatgtgttcattctgtgatgctgtctataattctatatgtattaaatttatatgacacgtgagtgtatatatgcaatgccattacgaactgctactatagtctccctgtgttcttctctttgtatacatgaataacaaatatggcacaatttaaggcaattgcagttttacaggctctgtgcaagtagctgtttatgttttaacggtaaatatttagttttcccctgaagaggagttagcaaaaaaaaagttctttcatctgagatgcttatgatttgtggctaatgtcgtcttagtcgttcttgttaggccgaagatcctagctcaatattcaaggaatagattcccttcattactcatgttaatgttgggaggggcaacccactatactcagctcgtggatcttcatgaatggagctgccagcatcataatgacaaccaaataggagtacaagataaggtaaataggtagtggggatcgttcatgtcacttgctctctgtttttctccttagggaaaaaaagttaatctttccgattatttcgttctattcattaattatatgtacttagcaaattgttgtgttgtatatgtattgccattttgacataataaaaagattccatttgatcatttcctgaaccatgcaggaataatactccgagtctctgatccaactcttctgctcatgaaacttacaaacaccaagtcagttgactgctgcaagcagtatggtctctgtagccaatgcacatatagctctcccatgagtgtttcatgctggtggtcatatactcgtattaacaatgcgtgttagatgcaccgagttgctagcagtgtgaaggagtaatccttctcgtttgctgcttgcattgtaaaccttgcggtttcacttttaactgatgttttgttgttgacgatctcgcaggtcgactgatagatgcattgcggaattctgtgtggatgcaaagctgactcaacattgtttagcttttataacagatggcttcaataggggctgcgctatctgggttaaagaacagcagcttcaccacaatgggtgctgagaagttgcctgatcagatgcatgatctgaagataagggatgacaatgtaagttttattatgacgagaagtgcaatttcttctatgtgccatgtgaatttgacttcattgtaacatgttaagctaaatggtaaatacaggaagttcaagtgactaatattaacggcaagggagcagaaaccggccacataattgtcacaactactggtggcagaaatggtcagccgaaactggtgatttcttggtacaatgttgtgatttcagaacaaatgctatcgaccattgttatctgaaactgttcatcgattataaagcaatcttcatttctaattcatattcttggataatcctgcagacaaaatgtaaaagtgcttgggaagacatgttgaatactgagcatgcaggtaatcgaaagaaaagttgaaatggatatattatgcctcctaaggtattaagcaatcatctgttttgttctaactcacgtatgccctatgtttcagtgaccttctgaaagataaaacatgtttacacgcttgaatagcgaaccatttgcatcttgcagctgcgctgaactggtttgaagatgtttgcagacagaattgtggtttgtaatgagctctttccacttgtagtcctttatggtggagaagaatgccaatcatagcatccactaaatgacccatttgaaagtgtttgtcctttttgttgatgaaaattatagcccaattcacttttttattgttcatctttgttggtgtgttgtcttctattaagccacctaatggattcacaaggactacttatactttattgtactctgtttattaaacaaatgtagaccgtatttatcaaaatattatctactatctaaccattttatgcagaactatttgctatcgcgcggcgtgcgccgcgctctcctttctagtatatatctatgtttctgttaattgcagcaagcatggctagcaaatgcctaacactagccaataaaatggatctatttttttttataaataaactcatcggtgtcaggttagaaaaaaaatcatgtcacgagtcacgacggcgaacaactttgtcgtttctaaacaagaaaccgtcaccgattagttatctgtgacggtaccccgagaaaggtgatcaagccttatcggtgacggtagctctcccgataaagatgagttttcacataactgatcactaatccgtgaccagaccgtccgcatccgtgaccagaccgtccgccaccacagatgaggattcacgcctgatacagatccgcactagtgaatattaatagatctttataaatacttagtttgaaaacataaaaaaggtagattaatcatgaaaagtattgttataaatttattaaattttattaactcatttaataaaccaacataggcatactgcgacaaggaagaagaaaaacggcattttttttattgaaacaaataaccaaaagagtgtgttccaatatgagaatatacatatagaacgaagttatccaacaacagataagaggctagatccaatttttcacttgacacctggtgtgttacatttcattgcaagggggtcctcgttgtcagctaccacttgatccatgccatgtctggtggttttttattcatatcaactagtgttcgagtttacactagcacgggatggctcatctgtaacgggcgggaagccacatctgtgtcgggatagggtaccgtcacgaacaaaaggtcactgatgtgaaaggtcatctgtatcgggccccttgctgtcacggattacagttatctttatcaggccaatgttaaaccccgtcaccgatgagttcgacctagcagaggagtcaaactagggcccgtcattgatgagtcatccgtgacgtgcgcgcacttgaaaccggcaaagatgattatgtcacctttgtcagtatagtatggtgaccatcacggatgactgatcggtaacggattctaaggtacactcgttgcctttggtattaattagtatcgggtttttttataacccgtcaccaatgagtaatttaccaaaaaaataaatattgtttttttcgctagcctcagtcctttactagctatgttcactgcaaaataagaaagaaacacatgtttatatatttccttcatcccagcaaacccacatcccaacatttttcacaaatccatcacatgccatctataaagccatacattcacaacagcatatatgtacattcacaacgtcaaattcatttgtatcagcgtcttcaagagctaagcatcaaaacctacaaaaccgagttataaatttgaacaaatttatatgtaattagcattgcaaatgtatacagagacatcacatcacatagtattacatataatacataatgttacataatctcatgttgacaagcattgacattgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttaccccccccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcaaggcgtgcgtcagatcgcctgtcgccacctaacccacgatctgaccggtctgtgactggtcacagaccggataaacgagtgcactgcactgcgttacatgcggcgtgacacgctcagccaaaccgcaataaatgtggttaggtgagccccactgtgctcacctaacccatacacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggagatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaatgagggggcgaaatagtgggcgcgagaagcgaggagccgggcacagcgttggcaaaagtataaaggcactgaggaagggatctgtttccttcctttcgccattattccccttgtcttcgccgcttgcgccctaactccttctttcctgtgccctaccttcgccacacgcgctcgctcttaattttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagcagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcgacgcgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgagagggggtcgtgcttctgggtcccgcgacaggggcccggggagcagccgccctgccgacgcccgggtgaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcacaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcggatcgcctacgggaagccgaggaggccgcccaggaggccgcccgggctcgccaggccgaggaaaccgctcgggaggaggccggatttcgccaggacgaggcgatggcgacttccgaggcagctcgcgacgaggccgcgggcgcgtcgcttgggcccactccctcaggcgacactcaggcgacaacttccggggcagctggcgacgaggccgcgggcgcgtcgcttgggcctactccctcgggcgacgctcaggaccaaccgggtccgggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcgaggccgccgtcaccatccgggaagcaacgctggtggcgcacgaggctgcctgcgccgaagaagagttcacgctccgcctccgcgaggacgcgctcaccgaacgggagcgagctctcgagggggccgaggccgcggcgcaacagctggcggtcaacctgtcactccgcgaggcagcgcaggaggagcaggcgcgccgcaatctggaaggtgcccgcgccgagagggccgtactgaaccaacgggccgctgagctcgaggcacgggcgaaggagctggacgcgagggcgcgcagcggcggggcggccacgggcgaaagcgacttagccgcccgcctcacagctaccgaacgcaccatcgccgatctgcagggcgcgctggactcgtccgccggggaggtcgaagccctccgcttggcaggcgaggtagggcctggcatgctttgggacgccatctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgtaggtccgggatgccgccgaccatatcgttgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattctttagttttttcttcttttctttcttctaaggccttcgggcctcttttttgtatatatcaacttaatctgtaatcaaaaatgaagaaatttttgtgttaatttcatcttgctgtgagtatgagatgaggatgatctgtgccgtggtccttttgtgtcttagcttgaataagggtttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcaccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaatggtcccaggatatcgagtccccagacagcaaatggccacgaaagtggtatggtctgcagggcctgggccggctgatggatttgcttggtgtggaattgacacgctctacatcgccggaccaggtcgactgcatcattaagagctgtcggccaatagaaaccctggcgaaaagctttaccaaccaaggtgcgcgaggcggagtgggctccgcattcgccttcatggatatcggcaagaagcacaacgccttgttctcgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccatctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggcggccttcccacagtggcttcggggccgtcctgggggtcgggggctcctggcgtcgtcggaaaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccctgctctcccccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgcgttcgccagccactccggatggatgacctcacggatgaatccggcttccagaagtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgttgcctcggggtggcgggggcggaagcgccaagcctctcgtcgccacccttgggcttggatgcagcggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcatcatccccggggccttgatggcgtcaaaggccgcaggggaaaggatgttgagggccgctcccccatcaatgaggacacgccccaacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtagaggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgggggccttctgcttggcctcacttcgccgattaccggaaggaaccgccggggatttgccctctcggcgctcctgcctcgtctcctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcccgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctgggcgtgctgccgtcgccgtagacgaggaggcgacgctccccatctcaccgcccttctccacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggacatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttaccccccccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcaaggcgtgcgtcagatcgcctgtcgccacctaacccacgatctgaccggtctgtgactggtcacagaccggataaacgagtgcactgcactgcgttacatgcggcgtgacacgctcagccaaaccgcaataaatgtggttaggtgagccccactgtgctcacctaacccatacacgcggagcaaaaacccacgaggggtcggggcgcctcggccctcggggccgagggggtgcggcccgaccccctcggggggactaagaggagggcgaacgcatcaccctcgggcccgacatccctcaggggtaccaggccacgtgtgcgattgtgtctgcctcaaacctctagtcatgatactcctgatcccatgtcaccgacagacataaatggagacgagcaatgacattaatctaaagcttcctttggaagatatgatttcttcaagtatgaaacatgctatcttctctctaatttctttgaagttgtgagatattttcttgtttgaatcagagattttttgagtgctaattcatccgactttatgtttatttaaagatcacccttttacaccgggtatgggtggttcaattgaaggaacacagtaccatacacaagaaacaatcttttactttttattctagttgtgcacttaacttgtatccctagtttaatagacttttgccattttgtgctagaagctgttagatcagccgtccaatttcgctgcgagatcgtgaaatctgtaaaattaaaggtgtttttgattgttattctgtgatgaataattggcattggagattattggttttgatatttggaatttatttttgcaaagtggttttggagatgattggatttcacaggtgatctaaaggtactgtgctggattgggtccggtcagaccgggtagtggctgccggtcagaccgggtagtggctgccggtcagaccggcgtgtattgcacggtcagaccagtgcagcccgcggtctgaccggccgactctgtgtcggtttcggttttgggttgtttatttggatatatgtgattgtttcatgattatggcttttagatggatactatgcgtatgtaatactgtcgtttgctactaatgagtcaagttggggatagcttggtctcggaatatggtttctttgtttgttctatgtataggtgacttgagatgccgggagagtatttgcggtgatggatcgggagttggcttggggataagacgacgtccagggtggtcagagatcatgcgggatactaaggctagagttcaatgcacgtggttggtgaagtttccatatggcatacgatggaggtattgtgtgcgtatgggatgcggagtcgaaattggaaggagtccaaatttgttatgagtggttatgtaaagtttgtttcttgtacgagaaggtttcctagggtgattaggacttctagtatgagtttggttcatggctttaggttgcctacctcgggtataaatagagagggagagtggggcttcctggtatcgcttttgagagcaattgaattgatagttgagttagggtttcgagtttagtcgagatttttgtaaggagtgttgtttgtgcactttgtaagcacagagagaatcaataaagtcgtcatccactttaagagttcttcgatttatgtttcaccgggtttcggcggtctaaccggcagcatcgcggcggtcagaccggcggcggcgacagtcgacagcaggcaatctcgacggttcaaccgaagtttaatctcggtcagaccgacgatcttcaggtggtcaaaccggcttgtacacttcggtcagaccgcgatccatcgaatttgagggtaacttttatttccgctaaaaattttggtttttgggtataccaactattcacccctcctttggttggcttaattattgtgtttcgatcctacaaaatcatttatatgtttgtctactaaaaaggtatttacctataatttgatcaatattgactccgctaactgatttttgtcctctttccacttaggtaacgggcaatccaagattgaagtgtctattttaacatctcccttatcactagaattgagagtaaaagtgcaaaaatcctaccgtaaattgtttcattttgttgtattaggcatgtgtttaacttataagcgcgctaaaatgtttcaatagaagatgatgtatccatcgacaaaggcatcgatgatgacttcatcaatcctaagatatgttggcacagtcttcaaaagtacttagtgtaactgtgtgtgtttacaagatgatgaacgttgcacgtatacctgagtatctccatccatactactccctccatctacttttgatagtcatattttatcttggcacacagatcaatgataagtgattctacttatcatccatttaaacatgctactagtcattcctcgtaaacaagcgattcattaatatttacatttctcgatgtccatgtagccaatcttgtgtggaagaatggagagtcacgcattaaatccaagaaagtcattaagatgataagttgttggattgaaatatgcctatcataaataaattttttagatttggaaatatgactatcaaaagtagatggagggagtatgttagaaaaaaaataccaggacatctcgtactagagtagaatctccgagatggaaacagtgaagcaaatactcttacataaactttttcgtaacatagggccaacatatgtatgtgaccacatgactaaaaggccatccacaatgcacatacatgacgtgtgacattgttggtccacatagagaaatcgcttgcgtagaggggagagagtggactgggggcctaggggccatgccttcaccgggttcacgtgaccaaagttgatcatggtggccttgcagcagtttatcagaaaaggggaggaaagtaggagaaagagaagggggagaatggtgtccgactggagcttgccgccatcagcatcagatcgagaggagaagcttgctagagaggggtgcggaggtggtgaagcggcggcaagccagaccctaacgatagtgccctcgccgtcccatacctcctaatccacaccgtcaagctcctgccagcttcgatccacaccgtagaagcttgccaaagaggggagaggagtaggggcgccgacgccaccagatccgccccaagctcgccgtcccatccagcggcgaggacaggatctcgacgatagtggttggtacggaggaggtggtgtcgagattgtcggcgtgctcgccaaggacgaagggttgccgatcaggggaggagaggaggggtggtgcgctagcgagcagcaggctagatctggccaccccgccgccgtcgcctgatactccgctttcgccaccccgccgctgctccgcctggcgtcgttgccgtcgccgcttgggatgcctcgccaccacgccactcatcaccatcgctgtcgtcgcttgggacacttttgccctaggccaaagctggcaccgtcaccccctcgatttctccacacgacgccttggctcgctcggccggtgaggaaagatatagagtcgcagacatgagagagagagagagggggagagacaggagagagattgaaagtaaaagaggtgggatataccagaagtaacctgcactgtcaagcatgcacagtttcaggggcttgggtctactctagcgtaacctaagactcaaaaaatgcaaaaatgctctcggtcgtgcaaccggcgcggggggagccagatcgggcgctccccccgcacgcccctccttccacgtggacccacccatttctctctccctttttttcacaaaagatgtttcacctaatctatctataatgtttcgctatttatagatctaatgttacagtgaattaaaatactcatttgcaacaaaaatcccacatattttggaaattctctattaaggaaatttggtttattttttgttctagtatactcacaatgttttactatgtatagatctagtgttgcagtaaacgaaatattctagtgcaacaaaaaacccacatattttggaaacccctattaagggaattcgttttattttttgtgccaccaaaaaatgtttcacctagtgtacttataatgtttcactatgtatggattaaatattgcaatgaactgaaataattttttgctatttactgaaccattgtttttatataagatgaaacaacacccaatttaaacaagtgaaacatttttgatcaacctagtgaaacaattctaatatacctggtggaacatcgtgcaaaatttaaaaataattcaataataagctaattttttttcgtcggaatacatccatgtgcggtcttgttttgaaaatttaattataatgaatttaatggtgcaatcggatcatgatttgaataagtaatttaagagaaaaatcagtttaaaatagttttgtacgtaaatcgggcgcgacgtcatgctgacgttagcgtccgattttttcccacctaccatcgggcacctgatttgtagggggatcccaaaaaatgctgtacatttgttccctcaaaaaaaagaaaaaattgcgatacatctgcactgctatcgcctaaacgtcggagacgctctcggatctcaatccctcggtaattagctctgtggaaatacttgtagagattcttatccattcagcaggcagaccaacaccttttggtctttaaaggacgacgtatgtcacttgtcacgtctaccttttgagcaaagagtgtggtaggactcccttttccctttttgacagaatcatgtgctatctcgttaattatctgctcttttagctaagctaccctcctgtttgaaaaatccttggtgtaatgatgctgaatccaatcattcgctttctaaaaggaagcagctcataggtagattagattgcacgtaccacggcttttcagatgggcattgcaccttgtgaaattaatcattaatcctgaagaacacaaatgatcgcaatgtttatcaatggggcatccaattgtcaccgaacttaccaccaaacctcttaacatcgattggttgatgcatgcatgtacacacttctcctgtagactttgagaaacaaaattaaatttaaaacttttttttaataatgaaatggttttaaacttctatgagggtataacataaaaattctacatcctaaccaaagataaaagaatggaacggtagaatgattattgctccttcagttttcgagtaacttatacgcttgaacctatttccaaaaagtacttggcatttcatgattctggatatatcttttcccaatttatcatgccattatccttattttttttcctcatcattcgtgtgctagattattccgaggtactttggttgttttagattagtcataagctatatttatatcgtcatatttttataaaacagttagattagcgccatatttttataaaacacttagattagacttttgcacaatgtaaattacaaaacttccattgtaatttgaaaatttacactgttgatttacaaaatttaaacagaacacactgtacgagagaattaaaataaaaataactattacctgtttaaagagatggtatttacttacataaaggagttgtcctctccaatgctacaggccaaattatccgaactaatctggaccgtccatccgcacgcaagttttctccaccccaagatttcacagctgaggattccacgcgcgaagacatcgctcctcctccacccgcggccgcggagaccgcgcgcttctcttcctcgttcactcctccccgcgtcctcgcaggagcgactccccgctgccgccgttcctccgcgtcctcgccggagccaccgtggccgtcctcctcgctcgctcctcctactccccgctgccaccggtacgccgcggccgtcctccttcttccccaccgccacgccccgctgccggcgctacgccgcgtcctcgccggagacgcggccagatcgtgcttctcccactcggatccgccaccggagccgacttcggtcccttctgcatcgccgtccgcctcctcccatcgctgccccccctccccatcctcccgcccccgggggccttcttgttcgctcgcgctgccataagttcttccgcatcaatcaacgtcctggtggagcttcctttccaccggcgcagtcgccccgtcacgtccttgtgatcctgccttccactggctccctgccacgcctcttgtggccgcgacagttaaggggtagagtctgcccatatcaagcagctccgatgcttccagggcgccggtcctccctggacgctggtcctctcttgtgcaggttagattgattcatctgaaaattactctgtgattccccttttaagctcattaatcccctatatgaaaatttctcctcttttcattctcgatccattgtacagcttgatgaaagttaattattgatcatcaccactacagagaatatcttattctgttgaaaattaacagaattttgcttttttaaagatgctgatttgaacttattgatagtgagctgattgcataggggaatcactcgcgtctagcaatatcttgccctgtcggtgtcttcgtcctccattccacatgggtttacttcaatggactggacaatatacaagaataattgcatatctacaccgcaagtctttataatgataggtaattagtcaccaactttcgcctgacttgctaatacaagtttatatagtgctcatacagatcagtagaacattggttttattttgcagtgataaggcaactgatctacttttgtagtactataatagaacttttgacacaatcattgtaatgcgtatgcatgacaaacccgtttgctgttggcaggctgtcatttttttatttaaagcatatatgaccattgtatgattcattgtacggatattgtgggtatttactggctgcaaaatgtattaggggaaggactgcgttttgacatctctaatttaagtgcgctggaatattaagaagcaaatgcgatagagattttggttacaagcttatggtttgaggtaatgctaatttacttgtttttgtccagctaatgctaattcacttcttttcatctctcagggagcatcccacaagttggttgttgacatcatccaaaaccgtggagacaaattagagcccattatttgtagtttcttgtgttccatgcaatttcaacaacgatatgccggtttttctcatgacgcactcaggtagctgtgaaaatgatagccaaagatcttatttgtacacaacatcataccacaaagatctaccaacttaaatctcagcttcaaggagcttttctaagagtgttgagataactgtgcatttgttctgccgctttcttgctaaatgctaattattgctatttatacaatgtgtgcatgcctcgtcaactagcagtgtcttccatgctgaccaagcgatgtgttttacatggtctatgaatctactgtgcattataaggaaaaacgtgaaagtctaagttttttgccgtcagtacatgattttgacttcattaagttgtactaagcagtagtagcaacatggtcaggttgggatcaatcttttacttaagatgctgtagctgctagatatgcgatgcaatgggctgaaatccctgacttatttaatttcaacacaagctatgcattaattcgattatgatggactttgagcaccaaaatttagagatggagatgatgagtgatgtcatggggatgctacagatgatgctttggatggagacgtggaagaagagaaactgatatatgtttctgtttgtgaaatgaatattttgacttatgccatcgatcaatgcatggttatgctagatgatgcactttagaaagattcaagctgttgctctttgtgcacagctcttttactacctgttaggaatatattttcctttcataccatttgcttctacattttcagggtttttggcatgaccaatggtgtcaagcagggactacgccatcaacatattaatttccaatgtgattatgactctgcaacatgtactttcttactattttccctgaatgtgtgagattttgtagtcactgagttgcacatttcccctatcattttgtttaagctacagtagtgtaaaaaattttatttgttctcaggcatgcttcctgctcaccaatcaagctggtgcttgtttcaggaaacataggaaagagagaagcatatgtgattgctaaacaatttcaccccatcgatggtactaaaatcaatggcttaggatggatgatggtaacaacaaagcaaatggccaagtcttttgatgtttcatcatttatagaggtactcacaaggtaagttaagttaatgtgcaaaatgtgaccaaatttgtgttaatcatgtattctttttccagttttgtcagatattactgcatttcatctcagtcgataatgtgaataatgagaaccatttgatgatgaaatcttgaatattattaacagaaagttatggttgatccatcaatttatgatttatcatcacactaaattaggtgagcatagttgggattttttttcttggcatgaattctgctcgcaaagaatctcaaatgtatcatctcagtttctaaaaaaaaattatataaaccattattcgtccatgcttattagagttcaacttatgcacatgcatatacaaaaattatgtttttcaaatttctgaaccaatgattctgacaaataattttgttgcatgcaggaccatctactttgcaactatgaagaatacaaatttgaaaaaaaaaaggattgggtacaaatgctgattacctgaatgccatgtggaatagcctaagaagcagggggttggtgctcctcaagttgtgcaatgttgattacctcatctttctattttttatcatagcagacttacttagagaagggatgctagagaaattgcaaaatatcatgaaatacgcagttggctcttagagaatgatagttcaaatttgtgctacctaagactgacggtaattttttagtagcacaggatctggatattaggtggtatatactacgtactataccgcagcatggaaacattagagaacttttagacaatctatgtctttgcttgttataaactttttttttgtttctacacatgtcaataataacggtgagaattgatctggcaccggacatggtatattgaatttgtttcaaacactattcaagtagtctttagtgtactcctatattgttctatgacttactgatagatgggtatccaattgtaaattacaaactaaattattgagcatatgatgtacgcagtattcaggttatgagcattatggtgaagaaaatttgtaacttcaaacatcctaaacttttattttacttgttttgaacaagtttacttgtcacgagctccggcgtaagaacgtatgggatatgaatgtgtgattggcggacgtggacgagggagtttggaggaacagcgacccgtgatgaacagcaagggatgagcaaatagagaataggagatgagagaattagaaattgaatctgcttgattaactcctccgaattgtgcctctaaataggcttacaactaattaactaaattactaaaaacaagctaacaaactgataaggaaactagctaacagaacctatcctatcacaatactgttgccgtccggcacggcggattacgcgcgctgcgctgcatctcctgacgccgcatcctgctgccctgtgcagcttctgcgttgatacgttatcccgaccatgacatctctcccgtccttcggaaacagctcgtcctcgagctgaaatgccggataccgtcgccggaactccgcctcattctcccacgacgcttccgatgctgccttcccttcccaatgtatgagcacttcccagacgccacgcgcgattctgccacggactgccttcacaggaacaggcaggacgcgcccataggccattgccggcaacgctggcacaatctccggcggctctccatggaatttcttgagaacaccaacatggaacacatcgtggatgcgtgttcctgctggcaattgcagcctgcacgctacttctccaattcgttccatcaccttgtatggcccatagtaacggggcgacagcttgcctttggagaagcctggaagtgatgctgcttggcgttgcaacagtcgaacccagacccagtcaccaacaccatacgccacatcccggtgtttgtcatcataaaagagtttggcgtagtcctatgcttgcagcaatcgttcgcgaacctcgttcaggaacgtgtcgcgttccgtgagtgcttgctcaacggcgtgcacccgtgctgtcccacgatcataagcgcgcaaggcgggcggcggccagccataaaccacctgaaacggcgtcgtgcggagggatgattgaaacgccgtgttgaagcaatattcctcccacggtagccatcgcagccattagcgagggcgatcgcccgtcaggcagcgcaggtacatgccgatcacccggttggccgcctccgattggccgtccctctgagggtgaaacgccgagctcatggtgagcttgaccccggcaaggcgaaacagttccgtccagaacgcgctggtgaagacggggtctctgtcgctgacgatggagagcggtatgccgtggaggcgaaccacctcgttgaagaagacgtgagcgacggacgttgccgtatacgggtggcccaacggaaggaagtgcgcgtacttggactggcggtcgacgacggtgaggatcaccgacttgccgttgacgcgcggcagcccctcctcaaaatccatggagatatcttcccacacccgcgtcggcaccggtagaggttgaagcagaccggccagatgaaggtgttcgaccttatttctttgacagatcgtgcatgcatgcacgtggtcctggacgacttgcttggtgttgggcacggtgaagtcggcacacaggcggtgcagagtgcgttccacgccctcgtgccctgtgtgagccacgtccagcagtgccggcaaggatggcgatctcgcggcaacgaacacgcggccctgtttggtgaggaggccgtccgtgaatgcccagggcgcgcccagctcgccggcggcaattttgtcccgaagcgcgacgagggatgagtcggtcgcgacctcgcgacgcaaatcgtcgaacacagagaacgccggtcctgtgagtgccatgagtgtgggtgccatgtcctcgtcgcggcgcgacaaggcgtcagccaccacgttgttccggcccgggcggaattcgacggtgaagtcgaagcccatcaacttgctaacccaacggtgctgaggaatagtggacaggcgctggtcgaggaggtacttgaggctataatgatccgtacgaacgacgaactgtcgtccctacaggtacgcacgccagtggcgcacggcttgaaccaacccaatgagttcccgttcgtaggcagtgaggctggcgtgtcgcggcgcgagtggccgggtgaagaaggtcagtgcgccggcgccttggtggagcactgcaccgatgcccgagccagaggcgtcgcactccacggtgaatgtcctggcgaagtctggaagttgcaagaccggggcagaggagagcgccgccttgagcgccgcgaaagctgcgtccgcttctagcgaccaccggaaggcctcccgcttgagaagggccgtcagtggggcggcgatggtgccgtaattcttgatgaacttgcggtagtagccggtgtgccccagaaagctgcggacggctcggacggagcgcggcgtcggccacgcaccaatggcctggaccttgagttcatccatggctactccttcggcggagacggtgtgccccaagtattagacttggcgctcgccgaaacggcacttggagtgtttgagcaccagcttgttgttgtggatggcgcgaaggacagcttgcacgtgttgcagatgttcggcccatgtcgcactgtagatcaaaatgtcgtcaaaaaatacgaggacgaatcgacgcaagaagggagcgagcaccgagttcatcagggcctggaatgtcgccggcgtgttcgtgagtccgaacggcataaccaagaattcgaagtggccttgatgagtgcggaacgccgtcttgtggatgtcggcgtcgtgcatgcggacctggtgatagcccgagcgaaggtccagcttggtgaagaatcgagcaccacggagttcgtcgaggagttcgtcgacgatgggtattgggaacttgtccttggcggtggcggcgtttagagcacggtagtcgacgcaaaatctctaggaggcgtcctgcttgcggaccaacagtaccggcgaggagaatggcgaggtactaggacggatgatcccctggcgtaacattgccacgcactatttctccagctcgtccttctgcagctgcgggtagcggtacggccggaccgccaccggcgatgcatccggcttcaagtggatgcggtgatcgatcggccgcgcgggaggcagtccctgcggctccgcgaagatgtcggcgaagtcgtcaagtaggcggggtaggaggtcctctgtttccagcatctcacaatggggcggccggcggttggcgaggccgtgaagggtgacctcgcgcgtactgcgccaaattgacatgcgcatattccggaagtcccacaaaattggccccaacgtgctgagccactcggtgccgaggatgatgtcgacggtggagatgtcgagtgcgaagcaatcgactgtgaacagcttcccttcaatgcgaagacggaggttggcgcaccggcctggactgaccagacgatcgccgttcgccacgacgacatagagatcatggcgcactggagacagatggaggcacaggtgacgcgccagctcggtatggatgaagttgtgtgtcgacccagagtccacgagtgcgaccacgcgctcgccggcaatctcaacgggcaggcgcatcgtgttggccccgtccaacccggcgagaacgttgagcgacacacgcggctcgtcgggggccggctccatgtccccttcgacgttgtcgtcatattcgatgtagaacagacgagcgcatttgtgcccgcgcacaaatttctcgtcacagttgtagcacagcccttggcaccgacgttccgcgagttccgccggtgagaggcgacgaaattgtcggggcgcttgctcctgtgagccctcggtggtcgcggctggcgctgttggcagattggcagcagccggtccgctccggaacggtgcgcggagtgccggacgcgtgccgctggccagccgtgacgccttccgttcgtaggccctggcaagccccatggcttcctgcaggtcatccggctgatgcaactcgacgtcgatggccaattcctcgcgtaggccagctgtgaagagttgtatttgctgcgaatccatgagtggctccgtcgtccggctagccaatgccagaaacttcgtctgatatgctgccaccgaagatgtctgggacagccgcttcaactcacccagagaattacggtgaattggtggcccgaactgagcatggcacaggtccttgaaagcggaccaatcgaggtccgtgatgttgctcgtagtgaaaataccactcttgagcgtcgccggttagatggtaggtggccaaccatacgcgatcaccatctagcgtcttctgtccccgaaaaaattgttcacaatggttgaaccaattgaggggatcttccttgctatcatatttaggaaattccagcttataaaagcgaggaacacccgtgcctgcattggtgtccgaggacaaggacgtgcgatgctgcggcggcggcggcggcggaggcggcggaggtggtggcggtggtggtggtggtggtcgccagaacattccgtcgccaccgagtcgtggcagagttgaggtcgacgtggcgccctgctgctccaacgatgtaaggcgagatgaggcgacggcaaccgaatggctgagatccgccaagtcacttttggatgcgaggagcgacatgccatggagtatgtcggccatggactcacggagcttggcgatgtcggcattggagaccggagctgcggccgtagctgcggctgtggcggtggctacgttggtggaggattcgtccgttgccatgagctctgataccaagttgtcacgagctccggcataagaacgtatgggatatgaatgtgtgattggcggacgtggacgagggagtttggaggaacggcgacccgtgatgaacagcaagggatgaacaaatagagaataggagatgagagaattagaaattgaatctgcttgattaacttctccgaattgtgcctctaaataggcttacaactgattaaccaaattactaaaaacaagctaacaaactgataagaaaactggctaacagaacctatcctatcgcaatactgttgtcgtccggcacggcggattacgcgcgctgcgctgcatctcctgacgctgcatcctgctgccctgtgcagcttctgcgttgatacgttatcccgaccatgacattacttttgtttgtttgttatatatatatatatatatagagagagacatacacactagcaaaatgcccgtgcattgcacaggttaatgacaaggtggataaagtttgacctcaataatacatcaaagaatgtaagtatgatcagattgcgagatggataaggttttatctcaatgattttatcaaagtacatgtatgatcataagaaccagcgatgcgcacagttatcacaaagaaatatttgtgtttggacatttagtctattctacacatgtaggatatgaatgattgtcctgaccaatggtgacgatgattgtagcattggagaaatggatggcttgaataacacacctttgcatagaagacgatgatgaaatattatgaggacattaattattttaaattatatttttatattcgcaatgtaatgccctgaccgactaaatctaaatagtgccaccggacctaaccgttccttttttttttcttttctagaaaacctctctgagtataagtctttagcgcataattagttaacttttaattattatcttaactaactaaaagattcgtatttttctaatcgtcacatcttttcaccccacgtgttttttcgtccgtaacctcttttttttccgtcatcgcatccttttcactccatgtttttccgtttttcccaccgcagccgatttctattatgcgatttgtttgttgtgtccaactcggttccagaaaaaaaagttgagcaaaaaaactagatcaaaatcaaagaacgatgtctacatcaatgaaacaacaacatacataattcacaacacttgactcccctgccgccggatccgccctcggccgtcaccaccgctgccggatccatccgcgcccgccgctgacgctgccaccgccgccggaggaagaagagaggcagcggacagtcatcaatcatccgtcgattggcctgaggttgctcgctgattcgctaaatgtgtttcttatacggatatgtatttccaaaatcgaacaaacttaaaaaccgattcaaatacggatatatatttccaaagcgaacgaatataaaaccgactcatacacggatgatgtaccaaaataccggtaaaaacatcttcaatttttatagtagtagcctagtagagagtataatttattatgagctactatatttctctctatcatttgagacttttttctagcgagcaaaagtaccaaagcagtgtgaaaataactttggttaaaaacaaataattttagtcttaatacaccgtagcgaagcacgagcattttgctagtaaacttaaaaatagatttattagatatttcaaaacaaattttctatagaaagtttgaaaagcgtggtgacaaaaatcgagataaaaggaacggagatattgtgtgaagtttcacaccatgcacatattcagtttccatgttttttaaaaattaccagtcgaattttcttttcccagtaaaacacacactgtattctgtttccatgttttttaaaaataccggtcagtttttttcctagtaaaaaaatcaataatgatatgtttttttcctagtcaacccgatcgagatcccatcccgtttagatcgggatcaggtcgatcccctttcctctcctctttcctgtcctcgtttcctctcctttctcatcgtagctttttccttatcggcnatnggngcttccccctcaacctcaccctccacccctcctttctcatcgtagctttctccctctcggccatcggcgcctccccctcaacttcaccggcgcttccccctcaacctcaccctccactcgtgccacctccctgcctcaaccacgacgtccgacgtgctgcccccaactccaccttggcctccgccttgggccacctccctgagtcgactgcatcctccatcagcgtcgccgccaactcaacctcagccttcttcgggcggccatgaaggcaatggccaaggcggcagtgcccgcgatggcgttggcgaaggtgcccatgccggtgacagccccgcgacagctgcgacggccaaggcgtgcaggcggccacgatactggtaaccagtggtaggcgtgtggccgccgaatccgccggtgggaaggctcaaggccgacggtggggctggtgggcagtgaattcggtgttggaaggcgcgcagactgtggcaagaatggtggccgncggggaaggtggccgcccggtgccgaggctggtggccgncggatctggtggtgaggaaggctcaagggcgtgtatccggcgtcttagttctagccgacttccaagcatacttcatcccgcctcccgaagttaccgccgtcgcctacttcctcgacatcgccgctcgtgggagccgccgctgcgaggaattgcctcatggtttgtcgccttcgtcgatttcctggctccctcaacacccggacacccaagcgccttgccggtgagggccgccgccaagcttccgccgcttgccgaggccgtgcactgccacttggagcttgacaccgcaagtcaaagccatcccccgaaatcaggttggatctcatctcatctcaccaattgctccgtagcaatcttgtggaatcctagttgtatttatggggttgatttcatccgttcttgagtccaaatcgaatccgctatgtctttcgtgttgaacttggtatccgcccttctgtttttgtttttgtttttgatttggattgtgatggtttgagattttggagagaatgtggtattctatttgtgtaatannnnnnnnnnnnnnnnnnnnnnnnnnnnnnnnnnnnnnnnnnnnnnnnnnnnnnnnnnnnnnnnnnnnnnnnnnnnnnnnnnnnnnggcgccatgccgtaattcgcccttcgtgagtggaaatctaccgcccat

SEQ ID NO: 39 - DNA, 744 bp, Oryza sativa
  unsure (1)..(744): unsure at all n locations
ctgtcatgtcctactantggtacagtagttcatcaaagttcacccgctacgcgcggaagttggcggatccaccggaggtgaccggttcgtccatgtgacctaacgggcacatgtgccccggccatacaccgataattggcttggactgacggagcatcattcccggggccttgatggcgtcaaaagccgcaagggaaaggatgttgagggccgctcccccatcaatgaggacaccccccaacttcacgttgcaaaccgtgggagaaaccaccatctcaatctgccctccccgggcaacgcacggtgggtggtcggtctggtcgaaggtgagggcaatcttcgaccaccgtgcccgacacgtcgcctcatgagtagaggccgcggccagaagctctcgcttgatggccttgaagcttcggcgagaaacgtgagcacacgctcccccatagacggtggcaatggaggacccaggctcttggaaacctaggtcatcatcgtcgtcatcgatgtcctcggcgggggccttgtgcttggcctgacttcgacgattaccagaaggaaccgccggtgatttgccctctcggcgctcctgtctcgggttctgctaccacttgctcgtccgctcaggcaaacttttgactgcacgggacttcgcgaggtcgtgaaggggaattgtgtggactgtgcaccacttgnccggtttgcgctacctgttgggagcgcctgtctcgttctttgtgcctt

SEQ ID NO: 40 - DNA, 875 bp, Oryza sativa
gtggcattgatgagtgactcgcgctctactgcaagtagttcatcaaactgatttgatcctgcaatcagcaagaaagagaaaagcagagttagtcagccgatagccgatcggccgatagcgtatcgttggtggtctctaccgatggagttagaccaaatcggctatagactggatatattaaagaatattaaaccctaaatatgcctcattggttgtaacattgtctatcaagattgataaagaagcttaagataatattattaaaatagccgatgtaacaatatttagtgtaagaaagataatatactggctaatactctagtacagatctatataggcaaatcaatctatagtaatataccaaatagaggtcaatagtcaatgttgatagcccagccgatatgacctctacttgatatattactataaagtgatctgtctatatagatggcaaatatacatgaaacagataaagaagcatgtatattaggtaagagcggctgaaaccctgatgttatccctgttagaaatcaagaagcagggtagagatcaacacgacttagtaggtcgaatgtactaatgcaacactaagtatgaaaagaaacacaatgtctagacaatcaagccgtgattgattttcaaggtggtatatgtctaagctaatctaatctagcaagacgatttagccgataacggcagaaaccctaaagcgagaagcagccgatagagctaaatcgatttgtttaaactagattaacatagacatatgatatcgatggtcatgatacaaggacttagatatctaaacgacataatagcccccatagcataggccatcgagatgaagtacctctttgcgagcgaactcgtcgaat

SEQ ID NO: 41 - DNA, 869 bp, Oryza sativa
  unsure (1)..(869): unsure at all n locations
cgtgtgaggtannnnnnnnnnnnnnnnnnnnnnnnnnnnnngccgctcgtgggagccgccgctgcgaggaattgcctcatggtttgtcgccttcgtcgatttcctggctccctcaacacccggacacccaagcgccttgccggtgagggccgccgccaagcttccgccgcttgccgaggccgtgcactgccacttggagcttgacaccgcaagtcaaagccatcccccgaaatcaggttggatctcatctcatctcaccaattgctccgtagcaatcttgtggaatcctagttgtatttatggggttgatttcatccgttcttgagtccaaatcgaatccgctatgtctttcgtgttgaacttggtatccgcccttctgtttttgtttttgtttttgatttggattgtgatggtttgagattttggagagaatgtgggattctatttgtgtgatatggaattccgactaggatttggggggcggggtgtgacgggacgaaaaatcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaagtactgtaccactgagaggtgcatgcataacact

SEQ ID NO: 42 - DNA, 1042 bp, Oryza sativa
  unsure (1)..(1042): unsure at all n locations
naggccaattaaactaaagtttgtggtatcgaagtcccatttttccgggtatcgattaatgtggctgtttgtcttcttaacctctcctttttccccatagaagggtaaaaaaggaagcttcggtaacagctacccctagcagcccatgtccgcctgttcacctaggctcccccgctgctgtgcgtactacagcggtttacactagccatcttccccttggtgggtccctcctgtcaatctgttttttgtctcgtgttgctgcagctcccgctagaaatgttgcatgtgctgctacgtctcctcccgatctcccgttgttccgctttgtgcgttcctaaggcttcctgtgctatcggcagcacctgcttgttgctgcacaattccagcaagaagtaaccaacggaatattagcttggaaagagagaagtttgcgggtttggttggatattgcccaattttttgtttttctcacaaaattatttgttctatataaacggtttatagcctgggtttgtcccatgtgagaaggggtgtagaataggttcgaaatatatatatatatatatatatatatatatatatatatatatatatatatatatatatatatatatatatgtaaattaactggtgctacatggagtatgggctccaagattcaaattgcgtatatacccaatttgaatgtttaaatgttttttttaaatgtttagatatgaatattaacttctttactaacaagttcaaacaagtttgaactgagtttgaacttttttttttagattttggttctagatatataacatctaaacatataattcgttatgtatgtaataatgaattgtgaaatgaagttgagtttgagttgttttgttgttaggtatttgtatgaattaaattcatatacctagatatctacttacaatttgtaaatttttaaaaatttgagagaatttgtgttttttataccttagagcccggacaccataaagtcccctatgnnnnnnnnnnnnnnnnnnnnnnnggagtctatcatggccac

SEQ ID NO: 43 - DNA, 1703 bp, Oryza sativa
  unsure (1)..(1703): unsure at all n locations
agttggcgcgcgcgattccacgaaggtaatttttttttccctatattgccccagccaccatttcatttatgctcagaaaatcttgttttggggtgttgttgacccttttcactccagttgaaaaccttcggcccccccctatgcccataattggtagtatatttccaaaggttcgcggcgtgattcacgaaacattatttttgccacgaatgcacgcaacaccctccaatatgtccaaaaataatgtttggggctttttcaactttttcattccagtctaaaccatcgcacccacttatggcaatatgggcattacttcacaaaagttcgccgcgcgaatcacgaagtgagtttttgccacgaacgcacccaacacacaccaatatgtccaaaaatcatgttttggtgctttttggactttttcattccgttgaaaaacaacgcacccacgtgtgccaatatatggcaatattgacattaattgacaaaagttcgccgcgcgaatcacgaagtaattttttgccacgaacgcacccaacacactccaatatgtccaaaaatcatgttttggtgctttttgaactttttcattccggtgaaaaacatcgcacccacctatggcaatattggcagtaattgacaaaagtttgccgcgcgaatcacgaagtgattttttgccacgaacgcacccaacacactccaatatgtccagaaatcatgttttggtgctttttgaactttttcattccggtgaaaagcatcgcacacacgtgtgccaatatatggcaatattggcattaattgacaaaagttcgccacgcgaatcacgaagtgattttttgccacgaacgcacccaacacactccaatatgtccaaaaatcatgttttggtgctttttgaactttttcattccggtgaaaaacatcgcacccacctatggcaatattggcagtgattgacaaaagttcgccgcgcgaatcacgaagtgatttttttccacgaatgcaccaaccacactccaatatgtccaaaaatcatgttttggtgctttttgaactttttcattccggtgaaaagcatcgccaacacgtgtgccaatatatggcaatattggcattaattgacaaaagttccccgcgcgaatcacgaagtgactttttgccacgaatgcacccaacacactccaatatgtccaaaaatcatgttttggtgcttgttgaactttttcattccggtgaaaaacatcgcacccacctatgccaatattggcagtaattgacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgnngtncggcggtaggcatgntcatatcaaggcgcg

SEQ ID NO: 44 - DNA, 1034 bp, Oryza sativa
  unsure (1)..(1034): unsure at all n locations
cgccccttgaatttgatgtcacctgcacagactcatactgccatattggcataggtgggtgcgatgtttttcaccggaatgaaaaagttcaaaaagcaccaaaacatgatttctggacatatcggagtgtgttgggtgcgttcgtggcaaaaaatcacttcgtgattcgcgtggcgaacttttgtcaattaatgccaatattgccatatattggcacacgtgtgtgcgatgcttttcaccggaatgaaaaagttcaaaaagcaccaaaacatgatttctggacatattggagtgtgttgggtgcgttcgtggcaaaaaatcacttcgtgattcgcgcggcaaacttttgtcaattactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattcacacgtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattggcacacgtgggtgcgatgttttagaccggaatgaaaaagttcaaaaagcaccaaaacatgatttttggacatattggagtgtgttgggtgcattcgtggcaaaatatcacttcgtgattcacgcggcaaacttttggcaattactgccaatattggcatatgtgggtgcgatgtttttcaccggaatggaaaagttcaacaagcaccaaaacatgaattttggacatattgcagtgtgttgggagcattcgtggcaaaaaagcacttcgtgaattgcgcggggacctttgtcaaataatgccaatattgccatatattggaacacgtggtggcgattn

SEQ ID NO: 45 - DNA, 1473 bp, Oryza sativa
  unsure (1)..(1473): unsure at all n locations
gagcacattgaanttcgatgtccantggtacagtagctcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaagtctaatttcaaatggatccagccacatgtccatatctgttctggagcggccgcaattgtcattttactcccgactattttctgtccatggtgctgcgtcatctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgtcctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgcacccaacacactccaatatgtccaaaaatcatgttttggtgttttttgaactttttcattccagtctaaaacatcgcacccacctattggcaatattggcaataattacaaaaagttcgccgcgcgaatcacgaagtgattttttaccacgaatgcaccaaccacactccaatatgtccaaaaatcatgttttggtgcttttcaaactttttcattccggtgaaaaacatcgcacccacgtgtgccaatatatggcagtattggcattaattgacaaaagttcgccgcgcgaatcacggagtgattttttaccacgaatgcacccaacacactccaatatgttcaaaaatcatgttttggtgctttttgaactttttcattccggtgaaaaacatcgcacccacctataccaataatggcagtaatagacaaaagttcgccgcgcgaatcacgaagtgatattttgccacgaacgcacccaacacactcctgatgnggtactgcgatagtcagcnctcatggatca

SEQ ID NO: 46 - DNA, 1655 bp, Oryza sativa
  unsure (1)..(1655): unsure at all n locations
aaaaaatccatttcgtgattcgcgcggcggaactttggtcaattaatgtcaatattgccatatattggcacacgtggggcgatgtttttcaccgaataaaaagttcaaaaagccccaaacatatttttgacatattgaagtgtgttgggtgcgttcgtggcaaaaatcacttcgtgattcgcgcgacgaacttttgtaaattaatgccaatattgccataggtgggtgcgatgttttagactggaatgaaaaagttcaaaaaacaccaaaacatgatttttgaacatattggagtgtgttgggtgcatgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcacccgggccacgaggacactcgtcctgcaagcaatcgaagaacaagcaagaacaagtaggtcaagcactgaaattgctagataaagatgaaagtttcactatcaaacacaatatggtggggttccgattacaggcagacgggcggtttagccaacacgcgcgctgcgagccggtagcaagaagctatctctatcatcaaaacccgcctgttcttggcggcgactagaggtataaaaagaggggaagaacgaccatagggtcgtgctccaaccctaggacgcgcccctaatgggcccaacatggatacacagcccattgggccaaaagagatgacgcagcaccatggacagaaaatagtcgggagtaaaatgacaattgcggccgctccagaacagatatggacatgtggctggatccatttgaaattagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcagtgcattcgtgtcaaaatatcacttcgtgattcgcgcggcgaacttttgtcaattactaccaatattggcataggtggttgcgatgtttttcaccggaatgaaaaagttcaaaaagcaccaaaacatgatttttggacatattggagtgtgttgggtgcattcgtggcaaaatatcacttcgtgattcgcgcggcgaacttttgtcaattactaccaatattggcataggtgggtgcgatgtttttcaccggaatgaaaaagttcaaaaagcaccaaaacatgatttttggaaatattggagtgtgttgggtgcattagtagcaaaaaatcacttcgtgattcgcgcggcgaacttttgtcaattaatgtcaatattgccatatattggcacacgttgatgngctgctttcaaagaagcgngtcatgcaattcaaggcat

SEQ ID NO: 47 - DNA, 781 bp, Oryza sativa
  unsure (1)..(781): unsure at all n locations
atgatgccatgagaggcncgtttatttggccacctttccggccagagccacactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaagaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacggttcatgttgcgctcttcctcttcattgggcacgggcacatccaaggctacatccgtatctgaaagatggagggaatccaaatagagaataagatgatgctgggcgataaggtacgaccttaaatggaatttagatagcaacaaatgcttcaaagcaaccgaacccgccgccagccatttaccn

SEQ ID NO: 48 - DNA, 792 bp, Oryza sativa
  unsure (1)..(792): unsure at all n locations
cgcggggtgatgaactnctcgtagtagttcatcaaatgcacccaacacactccaatatgtccaaaaatcatgttttggtgctttttgaactttttcattccggtgaaaaacatcacacccacctatgccaatattggtagtaattgacaaaagttcagcgcgcgaatcacgaagtgatattttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgattttttttccacgaatgcaccaaccacactccaatatgtccaaaaatcatgttttggtgctttttgaactttttcattccggtgaaaaacatcgcacccacctatggcaatattagcattaattgacaaaagttcgccgcgcgaatcacgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49 - DNA, 22916 bp, Oryza sativa
  unsure (1)..(22916): unsure at all n locations
agatgggnntttgaatgccgtgcatgcacncgccacagcaagaanncatcacacagttcttgtgcaagaaaaacgaactcctattgggcagcatttaaacgatccacatcatgaaactgcagcagactcactagttgaaccagacacagctgtccattttaagacttacaaaaggtacgtggacacagaccacaactcctaattgtatatgactaacccacccaaaaggaagactgattaaagcttacatgtataacttattaaactgcctcctactcctttagcatcactacctacatgtttcagttagcaaagttaccatattggcacagggcaactgaaattggtagccaaaaactgccccaaaatgctgttcctgggcagatcaaaagggtgtcaagatatcacttattctctttaacgaataaacaccttggactgactgaatcaaagtcgagctttcgacaaatgcttgggctgagctgtaccgctttaagaggtcgcctcagtggcgcatctgggcaggtgtctgcaatgcctgtaagtagaggctctgaagaaggggtctcacagcttctaggtgaattagaacctatcagatcctttccagtcgtctctagtgcttgatttgagataatcagatcaataaacatcatgcagatccgttcgagaaactgatcctcctcctcagcatcatcgaattcaaaacttaaccttttaacagggtaatcacctgaatcaaaacttagctgccttcgcgaaggaagttctggtgccttggtcaccttcttctttggtgcacaagctaactcctctggtcctggagcaaaaggatcaaagatgctttcgcgcggtgtctgacatccatatgaaggatcttcatctgcaacactttttgagatatatgattcaatcgcttcattctctggtggtgtaatcacctcagcaacaccactcttgttattttcatgatcacataccatgccaagggatcttgtgtccttattttcaaagggagattgcacagaagcttcttcatttacacacttgtccaacttttttacaacagggaagtcacagtttgaaactagcgaattatcaataacattcttatccaccccttgatccatttgggagtaatgtggagtcaacctctgctatgacttgcaaaatgaaaacctacaatgaaataagaaatagaaaaaattaaataccacaaactaaccaggacataacagaaaatgatcaccgaaacaaacaagggacacccaagaagattccaaaaggtttctaggggatactaaggcaaaaatggtcacaggagaaactaaagcaaaattaagtggttatcgacaaaacactagccccggatgtaacggcaactgctatgaatgtaaaattgttctaaaagagtaaaggactatgcaaggcgccaaggtagtcgtcagccactaataagcaaagagcttcaactcttgttagaagccgagtgaaatcactgacatcatctaatataaccaaagcccttttgtcgataaccgttatttcttaccgaatttcaaactgttcacccatcactctgagagtctgagtccaagtatatatacaacaattatatatgtttctttacttctgtaaaaagatatcaattaaccatcaacatctattttataaagcaccttccgactgtctaattggataatggggaaacctaaaaaataaaaagctttctatgcattagctccttggaagaccttcatccacactttttgcctactatatatgtatcaatggtttatatgcagctatgactcatacataaaagattaaaaatattctctatagccagcgtttttccagtatatctacacttgatctcacaagtttttccattatcacattttcctgaaacatagtaaaagtaaacaggataacctgtacctttgaaatagtacaggatctgagttgcagagatcaggttccaagagcatcaacacttaatagtagtatgatctttaccaaaagagcaagtgcagagtgtatcggtttcatataaaaacttgatcatgtcaaaatcaagtgtggttacctaaaaaaatgagtacatcagttgatatcaaaagatgaacaaggaacttgatagtatttgcctgacatcaataactcgaaaatgtagcaaatatgtgcagaaatttgacatcattgagcctcatttccagcaggtaaataaatgcagaacaatggcctcagatatatgaagaatgtgaagtagctactgtcattggtatctgttctttccagtatctatcaaatgtagcaaaagaaaaagtacaaggaaaaggaaaataagaccaagtgtaggaaaaaagaaaccgcaagaaaatgagaacaagtgtagagcaaaaatctattcacatgcatcacaaacagcagcatatatcatcattggccatctttcccagcctaacagcacgaaaaaaagaacaagtgtagaaaaatctgttcatgtactcttataaattctgctcagttcaagtgtagaggtggcctcagttctgctaagatcatttgaactataaaatactgagaaagatcacagaaagacagaaacttagaaagggcatgtttggttgcctgaccttatcgaataaggtcaagtgcgggcatatctgttcttatgcatcacaaataagcactattaatcaagtgtgtatctgtcagtatcaatttaaaagaaggcactattgtatccggccttatcagtaacttgtatttgtagccaaagatacaatggcataacacaaatcaacaggaaaaataggaataagtgtaggaaaaatgaaaagcaagccactagacatttcattccatcgaaatcaaccaagaaagatgtcagcttttagtagatctagcatatttatgaaggggacacggtcggtctaatccaaacaaatcggctaaaatcgaaggaagggaggagaagacaacctagcccttaccagagagctcaacggaaagagtcgacgaaagagaggggcatagcagagagacggagagagcgaaccagtggaagagagcgatggcggctagcgaaagagagggaggatgcagtgctgacggacgaccggccctcccgccactcgcgagtcggcggaaccctagctttccactggtttggaacaaatgaggagggatggtggtactggtgagtggtgaccccatccatggcttctgcaagagcaggcaaatctgctgggaaccaaacacgtacacgccctaactgaacaccacagtgaaatactcaaagttgctagtattataatggtactaatccagagatccaaatgtcaaatacgtgtggtctctacatcaagatctattgtagccctattgggtgtcttggcttgcgcatgccgccgctgaataacaccataaaccttacccgagcgctcgcttgacggcgacgtggtgcgctaagaagtttggatttgatccctcacaccacaaacaaaggggacaagactacaacagatatctaattaagcaaaacagggttccttaccaacaaaagaagaaatcaatccaagcccggatggatcttccagtccaacccaatacatgagatggggagcaaaccggataagagttccttgttggcgcacctagaaattagaatcacatggtaaaagaagtagatttagggctttaagaagtgagaaaagccgaaaaatcacatgaaaaaaagagataaagctcactagaaccctaacatgtgaaaaccataaaaaaatccatagaaagaagaggagcattttggatctgcgtgagagaaagattgagaagtagaaatggttaagaaaatggaagaaaggaaatacctcgcggcggctctggattggggcacgagattggtttgggtggcaccaaccgggattgggatgaggcctcccgccgccaaaacaatcccctctattaaaataaaacaaagatttcacaaaacaccccatagaatgtctcatttgctaattttattcctttgtacaacaactagcgaggagcaaggcagctctgctggaccactgaggaatatatgtgaaaaataaagaatcagtgggttggagagtaaaatgcaccaaaaggagggaaaactaatttgggcgggcaaccttggcgcgcgtgtagcaatttagcatatccttcccgcgaaataggcgtgcctatacatatcatcattttggtgaaaaatgaaagtttcccactgcctaaggagttttttcttaggaaaaaataataaaataataatggtcgtgattatttagaaatctataggtgcaaataatcattaaatgagtgggtttcatgtgtatactatgttgaggctagtttgcgggttatcgaagatcataatgattaagagacagttaattttatgttttcctggtttaatggaatttatctattgcaagcaaaatacctgtgtttcatgaccagtgaagaaaattataactttacataccttgttttgccattcatctctccatatgaaacacacctgtgatacctttgttccgtcatttatgtattcgtatgaaacacgccagtcaggttaaagaataagcctgtgagactttgatactcaattttaacagtacagagaagtttatgtgaaaatacatataaactcaaggcatgcattaaaaaataattgaatgaataacttttcataatattaacaaaatgaaagggttaaaatgaaagattgacaatgaatccaagatattttatcatctaatactcatagatagaatccgtttggtgatgcatggtagaggcattatccagcctctctcattgcagctcacgagggacggtggtggtgctcccctagccaaccagcccctctcggcacgacagaggtcctcccttagcgcgaggtagcagtgttcccctagtccttcttagcccttcctaggcagcgagggcggcggtgctcccctatccacactagatggcaatggtgatggcaacaacctctctaggcatcctccagtcttagcctatcttgttgggtctttgtctattttcattggtttatgcctatcttgctagggcaaaaacttttgaaaatgttttgcacataatttccttaataaaaaagtagagaatattcgtgagtagtacgtagttatggactagttaaaacataataagttattgtctataataatatcacgagtattccattcattacaaacttccaaatatcacgagcattccattcgtcacaaacttccaaaatacactcaagcgaatattcttcaaaacaaataaaaatatgcacatatcatcattagctagttcaaattggtgaagaaaagtgtgacagacgcttctcatcagtttagtttagataaatccggcaataaaaatcgctatcgactaccaaacaaggaagttgtcaaatgagacgttcacgacatctatgttttgaggtcccgatccttgcagcctttgctctaggctctgattggtagatttgggaattaggatgactaatggaaatttggaaagatttaatttcacctccttttctcctattagtgattcccagtttaattggggagaggggtggagcagacgcgaagtctccgttcttgtggaacaaagaagcatgcaaagaaaagaaataaggcataggagttggggcaaccacttggatggagtgagggcagatggccgtgcgtagccagcagtgcagcgaccgcaccaagctctgattgatcatgtgattccaacttaatttgcaagtttccaagcacgcaacgtaaggtgggcatgccgcatcgcgacgtgggacaagacgagaagccgtatgatatgctgctttgttacgcaggtgcactgcactagtagtacatagtagagtattatattctacacgggcggcacattagttcgttacagatagtatcagatcaggaattcaggattcagtgctacgattttcttcaatatttcttactgcgtgttgggattgatttgattcatgtatataacacggtgtcagtttggatatatatacagtaatttcactattctctatttcttcaacgtatgcgcccatgatgtttactactccctctgtcctataatataagggattttgggcttttacttgcactgtttgaccactcgtcttatttataaaatttgtgcaaatacaaaaaacaaaaagttgtgcttaaagtactttggataataaagtgtcacaaaaaaattaaataataattccaaatttttttgaataggacaagtggtcaaacagtgcaagtaaaaactcaaaatcccctataactagttgagtgcccgtgcgttgcaacgggtgattaaaaatacatctagtgttatatgttgataagccttaaaaaattctaatagacattataaaacccaaaccccaagtccatgatacacaatattttaaattcaaattgattacaaatgcagtgctacttttttatttcaaatccatcaagcaaaatcaatttcagatttaagtccataatataaaatcaatgttaggtctcagtttagaatctgttttaaattttcccttccactgaccgtaggctaatgattagaatttataggcagaatcagacctttactattgcctctaactgtacattgcctaggtgaagcacaaaggatgccagtaattgagatggcctcgatgggtttatcctcccctattgcagtaccacacgccgcaggcaaattcatctggcaaaagacaaaaataagggaacaatttctgaatatgtatcactaaactgcagcagcaaatgcaacaatgctggaactgtactaccgaagtgatcacagtaagagtctcaccatagatagtggccaagcaagtaggagcagaaagttggaggccatgtagagcaccatcccctgcgctgccaccaccagcaacaacgacggcatggccagtgcccaatgcttgaaagcaaccaccccggtgcgcacaacgccacccatgagactcaaatcactcatccaggcgaagcgaacaactgcatgcatgctaggagtggagacggcggccgtcgctgcatgtagtaccgacctggcggggtagtaggtgatgctgagggagcgcagccaggcggcggcaatactgcctctccctcaactgagttgatctgaaccttggtctgcatgtagtaccgacctggtgaggtagtaggtgacttcgagggagcgcagccaggcggcggcaatactgcctctccctcaactgagttgatctgaaccttggttactggaattgcgctgcatatcttcttctttagcaatcaggagacaagttaataggtgattgaatttaaaaccagttacaaacaagatccatcagggtgaaaagaatagaaagtacaaaggcactcacaattagagttcagttcttcaataatttatctccaagattcagtctcactgcacctaatggtgtggcagcccgaacacttcccattgctaagaaaaggaaaatattttagtaaatatttctattattagaagctttaatcagttgctatataggatatgtagtggtcattgatatattagcagctttttcatttgtctgaattaatattgagaacaaatgtggatataatcctggtgttgcagaaatcacaggacttatggcctttcagtttgtgttctacttgatagtgtgctacaaaattcaaataatacattaatgattgcaaatatttagaaatgcacaagctgtaaataaaccagcaatctcttttaaatcctgtcctgcatggactaaaaataaaagaaatacttcctccgtcccaaaataaagccattttttaggttggcacgggtattaagaaagtaggtgagaatgattggaggaagtgtgtgattggttgaaaagagaaagtaggtgaagaagaatggttgtgattggttgagaggaggaggtaggtgaagaaatagcttcattttgggacaagacactgtgctagaaatagctacattttaggacggagggagtacttaagttcagtacctactgaataagtttgtttgcagttacccataggtccatacaaaggaaacatggtctttataaaatcacagggtctttataaaacaatcatgccatttaaggacaccaaagctacatatcaaatttatttgactcagtacaaatgatcaaaaaagagtaggcatatgaagagtagaatctacgtagttcgaggtggacagtactatttggtcaatttgagcagaggaacaatgagggctccagcatttcttactaaatccctgactcgcatttttcactaaccatatgaaaagcataatcatatataaattcaatattttttcatgacaatactttttgggatatggagtttgcaaactaacattagaaattgtaaactaaccccagactaatgtgtttgatccactaaattttcatccacaacaaacaaataaacgtcgctttatagatgtactataaactccattataaacaaatgggggggaggggtatggaagaaatcataacatgaaaaaaattttacaacgttacttaccaccggctgaggaggaggttgccgcaatagagggcgccgtcgttggtggccggggctcgcagaagggggacgcggaggagatcgacgcgggattgatggttgcgcggaggagatagacgtgaggcgactcgtggaggcagcgacggaggataggcgggcaacatggtcatgggcgatgggatcggctgggaaataacggagagaaattggtacaactacaactccttcaactccctgctattgtatatgaaagccatacaagttatgttatcagcactcctgatgaatacaaaaaggtcaaatcaaatcacagcgaatttttggacacgaaatccacctaagaaacggccataaatttcatgaacacaaaggataaaacaatggatattagtataacttgcgccaatggatattagtatgttagtataacaaaagctaaatactcatggcatactcttttccccaatgttaccattatttacactgtgaaacatattcaagtcatctatttatatgtacgatcctgtttagataacttaaacagtaatgtaccacctcgataacttgcactgcaccattcatttcccactccgacaaatcgaagtatggaagacatcggcacgatactaaaaataagcatttatgcattgaaaaattccctttgggccaagtgagccaaccaaatgtatatgctgtttctatcaaaaagattattgtatcatgtttcgagcctcagatttcattcgagcgggacagtgggtgtaaagttttgacttttgtcttgctgaatagcagaattagtctttcctgatcaatttctgatctaatggcttcagccaactgcatcaacctgatgctgtggtcctagaagaaatgaactttttttttaactcagttcagacttcagaacccattttcttcagggaaaaaaaaaagttcagaacccattgtatttagttactgttgctgtgcttatgttcaatctgtccttgtgttaagcattatgttatgggcatgcagtcacaatcaaattacatcggttgatgacaatgtgtgtgcctgcctgtatctgccttcctatatgtgcccaaccaaggttaatatggattaactcaccaatagacgtcgaaccgaggagagggaatagattaacatgtgaatatgcagatttagagacctagtaccaagaggaaggggagtacaccaaccttgggaatagttggcgccggccttggggaggaggcaggatgcgacgacggcggaggggcggcggtcgagggcggtgcgggtctagggtttcggcgcgatgagggaggagggaggagtcggcggcgtcgggtcacggggtgagtgcgagagagaggagggcgtcgatggcgaatcctcgacggtgacgatgggggcgccgacgcgtcgatgtggggagtcgcgagggtggattggggggcggcgatggtgtggaggaggcgggatgcgacgacagcagaggggcggcggtcgagggaggcgcgaggatggattgagggccggtgatggtgtgaagaagncggcggtggaggaagaaaagtcggaggaggggcggcggtcaaggaaaaggagtcggcgccgtttcctttttttttttttttttgttgcggacgaggagtgtgcgccgtttccttttctttcttttttttccgttgtagagtggcatgtaaattgttgatgtacctttctcatgtttgatcgtctgtccttggcttcactatcaccgtaacgaattttttaaatagtaaagatatgggacgaagggagtagctactgattcaaaaattccgaatccaagcaccaaacttcagataaacatacctttctcaacagcatgcccacagctttaagctgccaagtgccaacactcacagaaaactcggcctggcgcaaaaaaaaaaagaaagaaaagaaaacaccatatcctgagtcctgacttctttcactagcaaatactgagttactaggatttaggaccctcacatgatcaaacaacaaacatattaaacattgtcataatgaagccacatgtataaaccaaacagccatatccagcggttctatttaatctcaccactaactgtcgcatcaagcaagcagcactttacattatcaatcacgattttcactgctccgctgcattcatcacataaatgaaaatatttaagcatggcacaccatctcccagttcttgtgaaaagaaaaaggaataatcattgagcagcattcagacgatccacatcatgaacctgcaacagactcactagttcaaccagacacagctatccattttaagatttacaaaaggtacatggtcacagaccacaactcctaattgtatatgactaacccacccaaaaggaagactgattaaagcttacatgtataacttattaaactgcctcctactcctttagcatcactacctacaagttttagttagcaaagttaccatattggcacagggcaactgaaattggtagccaaaaactgccccaaaatactattcctaggcagatcaaaagggtgtcaagatatcacttattctctttaacgaataaacaccttggactgactgaatcaaagtcgagctttcgacaaatacttgggctgagctgtaccgctttaagaggtcgcctcagtggcgcatctgggcaggtgtctgcaatgcctataagtagaggctcacaacttccaggtgaattagaacctatcagatcctttccagtcgtctctagtgcttgatttgagataatcagatcaataaacatcttgcagatctgttcaagaaactgatcgtcctcctcagcttcatcgaattcaaaacttaaccttttaacagggtaatcatctgaatcaaatcttagctgccttcgtgaaggaagttctggtgccttgatcaccttcttctttggtgcacaagctaactcctctggtcctggagcaaaaggatcaaagatgctttcacgcggtgtctgacagccatacaaaggatcattgctagcatcagtagcaccgaatttagtattcagtgcatcccacaactccttagcgtcggtcatatacatatacacctcgaccagacgatcgccaagaacgctaagaatgcatcccacaaagagagtagtggcttcctcgaattgcttctgctgatcagtagtaagaattccttcaggtttaccagtactcacccagaagcatttcatagccgtcagccacagagtgaccctgatctgccatctcttaaagtgcacaccggtgaatttatccggcctcagtgcatcggcaaaaccagccatagtaaaatcacagtgcctataataaggtttttggattgttgaaattataagcacataatgatttaatttattccataaataaatcatggcattgcagatgtaaactagattgaacgcatcattcgatctacacatgtaaactaagcagtaaaacatgaacagatcaaatatgcgcaacacgtcgaacacgtaccgaggtggcggaaagactggttgctcggcaggaactactcgtggttgcgagcgtcgacaaaggcgcgagtggctaggagggcatcctcccttttaaggaggtctccctctcctagaataagtaaggtgataccaaaatccgcatgcatgccatcccatgaggtggacttttgtgattttccaaagaattaatcttcgaatgggccttagcccatctattaattccaacagaaccttggcaccggcaatgcgggctagagggcgcatgatgtgggtccaagagaagaccgacgagccaaacccatgtaatagcactatgggcaaaccaatttggttttggtcagcgtttgtgatgccagagtctggagattggtcactggaatcctcatgggtgcaaaccttgtggtggacccttacgccattgatctcgtagaagctgctgtctgggtcagcgagggcatcggggtcaaggagatcgtcctggtcaatgccagccacactccggcggcggcggcgtcgtggtggcatctgggcactgtctggaattgaacctgcattagttgtagggtttagtagtgccaaagctgttctgctagttttggggacgtttaagcttttggtgctagctttgccccccagatgaaaaaaaaggctcaataatgcgccattttaaataggggaaatcacacattctacttgcagagagcacatcaacctcaaaatatcccatcttaataacctcctatccaaatgctgcaagtctttcaccacagagaagttacctgggaactcggcagaggcaaaggctgggggagaaccattgggacggcgagggccggaggccgcgggagaaggcggcagaatgtcgagggtgtggagccgagggtggggattggaggtagcgtgggagaggcatctgaattgacctgatcaactgcagagcaggaaactcacgttcgctggactgaacaattgtgtggggtctcaacggaagaagcaaaccgaaaaatcaatctgcatccacacactgcaaatttgtatcgtcatcaaacaaaacggtgctccaaataactatcaatctatattagatgaatgcacactaccatgctcggcaatcgcatttcttggatttttctcatcattgattcattgggcaacaaaatatcaagtcttaatctccctaaaaaaatatatccaatcttgaagcaagtaaaacatctgtgagttaaaagcatgtgaacaacgcaagcagaggaaaaaaaaagatgatatcaaaatagaaaagtttggttatagtaagcttaagagcatgtataagatctgagacaactatagtctctcgtgcactatagacgataccgaaagacagttactacaacagtttgccatatataccatgaaacgaaataaatgtgaactacactcgtagctttggaaaagagaaaatccatcaaatgccatcgatagacaaacaccataatcctagaaatgccatcgacaaaggcaacttcccaaaaatgtcattgcacaagcctctttctcccaaaaatgccatcgccgtcaaattgctgttagcatctttccgttaagttgcatgaaaagacaatcttaccgctaggcaaccatttgctcacgcaacatcatttttgcattgtttgctcacaacaaattatatttatgttagcttacaaatttaccaacatcatttgatagtttccttctgttttcatccctagtcactccccaatggcaaataggcagctcccgagagagagagagagagagaacgcgccgtcgccgccgcggaactcctcgccgcgccctgcgacgccgccaccgccgccgtcgacctcctcgccgtgccctacgaggctgccgccgtggacctcctcgctgcaccctatgatactgccgcgccgtcgccactgccgtcgtggacctcctcgccgcgccctgcgaggccgccgccgtggaccactgccgcgccacccctgccgtggatcctcaccgcgccctgccgcgccgccgccctggtcctccttgccgcgtcctaccgcgtcgctgtgctggtcctcctcgccgcaccctgtcgtgccgcccccgtggaccgccagcatagcggcgccatggccaccgctagggaccgtcgctgagccaccattgtctagacgccgctggggagagcgctagatcgggatcggttgcggtagggttagggctagaaattttattttttttctttgacagtgaaaattgggtatattttgcattgagggcaaaatggttattattaaaaaaaataatggttgtaatggtgtggagttgatggtgatggcatttttgggagaagggcttgtgcaatggtattttttggaagttgcttttgtcgatgatatttctgagattatggtgtttgtcgatgtcatttcatggattttttttctttggaaaattatgtgttagtagtaccagacagtagaaacaggcagtacagactacagagcttggtcccctctatgtggaaatggtagctacagtgatggggtttgaccatttgggcaaattctacaaatactatagcgattggcatgaagtatgaaccacctactaccataatctttatgaaaacatacacagctatgaacaccatctattacttggtgttgagttgtgatccaaattaacttgcaaataaaggccaacttctatcggagcgcagcggagatccgtcgctggaggcttgagccgtagcgaaaaagataccgaaagaaaaaaagggaaggcagaaagaaaaacagagaaaaccaaaaaagaagcgaaattgaaaaaaaaacaaaaaaaaaaggaaaaaagggtcctccagtgctgtccgtcgctccttctccgcgcgcgacaggtgactggttgctaaatagctttctcgggagaccactacacttcggacgtctgatggataacagaaaatcggacgcttgttatgttatatttttgacacatacactaacatgtgcaaaaacactttaaactatttttttctcttaaattatttatccaaatcatgatccgattacaccattaaattcgttgcaattaaatcttcaaaacaagaccacacatgaatatattccgacgaatttttttagctaattattgaattatttttaaatattgcacgatgttccaccatgtatatcggaattgtttcactaaataaatcaaaaacgtttcaatcgtttaaatcaggcgttgtttcaccttatataaaaacaatgtttcagcaaatagcgaaagaatgttccagttcactgcaacatttgatccatacatagtgaaacactataagtacactaggtgaaacatttttggtagaacaaaaaaaataaagcgaattctcttgatagagggtttctaaaatatgtgggtaatttcttgcaaaagaatgttttaattcactgcaacattaagtctatacatagtgaaacattgtgagtacactaggtgaaacattttttgtggagtatgtagtgggaacacgtggcagtgttgcaggggagacgtggtggggcccaaggggagcatgtgcgcacgtggtggttgggggggagcgtccgattttctccccctcccccgggcgaccgaggcgagatcttattgtaaagatttaattgaaacgaatacaccgaaataaatggatcatagactgaatgagtagttttggagaaaaatgattttaaagattacaacttacatatgcatatatacttgcacaaaagttatgcgtatatgtatcctgagttcctgacatgacaaagagatgaggaggcattagcatgatgaggcgtccaaagtttcttccgtgatcggacgctagatgggaagtatttccggcattctcgaactatcgtaccagtttcaacccgtgggagagggttggccgccagctccgatgctagcgcgtatgcgccagatagcagcgcccgatattttctttccggggcgtgggcggaatcattcaatcatcgatttcttccccaaacctagcctcctccactgctcccaacctgccttccgtcgccgccgcctaccctcgactactgatctacctttctccgtcggcggccgcgggtgcccagcgcaaccgcaccctctcctctccagcagcggcgacccctcgcctcataccctttcctgggcaaggccgggaggggatcaatctagggtttccgccgccgccggttccccggacgttgctgcatgacgatggaagatggaagctgtccttcaccagtcacccccagcgaagccgaagctggagccgaagattacgaatcttggacactgaagcagaagattgaggatctcgtcaactgtgatcctatccatggtatcgtgccaaaaaatcctaaatataaagcatatttcgaggaaaagttccaggtacgtacgtacatattttcttcgatccatcatccatggatgcaaaactaattaattaattttgacctcaccagctagcatatattttttttattgtatgcaatcgatcgatgaatcaagtggtatcatatctattgctattgtaggagaagttaagtaagtacgtccgtgttgtattgccgaaacttcgtccagcaattcagaaggatagcgtcaagcaattctttcaagtctacaattgttggtcaggtttcatgggacggggaaacttccttttacctgatatcctcaccaacatggccaacgagaacgctctgcgttgtgccagggtcgcactccagggcacctctcctctgttgcgtcgccgccgcgctgaccccaacacccgccaccgctatggcttcgcccccctacacatggctgccgagaacttcagcgtcgacatggtcaaactcctcttccgttacggcgcatcggcgaacatctgcaccaagggcgagtatgtcattgagggcctcctccctctccatgttgctgtcgagaatgccagcatgcacaagtacattgaggatcattgggctcatggggaccatatcatcaacctcatcttcctcctttgtcttcctgagatggtttcttcattcaattcctatccctattatattactgccagagcatttagcctatttcaaatactagcttggaccaataattaatttcagccaccactgacatgcagaaaatgttcttggacacgactagattaattgccaaacagacagataacattgtcgacgaggtatggaattacattcgtgaagaaaagcatgtccaggcagcaattttgctgctggctgctcaaaagcagctccgtggccgccttaacaacagcagtggcaaagcctctctgaacgggtttgatattgttaaaagccacattgatgatgctcttaacaccatacatcttgaggggttaaatatggttaaggagggaaagaatggcagggcactaaagagattgaaagacaagaaggaagcccttcttacagcacttgtactagttggcattgttcacaaagccggtgaagctcttgagggatacattcaaactcattcacaggtaattgctgaaatttccccattgttaccattgctttctgatacctgtgggttttgatttttccagtttcgttttctttaaatttgtgtgatgcttacttcccatgactttgatctactagtgactcattttctttaaatttgtgtgatgcttacttccatgattttgatatactagtgaaacctcgaattacccttgttttagaaagctgtggtgggtgtggatcgcttttctttttctttttggtgatatgtaaacagttggaggagctcctgctgcattgtatcaactagtcacatccatattataaaaaggagttaaaaagaactggacccatgcagttaatggcatcttttagcctccattttcatgtaaatccaagaggctgaatagcaggcccagcatagtggtagtatactgctaggttcaggtctaatgcatgagtcaaaaatatatggaaacatgggagtagatgcagtgtgttcttaatgcgaagcaaggtggcccaccatcttttagatgcctacgagtttaatgcataagtcaaggtgacaccttacatctaaatctatacaatgttgccaacttctgtattacacacatgcttaccaattattgagcccatgtaccattcgtttcccctttctaaagaagatctaagaggaggggaagaggtcctcttcagtctcagcagcagaatgcaagaagggaaaaaaggacatgtatcctgtccaaagaggcagagcaaagcgcaagaaaaagaacatagatgagggaagaggtgccctttccaaactagcagagcaaagcatagaacaagaaacagagcagagaagagggaagaacaagtacctgtcctgtgcgacggttgacagctggggaagtggagagcatgaaggagaagcagacccgtcggagaaataggggcgttaggaaggcaggctggtcctctgcatctcccccttctccttttctatctctaggccactagcacccctcacacaccagcctttcgactgtgcacgccacacttgctctccccacatgtgcgtacccccatggcacttgcggaaggctaagcgagcaatatgctctcttccactggtgcttgggcgcgaaaggcgatgcctttacgacactttaaaaaccaagaattgatatttgcatgaactatagaagagcataggggtccattgaaggtaagtttatctttttgggatcaggaacatataaaatttgtagggaagatcaattgttcttaagtatggtttgagaataaaaatataatagcaccctcccttggattgggctaccttttaaagtgggaccccatgtaagtttagcaaagcaagttttttagcttggaaactgagtctttgagtttttgtaaatattttcaattttattcatgaatatatgcgtattcagcaattttaattatgactccatatatattcagcttctattcttttttttttttaagttgagggctaacataatgggtaagatgagcaagaaggtgcgtagttgttatgtgggagatcatgaggctaataaagggaatagcacttagattatgtcaaggtaacctgcaaaagggtagagatgaatagatgatagtgttaagggtgatggtggtttgtctttagccccattggagtggaaacctgatattggatatgctgcccttgttaataatatatgtttgagtggaagtttatatattctttctctaaccatgactatgactaggaatcatcatattgttctctcaacaagtctttcatattttaattgaattcaagctctaagaaatgaacgaaacaaaagctggactaccctgaagcaacttctcataatgacccaaattacatgaccagaaggcctgcattatggaagcttttgttggtgctgaccagttctttttcttcctcatttatttcttctattcctcacctggcatgttcatgtaaaacgcaaaacacatgtcggattgttattttctttcttatttatttgctttattctacgtgcatgttaaagtttagtgagaatgcatgtgtcaaaaattgtgaccctctttcaccccacgtctctatgcacacgaagagtgggttctaatattttctgttcaactttacttgggtctgtttcgaaggcccgccatttcacagcatccatatatgccatcatgccacaatgaatatatcaataaatttaaaaagtggatgcttgaaaagaaagattaaccnnnnnnnnnnnnnnnnnnnnntcatgccacaacttagttggcagtgacgatacatgttcacatggtacctatcataggagaataatagtttaagcgttaagcctccaccttctcacatcaagcctagcagagaaaaggccttggcttttggtgtcacttaagattcgtttatcattaggcaaccttctatagtttgtctttactacttttttatttgtagtaggaaaagtgaaaaattctctgctggggtccatggcaatgaaactgcaaattccatgcaactatctatacccccagagtgtagaacataacattgtgacaccacaatattctagagttgattaccatagagcatctgtatagtttagactgttatactttcaattccaaaaaagtgatctggtttgtagcaggtgcaacggtaccgaaaacaactctcacctgccaatattctgctttacacgtgtgccggcatagtgctgccataccactgttctgttgtgtaagatctgttttaattttcttctgctgttatactgtagtgtcgtcaagtaatgtgccattggttccagacaaaaagtataagttgggcaacttggttgtttgttcatctagccaaatgagatgttattgacaaggccctagtgggctttttggtgttgtcttgtttgcggtgagcaaggatggcaaataaatccaagcttggaatagtagagttggttgactatggcagattggcagcatgccaaatcaatgacttactgattcaactcttgaccacttagtatttgtgtagatgtagtgcttaaaacaccattgttgactttcagatggtctgtactgtttgtctcgagagatgatgttattgaaggctgttatgtgtcttgcaaccaccaccacctgcaagtttagatatctgaattctcgttttggaataatatccttgaacattttgtaatgatacgttttaacaattttcttggtgaaatgtaggtgcgccatgacgaaattgttgaacatgtttcatcaattctaaaaagcaatggcattgctcattctggggaaagcattgacactggaaaacttgaatggtttgacatctactggctttatatatatattcagttcatgtttttgtgcatataatttatgcgttgatttatttgtgttttgaagctaccaacatggtggggggatgtcgattggcaagtcagattcacaaagaggtgtgtttcattttggttgatcctatttcttattaaaataaactagaaaggaaaatagctgtgaaactttattacgtgtccacccattacaaagtcatttgctgtggtgaatgcacaactttggaacattgcagaaagcttatgacttgcatccagcgcaaaagggggtgcaaccagactctgtacaccaacctcggaactatgctttccatttcataagctgtctcatgaccaatttcattgctgattacagtgggctatggggaaactattgaagcggacaagtcatcttctgatataggcgaagttagtaaaatggtaatgagatacgcaattaaatttatttgttgagtctaattcatgctgatgaaattagtatgaaaacaagattgttcctccaaatttgctcctactgacccctatcaattaacaagatatggaaatatttgataacgtaatgcataaccatcaattgttgccttattggttaacaacagaatgaatactcactacttaaatctgagtgtttttataattttgtttatgcgttcagttgctaattttctcatgtaaacagatcctgggaaagcaaccacctaaaggatcagccatacgcgaagtgagagatatgttcttcccatactggaaatcggtgttgtctcgacggttgcagctaaagatagttccatcctgtcaactaagcaggaaggacttgctaagtgctgaagcgagcacgaaggggaccaagagtatggaccacccgtgtaacccaatcaaatcaatgggaaatcttggttcgatgggctggcccccattgtcaagtgagtccagaaggatgctttatactgttgcttcaatgtcccggaaggtgtttaagcgcacttgactacagaaaatctttggcggtatgcttgttgaaacactttttttttctataataagcctctagaatgtattttggtcatagatgagaaggggagaaaacagcatatcctgacttctttcactagcaaatactgagttactagtaggatttaggaccctcacatgatcaaacaacaaacatactaaacattgttacaggtttcaaaacatataatgaagccacatgtataaaccaaacggccatttccagcagttttctgtttaacctcaccactaacagtcgcatcaagcaagcagcactttaccttatcaatcatgattttcactgctccgctgcattcgtcacataaatgaaaatatttaagcacggcacaacatctcccagttcttgtcaaagaaaaatgaactaatattgagcagcattcagatgatccacatcatgaacctgcaacagactcactagttcaaccagacacagttatccattttaagatttacaaaaggtacatggtcacagaccacaactcctaattgtatatgactaacccacctaaaaggaagactgattaaagcttacatatataacttattaaactgcctcctactcctttagcatcactacctacaagtttcagttagcaaagttaccatattggcacagggcaactgaagatggtagtccaaaaactgccccaaaatgttgttcatgggcagatcaaaagggtgtcaagatatcacttattctctttaacgaataaacacctggactgacttgatcaaagtcgagctttctacaaatgcttagagctgagctgtactgctttaagagggtcgctcagtggcgcatctggg

SEQ ID NO: 50 - DNA, 756 bp, Oryza sativa
  unsure (1)..(756): unsure at all n locations
gtgggttggctaatggattaaccaatggtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatcttcacctttcatttgatccctatttataggatacgctgn

SEQ ID NO: 51 - DNA, 752 bp, Oryza sativa
  unsure (1)..(752): unsure at all n locations
ncctgaagctgtcgtcgcccatttccatacagaatcttcgactgatgtcgcgtgccaaactcctgctgaccgtggagtccaagaagtacccacatctgcgcatccagggacacatcgtgacccgagccagctgcgaaatcttccagaccctgctggcgcggcacagtgctgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccactgcagtcgaacggaatctatgcaagccaagcccacg

SEQ ID NO: 52 - DNA, 62012 bp, Oryza sativa
  unsure (1)..(62012): unsure at all n locations
taagatagatatataacgttctctcaatcatatattatgacaaggcagcatatcaatatctggtttctctccaatggggtaaagacaanccaccatcgccctatcggtatcatcattcatctccaccctttgcaggttcactgacatatataagtgctatccgctctattagcctcatgatctacgacatagcatctacgcacattcttgctcatctgacccattatgttagccatcaacttataaaataaaaagaataggttcagttgtacattgcaagtctaaaccgtggatggtgcgtgagtgtgcacacctgcgctgtgtgcttttgggttttttcttctttttttttttggctttctccccagttttcaacctgtaaatttgctctgcatggtggtgcttgtaaggccctctaattttcacagtggtcttatgtgttgttgactgtgtttgctctgccaaaaccggcaaggtttaaccccagaaatgaaaggctgaactaagagtggttggatggttgctatgctactgaaacgttgtctatcatctgtatcttgttccatgaattgcctactttctttgtgcattttttgttgagctttactttctgatattaaattgctggtgttatgttttcctgacgtagtggtcatctgtattgctgctgtgaatcattgtataatttgttcctatatacctgttctatcatgatgctatcagtgtttctcgtattcaaggctgcgtcagttttgcactccaggtgttgtgttttcccacgtcaacactctgtttaagatatggaaatcactcattgtctttctgttattttattgtatacagaaaccagtcattatctgttcgctctcttgcttttgtaattaacaaggagccctcattgtcttatcatctgtcatccaccatgttactccattcctaattctaaagatgccgactctgatgcagcactatgataaatgtttggtctcatcagtcgggacactgataacaaacagcactttagagtgctaaaatacagtaaccatagattccccttaatctttcaactgaaaacttcagtctaactaaccataatttaaaccaaattaattagcggttatttttctgactctataaccatgcatatactgtctgaagtagattcagagatggttttagaattaaggcaaaagattgttaagcgtatggccacctgtctgttagtataatgctgcagtaaagagtagtaataagcatatatagacaacagtggtagtcattttcagtcactaaaatacatacactcttattgtactgtaattcatggttcccttgagccatggtcatcgtcaccatcatcactcgcacttgcgtcgaaggagtgattaggagatggttatcgtgtgtgacgtggatcaagccagataagcatttcaatgtttttatttttgagagagagcagggataagcatttcaattagcaaatgaaaggtgtctgctatagctttttctgcaaggacaataattaatgaatctgaaagtgtgtcgtccttggaaggaagatggaaaggaagaaccactcattaatcaaacaagtgtcacaaattggatcactgactgcctgactggacaggaatgttggtgcattatcatgttataactaaaagatgcgtgaaaatcagtgagcaatcatagaaaaatcatcaagtgcactgttccattgttgacaagaaaggtttttcctcacaaaataattaaaaccgtatccttccaagttccaacatacaggacaatctctgtgggatgtgacttggttaattatccagttacatctagagagttagcgaaaatcggctgtgcatgacaagatcacaaattaatttggagaacaaagaatgaattaaactaagttcataaaaagaaaaataatcgtgcatatcaaaatattcagaagagcgaaaaatacaaggatcagatgcgaaaagggccaaggttgcattgcaaaccatattagtttgctggtgtcctggtgatatatgcaactttagagagccagcaaatgacgtatctctacctaaagaaagatattcccctttggtattgacacaaaggaacatcaatcgctctcatttaactggcacgcacaacggttgcttcatcttcaactgctaattaactttctgaaacgctgatgctttttaatcctcttcttccccggcccatgcatattctctctgctttaatggtgtgaaatttcagaacaagaatctagtttccgcatacagagttccagaaatttccgactgttcatctcatcgatcatccgcgattctttttttagtttttgatggtgatcagccacaccgctagctagttgacacatgtatgcagtagcaatatttgttagctgaaaaggaagcaaggaggaaagcagcaaatcagctttgttgccaagctgcttggcaggtcacatttttcatttccgagttgattaatttgcaaccatcatgcatcaatacaattactatttaagcatattagtaaaattgtgtgaagttttttttttcaattaagccatgtcatgtgtgggggcgttaccttgcagactatataaatatgagtgaaattgacttgaggcgtcgagttgccttattgccaaacaatagtactattcattagtagtatatctgacccaaaacccaaccatttttccccctttgcgttgcatctcagtgttcttccattctttccagagagacaaagtaattgaccatggcaaaagatcctcatgtctccatctctctcaccggcctcgccatggtcgtcctcctcatcttcagctcctccttcctccaggccgcccaaggtacgtacacaccttcatcttcgcctgcttcatcatgcatcttggtgatccttcaagtcggttctgacttctcaattgatattcatgcatgcaggatcagacaagaagatggcaatgaagtacgacgtgccggtgaagaggctggtgtaccggccgtcggcgatgcaggcggcggtgatcggcacggaggcggcggcgtacgagccgttcgagctgtgcatgggctgccggtgctgcgcgtcgtcgaacgcgagcagctgcgtggacacgagatgctgctacgccatcgactgcaacatccccggcaagcccttcggcgtctgcgccttctctccccacacctgcgactgtggtgccaccaactgcaccagccaacagcagccatgaccacacacctcttgctgctgctaattcaattcgatctcttccatgatcaatatacttatgcgcctgaatcattcaactgttttctgatgcgattgcaaacgtattaagttttttcagagattcttgggacttagatatcctgacatgagcatgttgatctgaaagtttaactgcatatagaatcttcagaaagggattaattcttgatctaccagttccacaaacaatttattcgtgctttaaatctggatttgcattctctcttatcagagagtaattaatttgagggtctgatctgattaattgctgtagaacccactttgatgtatggatatggctgtgctgcctgtgcagactactagctagactgtagagaaaaggcggctgttttgtttgactattgcaggactagcacctaacactgttgttgtttgtatcctgttcttccttttcaaagcctacgtgccaaatacatgatcagcattcagcaaggtggatggtctagaaatcaagttgggcagtcacaggccggcacacgcttgatttgacaatcacttgttaggtggaaatgcaaatgaattgtaggtacaaacccacaatgttagtagcttaattagctcatcagctaaacgcctaaacctactctgaattaacttgaagtctgaaacgtacgtgatcgagggtactcatttcagcacgattaagcacacagcaatcaaggtgcttatatataagatgaagatactctgtctgcctgtctgtaagtgccagacatgcaactcgatcatcgccctagaaaacacatctctgtcaggcctgagcaaccactgttgttttgcaaataaaaatttcagattctcctttctccgatgatgcagcattggtttcactgatctgaaactagctacgaggaatggttagctttgtctaacaacttccttctgtttgagctttgggtttgcagacaatcatgtattctatggtcgccgggatcgccacggatcaaccggtgcagtgctctacgtacagcacactatatatattgcaaaatggatacggcgtttgttggaaaaatattttgtagaaaacacatatatagtaaaaatttggaaactaccgttaaaactaaaactgaacacctgagatttatacacatcatcgagagtaaaattttactcccagacaatttttttactctcgataacgcggacaaatattatgcgcctatttcataattcaacggtagcttataggttttcactatatttctagtttgtattacatattttcaacccgatggtgagttgttccaagctgctcctctgctttttactactccctgtcaataggttaattaagagagacataactcaatgtcaaaacaagcttaccaacctcaataacaactaggaaaaagtacaccaaaggtccctcaacttgtcatcgagttacagaatcatcacctaaccagatatatgatatctctaacttagaaaactgttcactttaggttcttcgatggttttgaccccggttttatccgacgtggcagctgagtcagcgtggacccatgtgggccccacatgtcagggtgtccacgtcacctttctttcccttctctcccttctttcttccgtctctcttgctcttctcactcgcgccgaacacgttgtgggaggcgcggccgggggcgacgccgaaaggcgaaagaggactccgcagaggcgagggtggactcgacgtcatcgacgcggccagcgccgaagagcgcggagaggagcgccgagagggagacgttggagcaggcaacgggcgcggagtcggagaacgcgcggagggcgttgttggggcccgagaagagggagatggcgcgggtgagaagaccaggggacgccagggcggagtcgaggagggcgcagaggagcgagacggcgaggtctaggcggcggaggcgcgggagacaggacacggcgagggaaaagagcgggcgggagccgtggaggcacgggtaatcgtcggggcgggagagcgtggtggcgacgagggagtggatgcgggccagatcggcctcgccgcagacggcgagctggaggtcgaggatggaggagcacgtgaggcgggggtgggggtccaggtgggcagcggcgggtgatcgacatcggggagcgcggagaagcgacggaggaggtgggcggggacgctagcggcgaggagcgggttggaatgccggcgaaggagggagaccatggttgagacttgagaggaatgggggtttgggaattgggatctcccctcttttttctcccttctctaggggaactcgtcaaggagggcgaggccatggtggcagtcacctcctccccttctcctgtcgttggccgccgacgccctcctccgcaactgccgtctccccttctcccgcgtcgccgccaccgccggtcgcccgtcgtcggccgtcgacaccctcctgctctcccgcctcaccccgcggcctcctctccactcgccgtccggcctgcagaatcccagtgagaagagtgaggagagagaggaagggagagaagaggagaaagagggagggtgatgacgtggacaccctgacttgtggggctcacatggtttactcagccgtaacgttggataaaattgggtcaaaatcactaaagaatctaaaataaaataaatggtttcgtagttgaggggtatcgtatatagttttgtggttagaggatgattttgcaactcgatgacaagttaagggacattcggtgtactttttcctaactgctatagtagggagcttttagcccatctgcatatagtggcctggcccacgttaggcctgtccattagtatgggccttagcccttcctctttaccgaaagcttcaccttttgaattgagcccatatgaacaataagacactatccatgttatttccttaaagataatagaattcattttagtctttacttttttaaaagaaactataaccaattatatagaggttacagaacgaacgatcatgaattacgaaattatagcttgatttaaaggaataattaaaatcgcaccattgatgtctatacatttcaatctttaatttctcggcacagtcgcatgcactcgcgttgcctcccaaaaagctcaaacagtttttgatttcgacatgcatagatacaagttgtggacaacttattcaggtacagtgcttacgtagttcaagatttctttatgacctgctttttttcttgttaattatggccttaatttgatactagtatatatcaagtggttcgcaacgcaagcaaactaaagttgcaatcacgcgggaaaagcagcaatgctgaaatagctagctagttagctttcacaattctgaaactattttctcctcttcttctgttcataatgtacggacacgactgtgagtgtcagagtgtcggcacaacaatttgattaatgatgcataggagaatgttttatgttgagcatgtaaattgttgaatacttccagtcggagaatgtttgatgttgagcatgtaaattgttgaatacttccacattaatatgcacgtagtatgggattaaaagcaacacaatggaaaacaaatttcggtatggtatatccttccccatatgtcttgagaatatgagataagtttagttaattaattaatttggttttacagatggaataaaatgaaaatatacgttaatatttgcatgcatgggttatatttgaattataacctgtgaaacagaaaaataacttttttttaagtacataataataggatctactatgggtttaatggattcgtgccggccggtttgcgcaaaccggcccagttgcccccgggtagcctacgcgttgtaggcttgcaactttttgcgagttggactaaaaaattggcttacagcttttaccccacctggcccatatccagcacacatacctttaaaaatttctatatataaagtttttatacagaaactaagtttctactaaaacgtcgtagctaaatcagaattggatgtgcccgcgtacgtgcattttgaaaatgtttctcaaggaaaactttgtgtataataaagtttctatgtgaaaaaatgtttttgtgtataataagaaatgtaaatacgtgctcctgatagattcacttaagtgacatgcccacgcattagacttttactaatagagtgcgtatgacacgatagtcattaagtcttttttaaaaattcttttattcagttttatctacaactaaaatctaatgctgactttcctcggaaaacaatcgagacttttcagttttgctgttctggagttgtacgcttcctctacaaacgaaatggagccaattcttctgcctgttttctttttcgcgaacgctgcctgttttttttactagcccctaaaatggatgatcaatcgtaccaacaaaataatacttcccccgtttcagaatataagtcattttagcattttctacatacatattgatgttaatgaatctaaacatatatatctatttagattcactaacatcaatatgaatgtgaataatgctagaatgacttacattgtgcaacggagggagtaaaccctaaggcacgttattgcatcatcgacaattaatcattattatattatgtccgactcgttacatacgacagatgatgtgattaattagaactgcaatttgcaaaataacaattaccacatctttaacgtattcttccatttaagtagcttagttcactaattgtaattaagcgctaactaaccatttggccagtgtactggtaattactaaattaaggagattatgatcaagttgtaaaaggatccaataaaacgattacttattagaactctaattaacctgttcaacctaaccttgtcattattttggtttggagtttgtgttgtctagcgtgattaatcacgcgtgtaatgtgcgagagctgcaacttaacgaatcttgtctcgttgtcattggccagagtcagaattaaacacagacgtgcatttgggtttttgctgtgttaatttgtcataagattcaccaaatggttcaattctcacttttgctctgttcacgagtctgtctcttccatagctcatgaatgccagggcggcagggcatcttcatctcattcatcaactgacgaaagtagtacgtatgatcagtcgaccaaattgtttgcaaatcttaatttgggggtaatgtagttcatgcctatacctatattcgcttttcactagatatttcagagagagagagagagagagtgatttagagggaggggcattcctctatacattttttaaaaaaggaaattgtgattgtgttggggattgaacacgggaccgtagtgttgaaactacatactccttaccactgcactgccaattgcatctcattggatatttctgttattcagagatggaatacagaattgtgtcactagtatcatttgcatatcaaattatcaatgccaagttgcagtgccaacttttgtatgtgcaagcaacagatcttggcataaatcatcacgaggaagataatattccaagtttcgcattctgaaacctagatatataaatgtctgtaacttactagcttaggccggtggttgtcgaataaattaattctttgttgagcatcgcaagggagtgtgtggggtatgatgaaatcaaattcatggctaggaatatataggacttaggaggatccttccatggccaaattgtgcattgtcaggacatgcttttcatagctgtagatggagctttcatccatgtttttcaaagagcaattagcaagcaagacaggatccaagaccacagaattggattaagctacggccactagcgaattggccatgcattcatatnnnnnnnnnnnnnnnnnnnnnnnntgctgttgagatattgtgagcaattaaccagatcgatgttgcgcatgcgtgactgtgacctttctagtaggaactccacttcacccacccactaaagcaaaattacttctttttttggtttagcagaatcttgggctttaacaattgcacgagtaattattccaagcggttactgattactgggcaaggagatatcagcagcgtgcttggggaaataatgagatgtatgctaagatggacacagaaatggagagtagcctagtgcaaatgagtgacattggactatttatataaaacaaatgttcttgtaggaagatgaaatggatggtaggaatcgcaagaaattaaacttacgacatctggaaagattaattggaagtttccgacactcaattgcaccctacataacagttagtgtagaatggaatggggagaacaccacacacccaatgggaggggtggccatgtattaatataggaagcacatgtacaggatcctcaattagaggagaatacaaggaaagaaacaatacaatacaatctgtacatatatggcaaagtattcctaatacccgcccgcagtcacagcgggaggatcacggatgcaaaggctggatcgaaaatctgtaaataactgcacaggcaagcccttggtcatgatatcggcgaactgatgcgtagatggaacatggagcacacggacctgtcccagagccaccttttcccgaacaaagtggatgtcgatctcaatgtgcttggtgcggcggtggcgaaccgggttggcggtcatgtagatagcactgacgttgttgcaaaagacaatggtcgtggtggagatgggagcatgcaactcctggattagctagcggagccaacagcactcgacaaccgcgtgagcaacgacacgatactccgctttagcactggagcgggagatcgtcgtctgtcgcttggaggaccaagacaccaggttatcaccgaggaagatgcagtagcctgaggtggagcgacgagagtcggggcagccggcccagtctgcgtcggagtaggcggtcagagacccgaccggaccggtgccgatgtggaggccggcggagagtgagcccttgatgtagcgcaggatgcgtttaaccaaggcgagttgaggctcgcgagggtcatgcataaaaagacacttgttgaacggcataggcgatcttaggacgggtgagggtgagatactggagggcaccggcgaggctcttgtactcagtaggatcggcaacgggggcaccctccgaggcggagagcttggcgcgagtatcgactggggtggcggtggggtggcattcagacatgccggctcgctgcaggagatcgacggcgtactgtagctgggacaggaagaggccgtcgggtgtgcgacagacggagatgccgaggaagaagtggaggtcaccaagatccgtcatggcgaactcggtgtgcaaccgagccgtgatgtggcgaagaagctcagcggaggaggccgtgaggatgatgtcgtcgacgtagagcagcaggtaggcgaggcgatcaccgtcccggaggatgaagagcgatgtgtcggaggccgatggcgtgaaacccagctgacgaatgtatgtagcgtagcgaaccattggtaccaagctcgaggcgcttgcttgaggccgtagagggagcgctggaggaggcccacagcatcgggagcaacggggtcgatgaagccggacggctactggcaatacaccgtctcgtcgagggtgccgtggaggaaagcgttcttcacatcaagttgatgaatcggccaggagcgggaggtggcgatgctgaggacgacacgaatggtagagggcttgacgatggggctgaaggtctcgtcgtagtcgatgccatgttgttgggagtagccacgaacaacccaacgtgccttgtgacgggcgagcgagccatcggagtggaacttgtgcttgaagatccacttgccggtaatgacgtttgcaccaggtgggcgagggacgagccgccacgtgccgttgttgatcaaagccttgaactctttggccatggctgcacgccagttggggttggcgagggtagagcggtagttggccggcagtggagaaatggccgagagcacgactcgatccactggcttgagagaactggtcttggagcgtgtcaccatggtgtggacctgtgggggaggtgtgggtgcagccggagcgacaacttggggcggaggagtcggcgccggtcatcgttggtagtggtacgggaatggcgccactgtgccggctggtcatgaagaagacgtggacggccggatagctggtgacgacggtgccctgcttgaggaagatggagacatggcagccggctgtgtggaacttgccgtcgtcccgcccgtagtgtgatgcggctgcacgtagtagggcaggtgctcgtcctcagccaagggagcacccgtgggcagccactgctcgacgttcacagggaatggagcgtgcggcaggtgcggctgctcaacaccagctagtggtggagcgaccacagagggagcaggagcatcctgcagtagaaaatccaaagaggaagcatcgacgagatctcccgaaaatggaaactgtgtctcatcaaaaatgacatggcgcgaaataatgatgcggcaggtggatatgttgaggcagcgataacctttgtgcgaggaggggtagcccaaaaagacgcaagcagcggagcggggtgcaagtttgtgggcagcggtggcactaaggttaggatagcataaacacccaaacgctcgtaacatggaataattgggaatcttgcgatgaagaagctggaatgggattgagttgtttaccgaggacgagggtcgacagttcaggaggtatgtggcggtggctagaccttcggcccaataggagggtggcatggaggcttgtaggaggagggtacggacggagttgttgagggtgcgaatcatgcgttcggccttgccgttctgcggggaagtatatggacaggagagccgtaacagggaacctctaccagcgagaaaggaggtggtgttgtgattaacaaactcggtaccgttgtcggcttggagacacttgaggcggtggccgaactatgtgtgggtatactcaacgaactcaacaatatggcgatgaacatcggatttgtggcaaagaggaaacgtctagcaaaaatgagtaaaatcatcaaccaacactaaataaaatttgaagcctgaaatgctcataacgggagaagtccatacatcacagtgcacaagttcaaaaggagaagaggtactggaggtggacttattaaaaggaagacgagtgtgtttccctaactgacaagcatggcaaagggaattatttgtcttggagcgaggtatggcggataaatgttggagagtggtgacggcggttggacccggatgaccgaggcggcgatgccataacgtggaggaggtggcgaggttgcagtgcgctgcaatggaaggtgcagcggtcgggagggtgtagagctcgccatggctattgcaatgaagaatcacgcgccgggtccgagggtccttaatagaaaaaccaaactcgtcaaactcaatggaacatttattgccacgagtaaattggcgaacggagagtaaattgcgaaccaaagagggagcaacaagaacatgacgaaggtcaaatctagtggtgccaatagggagaaaggaagtgccacggcaaacaaccggaatggagtgaccattactaacggtaatataagtttgtgagttggggaggcgagtaacgagtataccgtcggtggaggacatgtgcgaagtggcacccgtgtcgagaacccacgagttggggttgtgaagcgttattccattgagagcggcgacaaggctggcttggtcccaagccggctggacagaccctgcagacggtggcgaggagtatggcccggcgaaggtagtgtgagcctgaggatacggcccaagtatctcggcgctgggagcacgccagggttgctgctgtcctgcctagggcgagaagcacacccatggtgcagcttggcatggagcaggggcagagaaagtgctggtgccaaagctgttgctgccgttgttctgtccaccagggcgtccgccgaatccaccgccgccgttgccgccggagttgcggttgttgttgtggccgccgttcttgcccttgttcttgccgctgttgccgccgccggcgcagttctgctgctgcccaccgctgccagaggagtggcaagtgcccccggtgcagttggagtgggcgttgttggctgcgacgagggcagtctcggactggacttgtaccgagttggcgttgcgaagctccttgagaactagtgtgttcctcgcagaggcgaaggacggcaagacaggggcgctcgcgatgttgtcggccgtgctggtgaagcgcgagttgacgccgcggaggaggttgaggacgagctgggactcggtgacggggtggccgacgtcgtggagggcatcagccaccgtcttcatgcgctgacaatagtcggcgacggagagatcgccttgggtcatggagtggaactcgtgatgcagatagatcgcgcgaggctccttgttggcttgaaagaggttgtcgatggtgatccacaagtcctgggccgattgattaggctccatggcgaggtcgaggacatcgtcggcgacggagccgaagagctagctgcagaggcagcaatcggcctgttcccaggcggcgtcggggttggtgggaggagcagcgtcaagatgatcgaggagaccgaatttcccacgcatcgagcggaagaaggccttccacttgttgtagttggggttacgaagctcgagggagatcggaacatgggacttgacggcgatggtcacatacgggttgacgaaaaccggggcgacggtagaggtggaagatgacaccgtagcggagtcggtggcagcggaagtagccgaggaagtggatatggtgagggaagtggggcgcggcagccagggaggcggcgatgctcggtggacgcagcgaccagagaggaagcagcactagagcagcggaagaggagaagaaaacttagaatctgataccatgtagaatggaatggggagaacaccacacacccaatgggaggggtgaccatgtattaatataggaaggacatgtacaggatcctcaattagaggagaatacaaggaaagaaacaatacaatccaatctgtacatatatggcaaagtattcctaatagtttgtactgaccaaatcaagtcagtgtggtcatatgcatgcaggcatgttggagtaaaaaagaaattaattgtcagtataacagcgtgtgcattgactgagtagttgcaatttacccaagtattgtcacattgtgacaatcacaagtagtaatgactaattaacagtggaccaaattaaaccgtgttccgcggctcattccttaatctgaagctagctaggtaaggttgttcttcctttgcaggcaggcagaggaatatatggcacattcagaaaggtgagatcgatgccacgcattcatgcagacacatcaatagatagatagatagatgtacacgcacgatcgactcacacacacggttcaaagaggcacatccattcatcagtcgaagtctgaaaaggaatcatcagtcgttgctgcatcatatcatatcatcggttattcagagaccagaggagtatatataagcaggtgaggccggcaatgacgtggtcagcactgacgagtcgagcactacatctctcgtccaacgccaaactctctctctctctctctctctctctctgcagatagataggtagatccgatcgcggcgaggaagatcgatgagtcggatacacccttcgtatcaacgccaagatgccgccgccgccgccgcctcaacggcagcgccgcgagcggcggtgtacacggtgtggaagaggtccagcatggggttccagggcaccgacggcttctccgtctacgacgacgccggcagcctcgccttccgtgttgacaactactcgcgccgccgcaagctcttctccggcgacctgctgctcatggatggacatggctcgcctctcctcgccctcaccccacaggtacacttgtctctgatcttctagtcattcatgattcatccactgcaaaaatcttgcatttgcatctcagattaattaattaattaattaattacctcctataggctatattcatgcatctttgtctttgtgattgtatactagtattacctaacacctgacaatcagtataatatttacgtacggtttcggtcgatatattgagttagctattagcattcatgaacgatcgtcgatcgatcatcaattcttcatacattcaaccagcaatcgtttatattctgctcgtcaatcatcctcatccgaatgtagacttcattttacatatcttctctcaagatatagaacgatcaccaagtttgcttccaaaacttcactgaagacttctaaatactgcaaatcctgctttgccgagagccccgagactagtgtttcgtccatctacccgatctttcatcttctcgatttttttaaaaaatgtatctccaggctttcactgtttcctcaaaatattcaccaaatcacaagtatatatgtttgtcttgtctatttgtctcacaaatactaaaagataccatagctcaccaaaaagatttaaggcaaattatcatgcatgccgacggtttttaggcaaatgctatcaactacctccactaatacatctagctaggaaaataattagtctaaacacttgcagacaaaatcagctgaccaaagattaaaattcattgctttcatcgttccagcctcggttattttgatgctgttctgctttaatttgcccaaaatcccatacagagttaaaaacaaaacttaaaaaatggagaagttacatacagagtttgatttatccgctagttcattctactttccgactgaagttcttttacctcttgttacaagtgcagcagatgggccaaaagaacagaaaccattaatagaacccatggggagtaagtaagaactaagatttttattttcctttctgctgttgcaacagattatcagcatgcatgaccaatggaattgttacagagcgtcagaagaaggccaaggcaagagggcaagatcacaacaactcttctcaatgagaaaatgctcagttatgcaaagcagtcatgaagcagaagtgcacatgtcaggatgtacccatgcgtcgtcagatcgtactggccatgttcccgccttctcaatcgagggcagtttcaagagaagaagctgcaagatccgcaacagcggcggtgaggaggtcgcaaggataacgaggaagaaagctggagcagcatcattgtcactgactcttgctgaagatgttttcagtcttgaggtccaaccgaatgtagattgtgcgatgatcatggctttcgtcattgttctggatcggatctgctggaagccatacacacctatgatctgttcttcatagttcaaggtgatgagctctatttgacatgtaggaaatagatgtttcaattcaagtgaaatcgacgaattaactcaagaagctagtatgagactgtagtcactaattgtactgtcgattgactgggactaacataacatgtaacttgttctaaatttgactacttatgaaaggaagatcgaattagcagattgaatcaaaatctcttgcttcctcctactgcaacttgaaatgtatgtttcttttcccatgtggttctttcaatccacttgttaccaactgtgagctgttaccaactgtttgggcagtatcattttaatgctatccacctagaagcaccataagaacaaagcactattcatgcccaggacaatgcaaaggacaaaagtgaccaaagtttgttgaatcctaaaagagaaatgctcaaaataatagaatcaagatataagcaatgacttcagctacctttagcagtataaagcaagttgggtatactcacactgaagaagaggcaaaactagtgtcctccacgaagagagagccggagaaggagatggtgggtatccatgcttacgtgttactcaatttcttcaaaccagcacttcgtgtttcatttgcattgtacttgtgcttaagatttgcagtccctctcagaaagattcgaaagatattgacaatatactgcaataagacagcgttagtttactaagaaagttttgtttataccaaatattagaacaataaatagtatggacaaatcccaaggaatattacaaacaacttatttgtcttatactcaccagtctttatttatttaagccacttttgatttgtttgctagatgcataaacaaacaaagcatgaaagcaatatggtaataacacatatatatggttattaatacggagttgacagaaggaataaaatggtttctcatcagcaaggaacaacttaacagctaagtatataaattgaaattaatagtttgaacaaggtggaacaaattttagcaactctgcagaaatcattgtttgacttttgcaaaatctaagtcttctatctaacttctgatcactaaagacggaaccgcgacaaaaaagttaaggatgcacggaaggcccattggtatattcacaagttcacataatgcattctggaagcgacatgcacaggatacattctccaccatgagaaaatcccctgtgtacccttgaaagttcacctaatcccttctgtacccctgaattttgctcaatcccttacatacccctgaattttagtttggatctcttccataccctttccactagttgaccgttagttgaccgttaaattcttatgaaaaagtccattttgccctttggtataaagaagcatataaattaatagagtatattgttggagcatagaaatttgttatatgagactattatgtttatgagatagttatgcaccatattatttgcgataaatatacttttagatatgacataaaaaattaatacttatttattagttattaaaagattttttttagcatgtgttttgaagtaataaacaaatctgttgtattactatgaaaacacatatgctacataaaagaacttttaataactaataataaataagtatcaactttttatatcatatgtaaaagtaaatttgtcacaaataatatggtgcatcacatactcataaatataatagtcccatccaataaatttttacattccaacaatatacttcattaatttattatgtttcttcatagcaaagggcaaaatggactttttcaaaagaatttaacggtcaactaacggtcaactagcggaaagggcatggaagggatccaaactaaaattcaagggtttgtaagggattgagcaaaattcaggggtatagaagggattaggtgaactttcatgggtgcacaggatacattctccaccatttaagggttcctttggaagacagaaactattcaggaactttacatgaagcaattcatttcccgcatggatcaagaaataaagtcccatgttgcagtggtcatctcaacaaaaaaaaaatccataatacctcgtattatacccccaaaagctacataaacagtactgacacagcttttactcatatgcattatattctgacatgatatatttcagatttcaaaagaatgcccttcgaatagggctggtgtgatccgtactacttggtttatcatttacagaagtgttctttgtacctaatacattgagcatctacaaaggaataaacatattatctggcagtaaaatatgtacacaatgcaaaataaatgagatgaaaataaggagttcaatattactaagtaacggctacacatatattacaacagaatatcaggtagtatgcacaatacgattagtatgatcatctgatataaaaacacaacaaatcagtgtaatatgtaaaatgcagctgtgaagctagctgaatgctagaggaatagtgaaatccacacaaagttaagtagtatacatagacattttctaggagaaaagagcacgatattctttggcttcttgggccatttcttccatcgttctatcttttctttcaatatccaggtctaatgtctcgttttttgcattcatctgttatgaacagagagattattcagatttatttgatggagtatcagatgaagtgagagttgttccaagcagcatcactaaccatgccattattgttatcattgttctcaaaatcttccttccttcggggaacgatgtgaacgtgaacatgtggaactgtttggccagagtgaggtccgtcctgataagtagcaatatttattcaacttcatatcatacacaatagaagataaagttagttttcattagcttttacaacttttcattaaaaaatgttacgaacatactaaattgtgatctgaaaccacaattttgtgagcaacatcatacttgtcatgctcacacgaattttagctataatatttcttaaattcaaagtgaaagacctcacaggtacaagataaatcgaacctgaattgtgaatgtgagcgaagaagccctctggtactgctcaacacgtacaccaatatcctttgccatgatccacaaatcacgagtctcatcagggctaagatcagcaaatagtttcacaagactctttgggcatataagaacatgtataatttaagttaaggaagggggtgggggggggagttaaaagtcttaggctgtcaaaaatgcagtgccacatacaatccatcataggacaaaggcaacaagagctgagttgccagttgtcaccagggattaactgaagtaattagcacgaccagaaattaacaaggtaaagcaggtagtattaattgtcttgaaatagaaagcacaataacccttctgaaggcaaaaacaagtgagcactgtgatgtacaccactaccatttttcaatgaaccgatatcgtacattacttatgtagttcagtgcagagtctttctttctttcctttttttttctttttgaaacagaggcacatttcattgatgaatagcaagagaagttttttttttttgcaaataataataataataataataataataataataataataataataataataataataataataataataataataataaagtatgagaagttgagagcagataataccgcaatgtgaagtagatactagaaggcactaaattagagagaggagtagagcagctgtgcatacacataattggcagaaataaaggatatgacctgcagggacaagattggaatagaatgatgaacaaacaaagaaggagagagcaatcaggaatgatagatttgttctgaggagaggagaggagaggagaggagaggaaatagctaggtaccagggcgggtgggtcggaggttgacgatggcgaaggagaggggcgaggtgcggaacacctgccgctcggctatctcgtgcggaccaaacctgtacctgcttcccgcgaccggatccatctccttttcccctcttcttggacggcgacggcgatggagagggagaagaggaagcagcagagaagcagctgagttgcgttgggtctaattaattgtcaatggttgtggaactgaggggccgggtcaagtcaagtcaatgatcttgatgggctcccctcccacggtagaagccaggcaagcccatcagaaatactacgtactattcaaatcaggcccattaattgttgtcactttctctatctgaattggtcagcctgcttgtgctttgaataagtagtagggcgatgcatgcatgccagctccttcacgctaagccaaatcccaatccaacgtgccctgcactatctgtccacaccttcactcccattcgttcctacttgcaaaattaagctgcatgtccttttttttcgccggcccatttcagctgctctcactctcacgcattaataattaacccaatctgcagactgcagtgcaggcaaagctaggcagccacgtacgtccatacgttgcgttgctcatcgattgatcgatcgattagccatctaattggcaaaaccaaatcttgattatttgctagcttcccctagctaacataagctatagcctatagcttcctccctccctctcaaactagcttagttacttccaccagcctcatcaagctatagctagcatgagaaggatacagatacacccctcacatggcggcggcggcggcaccggcggccgtgcacgtcgtcaggcggcagatcagccggtggtgtacacggtgtggaagaggtccagcataggctttcagggcaccgacggcttctccgtctacgactccgccggcaagctcgccttccgtgtcgacaactactcccgccgccgcaaagctttcgccggcgacctgctgctcatggatggccacggcacgcctcttctctctctcaggccacaggtcgatcaccttctcattcacttcattacttcttctctagctctactcgtatacgtatattatatcgctttagcagcgacctgtttactgatcgatcagtttagtttgctagtttggaatcatgtatatatcttaagataggttgggacttgggactagcgcgtctttaattctctttcattcatttctcactttaagtctttcctatcataatctatagacgatggccgtgtgcttactgcttctgctttgctttcagtccaaaaatttagggtacttagataaagaaatttcagggtatacttattagctgcaagatttatataatctatcaaactaacaagatccctattatatacatgcgcatcaagtttaaattctcaacttaaaagattcagtcttattatttgttgctttgatcaaagctttgctgttatattaatcatgcagccaaacatgcattacctattcgaggctggaatccaaccgttggatttacttttgcttaatctcctatgtataaaattatcgctttgcttccttgtttccgttctctgatgatttgattaaaaaaatccagttgtttgagtactccaagtctcaaccgacaaattctactgtactcataatcgtcctaattaactcttaaaaatcttttatgatagatattgaccagtcaaaacaaaggaaaaaaaatctatactagtatgttccatgcgtcattctctataataattgaaagatattgtactactgataaaaacatttaattaattttagtctattgagtaggccgacatgtccaagcaaaatgtaaccaaatccaaaaacaagcaaacaaaatgcttgtatcataataacatgttatatattgtttttcaacctttatgtgcttcacattagatctctccatttgcaacttgcaattttcagttaagtgacaaagaagtaataaaagaaacatgatctgcatgattcgttgtcaacttttcttcagccgctatttttgaactaagcaatgtaaaaaacagataatcagcgtaaattaaaaactaatcttcattgctctaatgtgacagattctcagcctgcacaatcgatggaactgttacagagcacaagaggaagaaggcttggacagcacaagttctccttcagtgtcacagcagcaagtcttctccatgaggaagagctcagctctgcagagcaacgatgaagcagaagttttcatgtcaacaagaacaagtggtgacagccaacctgatgcttctcccagccccagcttcagaatcgacggctgcttctccatgaggagctgcaagatccgcggcagcaacggcgaggaggcggcgcggatcacgaggaagaacgccggcgtgatgtccagaccggtcagtctcggcgacgacgtgttcaccctcgtcgtcaggccaggcgtcgatgttgcggtcgtcatggctatggtcgttgtcatggaccgtatctgccggaggccctacacaccaatggcgtgttcatcatctggaaattcagtagttcatagtggagaaatcatcaaatccaaggaaaaataccatctaaaccgcagtagtagtagtttgctgtaaattttatatattgcagctgagatgtaactaaggttgtgctaaattttgtgtatttgcaactatttcacatgaagaaaatttgcgaaaagttcaggctttataaagagtacataatgtgagtatgtgacctcagagtgcacatttctagcaagagaacgacaagcacttgctattctgagtggatacctgaggcactatattttttgccgaaagaactacttttgcatttgcagatgagaatctcctgctgatggagatgaagcatgcatactacctaggagtatatattccagcgaatatttgcaacaacgtactcaacacaacaatagcctctaagcagcagagacaaccagtggttggtatgcaagccaagcaaaccaggtcacacgactacgacagaagcttacttggtgttgattacctagtacaccggcaacaatcccagccaacaagtgaggggctccagatagcttaccgttaccaaatcctcaggtctggtgcaacagtcacatcccacttcagaacacaaccagccaaattgccaatcaaattgttctttaccacttgtcaaaggtagctacaggcgtatcaaaattgcaacttatggcatatatgcataatcaataattctgttcagtgcatcttatcatctcaatggccctcttgatagcaagcatgatgcaaagatgaaaatgaccaaaagtgctcaagtcccagaaaaaaaatcagcaaaaagagattaagatctaaccagttatttgagctatcttccagaatgtatatgcgtaaagcaagcacaagagttaacaatggagactaatcaaaatcagagcctcttatgttctaataacattagattaaatgggattgatggaacagtcccttaaccaaagaaaagttcacaggaggcaaaaacaagcagcaaaaagggtaaaaaccatggttcatgtttttcagaaacataaagactacactacacaatgatacaaaattaaagtagtattttcatggttcaatcagatcattaaagttttcatgatcttatcagaaaagtgcgccagaatgatataaagtttagccaggattacagccattggccacaaattgccagaattattgtattaatgagtcaggttaacttttcgaatgttggctagatgcatagactaacagtaatggtagatttcatggacagtcggcagaaggaataaaaactttgagtcggcacaaagagctagatagaaagttgagtcatgatccatcctgtctaacaaactttcagctactatgccttgtcgaatttctggcttttctcacaacaaaacatgccaaaaacagaatttatcgcagcaatctgcataagcataagagaacaaactttctaactagcatgatcaaaggaacaaaatactgtgtctgaataactaaagagcaacggaaatctcaagaaaagtcaatttttcagctgaaactaaatgcaatgggttgatagcatggattgcaactctgtttgatccaaaagaccaaaagaatgatccttctttcttttaagcaggctttcaaataggtactgaaaggttatacgatgggttttgttactatttgtagattgtgaaaccatagtatgacccaaccagctactgataatatatggctgtgtaatttcatgtggtacagggacatctgtcataaaaatataaattttccaacaaacaactactgccacacggtggcataactagttccaaagataaagatttataagtaagaacacattttacaacaaacaagtatcacaccaaattagataatttcataatattattcgaagacttgaattcccatgatggatgacaaacagttacaaaaataatttctggagaagagagtgcaatttagagacagtttacaagaaagttatcgcaaaaatacatctaagagaagagagcacggtactcattggcctcatgagccatttcttccatggttctatcttttctctctatgtccagatcaagtttctccttcaattccctctctttgacatcaatctattagaaagcaaacaagtaagaattttgtggtaaatattgggttgaagtattggataaaaggaggtcgattgagaaaaatgccacaaaccgcatcatatatctcatcatttttctcaaaatctcctttctttctagggatgacatggatgtggacatgtgaaacagtttgaccagcttctggaccatcctgtaagcactggaactaatgagtaaatagcttaatattattatataagaaaataattcaagacagacatgcaaagttatatctagggtaaatgataaaaaggaagttaagaatacttgtatggggaaacgaattcttttttattctacacacaataagatcatcatatttaggacgcaataagcaaaacccatatggtactcctcttgatggtatgattaaacattgaaataattaaaatacaaactcctgctaaccgcagtggcataaatacatagaccttacctgaatagcaaatgtaagtgaagacgctttgtggtactgctcaagccgtacaccaacttcctttgcggtaacccataagtcactagtctcattagaacttagatcagcaaatcgtttcacttcacgcttggggcacactagaacatttatatattgttaagggaaaacaacatataagatatatcatattctcaatataccacagtagaaatcaaaagaagatggttaaccaataaatttatggaagatttgctcgacacggcagtacaattgacagttactccatatcaatcacaaccaagtagcagataaatactacatatggacatcatctcatggtaaagatgacatcctctaagatgatcaatcaagtaagatgacatgtggcaaaataaacacctacatcacctcttcagccaatccacaaaattgtccttaagccagacttgatatttgtcaagtatagaagaagggtaaaccaacacaatcctttcatgaataaataaattccacaggtccatttatttactattaatttgaatgcattgatgaaactttacccaaacacaagccagcaaaagcaagctcattttatcgacgaccccaacagaactagctagcagtgcatgcacgtgaaagaaatcaactgtgattctgtaaatatctccaaaacagcgttttgcagaaaaagtagcagtctcttttggtgcaattgaaggatatgacctgcacaataaggaacggtatggttaagaaagaatagcagaatatgaaccaaccaatatatagcaataggaattaaatgcatgcagcaacagcaaggtcaaagttgacggaatcgcatatggtatagtggtgaaatggtactgtattaaggtgaatctgttaggtagaagaagagatcaattgcagaaaaacactactatatgtgaacagactactccctccgtttcacaatgtaagttattctagcatttctcacatttatattgatgttaatgaatttagacatatatacctatctagattcattaacatcaatatgaatgtgggaaatactaaaaatgacttacattgtgaaacggaggaagtagctagtatctgcgtgtacattgtgcttgttaagcgtgttcaagaaaacaaaaacgtgcttgttagcatttggcaggtaccgtatgattcgcgaactggtcatcaaacaaattagcaatggcaagctacaaaacccgtctctgtaatttccgctacaaattttgggactgtactatggtactactcctactgagcaaggggaacggaggcggctggagggaataaagcgatcaagtggtaaaactgggcaaggggaagtgaggaggttattaccagggaggagtgggcggaggttgaccatggcgtaggagagcggggtggagtggaacacctccctcgcgtcgatcttgtacggcccgaacttgtaagccgcctccatctcctggaccggcggcggcgaggaagaggaggagatggctcgcggcagaagcagtggacgacggcgaagaagggtaggaggcggaggcggagcgagagggagagggagaagggagaagggagtgggcgcgcggcggaggacggcggagagcgccggaagcatcagctgccgtctcgtcggcgaacgaatcgacggaggagaggaaagcaatgtagagttgttctgggcctaaaattaaggtgggcctgcatttttacggcccatctgagcccatgttgttgtctggaccggtccaaagctgagtggtgctaatactcctactttagccctctttgtttagacttagacttattggattagacttttaagtcagcttattggcttatatgatttataagccggtggatttaatgtcctaagtttagtggtagagtcatacatcaacctcacataagccaaaaaagcttctccaacctagcatttggcttaatagtgttagagtggcttatggcttcaaaaaaaccaaacaaataagctgcttgtttgtttaggcttacaccttttggcttataagttgacctataagcctaaacaaatagggccttcaaataggctcacccaaaaaaaaatgcaccgtgatgaaaatgtaatcatgtcaggttgacttgctgaaaaaagtgaagtggatagagtgatgagagtggatgaactaaataatcattttgacttttgctctgaccaaaatcattaaactaagagtatacatatatggagctagccagcatccactgcctgaacgaataggagttgtcatgcaaatccactgcaaatttaagtgaagtgatgatcgatcatgtgcgtactttctaaagtagtttgtgtcatggatatgaatatgatgcatgcacctgtgaccgaaaagctaccttcactttgcaggcatatattggcattgtttggtgacttgacattaaacaagttgctgcatgctcatcagctttgaaggagtaagagataagtcaatctacaaaggtgtttatacatatatttttgtttatcttcaattgttcatggtagtgcttgctgcgtaggttttgcaatgatcgcctgattattattaatctatctatgtactctctctctctctctctcactacctacttgcacggatcaatcgctgtttgacttcatttgatgagataatactaatgaactagtgcaagatagtgttcagtcaacagcaatggagataatactatttttatgaccttgttcaaaggtttgtaattttccattaagctagtgtttacaaagcaaaccactatatatgtgcacttgttacttagagcaatctagctagctagtgttatcatatcatattccaaaatccttaaatcaggttagatacaacagaaacaaaaacaaattcagaaagctgccagcacaacaaccacaattattttttactagctacgatcagttgtgttatccaaaccaaagtactagtataacatttcaggctttcagcatatatatgcttgctacacctgtatccccatttttgccctgaaacaaacaggaagtactaaacatgatagtatggcttctagcctaattgcactgtaatcggaatgataggggtgaactgtgcaagcacatgtacgtagcatgtagtagcaatataacctgaaagttgtggaaaagctatatattgggacattgcagcttcactgccactactgatcgatcatcacaaccgaaaaagaaaagattttgctggatatttaactatatacactcagctaagctggagtgaccacatgggccagtttggatggtgtgcttttgatgatgttatgtattccctcccaaacctgcaagctgcatgcatgcctattctgtgtcttaagcaccttggacaagcaactaattgaacagctcgcacagagcaatcggcaattgcaacattccaaattaggcctggtttagttccaactttttctttaaactttcaactttttcatcacatcaaaacttttctacatacacaaacttccaacttttccgtcacatcattccaattttaactaaacttctaattttgacgtgaactaaacacacccatatcaacaatgaatcaaagttgtccatatgcatgcatgacctagaaaatgccaagatctctgcaagagacagcccccgtgcagtccaaaatcaatctagctttaagctacagttagagtttgggttaatttgtttggtagcgaaatatcattcgaccatgacatgcatgtggcgaaccatgcatatgcagtttgcaaaaaagatagctacatagcgtggatggaatacttcaaaagcatatcaaaacgatacgatatgcatggtgtttcagtactacaatctttcaagaggaaaaacaaaaacttcatgtgggggcagggagctgcagatgcgtgcctcttcacttccagagaaaactaatggtatgtcagttttaggagctaatacacactgccattacatgtgttatgataaggattttaagccgtttgcgaagacaatttaggtactgctccctctaggttaatactaatacttattgttttgagagaaaaacacggtctaaaacacaacttcagtcactgttttatattataatctatatagaaaaattattaaatatatgattttatatatgatgttattataatatacctagtcttcatatttataagataaatattttaaaaattatttatagttaaaaaaatttataatttgataccaaactcattcaaaacaataaatatcactctctccgtcctaaaatataagaatctagtatcagatataatattttctagtactacgaatctatattagaaaatatcccatctagttttacgtttttttatattttgagataaagggagtatcaacgagagatgtatgcttagcaaagcacatgacttgagtgatcagacacacatgaacgaaattgttaggtaactgtctccatctttgccttcaacacaggcatgcagccagtgtatagaaggagaagaaccctgcttttgccccccttgcagaggaacaagctatccaggatatactattgtcgaactccattccaatgtctacccactagtatatgttaactggatcatatcgagaaggcaattagttaacatactgccaagagttgcacatgcatacttcatatatacaccttctggttacttcatgtgtctgagttctctgaatttgcttaacccatacatatcattggactccggttaattacctcgaactttgtagccaccccaccccttgcatcgatccgcatctggtatttataagatttagggtttattcggatcagagtaatttcacaggatttttggaggaatactgtacataggaattttttccttttttttattcggatcatgaaaactggttgtaagaaatccaaagtaaagtttcctttgatgctgatttcacaggaaaagtacaggaaaaatccatccaccttgagctcattttttgcttcctgcatgcaaatcctaggcaatcaatttcctgtgatccgaatgctatcaacttttgtattcctttgttattcattcctctgttttacacttagggcctctttgaatcgcatgattgagaaaacgtaggaataggaaaaacgtaggattttgataggaatgtaagtgtaaaacagaggattgtaaaacacaggaaaaacacaggaattggatgagagatatagactcaaaggaaaattagcaagaggttgaagctcttgttaaatttcctccaaaatctctataggattgtccattctataggaatttcaaaggattagataggattcaatcctttgattcaaagggcttcataggaaattttcctataggattgaaatcctctaaaattcgtatgtttttcctccaaatcaaaggggcccttagattcctttcatattcctatacttttcctatctatgtttttcctatcctataatccgaacaagcccttaatgtctatacatacaaaatgagtatatatgttgcaccgatcaagcatgtaaggcatatattgtaaaatcaaaggtgttttttattattattttgtgatgaacaattggcattggagattatcagtttagatatttggaatttatttgcgaagtggttttggagatgattggatttcataggtgatatacaggtactgtgctggattgggtacggtcacaccgggcacgggttgccggtcagaccggcgtgtatctcgcggtcagaccggcgtagcccacggtatgaccggccgactctgtgtcagtttcggtttcgggttgtttgtttggatatccgtgattgtttcatgattatgacttctagacggatattatgtgtatgaatattatcgtttgctactaatgagtcaagttggggatagcttggtctcggaatatggtttctttctttgttctatgtgtaggtgactcgagatgtcgggagagtatttgcggtgatggaccgggagtcggcttggggataagacgacgtccgtagtggtcagagatcatgcgggatactaaggctagagttcaatacacgtggttggtgaagattccatatggcatacgatggaggtattgtgtgtgaatgggatgcagagtcgaatttggaaggagtccaaatttggtatgattggttatgtaaagtttgtttcttgtactagagggtttcctagggtgattaggacttctagtatgagtttggttcgtggctttaggctgcctatctcgggtataaatagagggggagtgtgaggcttcccagtatcgcttttgagagcaattgagttgatagttgagttagggtttcgagtttagtcgaaatttttataaggagtgttgttggtgcactttgtaaacccagagagaatcgataaagtcgtcatccactttaagagttcttcgatttgtgtttcaccgggtttcggcgatctaaccggcggcgcaccggcggtcagaccagcggcattgcgccggttagaccggcgtctacgacaggcgacaggagctgatctcggcggtcaaaccggagatacaatctcggtcagactgacggcaaccaggcgatcagaccggcacatctacttcggtcatatcgcgatccgttgaatttgaggtaacttttatttccgagtttcggtttttgggtataccaaccattcaccactctctggttggcttagttgttctgattcgatatatatatatatatatatatatatatgctcatagcaacagcgacagatgctagtgaccatagtatatctcacacgaacaaattagtaaggtatatacgggcaaacatactcaaccgattaacgctagtggaaatataggcatcagcagtttataaagaagaataaataattgtacgcgttattttactatctatattctcaggaatagatgaatagtacatgatagaatagttctcatttgcccaccagtactgcaagtgactctgactacacaatatgtcaattgtcaatattcttccaaatgcatgtaatagtctttagaggttttctttcgtccttgagaggtatatacctctcattgtctgagagctaaaaaaaaataaaccattaaaaagcaagtttatgattggcaataccaataattttcttttatcgtcaccttatagtatatttgttcataggtcagagatatatgagtaattttacggtccttgagaagatacctagatggagtcatagagtatatagtgaaaagcaagtaggctatgttcgatttagatgttagagcaattatagccctatggcttaccggagaagacactccattactgcataattaatatatatagacatttaaaatatattgtttttacaaaaaaaataaagaataaaaagttttttaaaagaaaatcgtactcccttcatctcattttaagtacagccatgattttccgtgtacaattttacccgtccgtcttatttgaaatttttttaaaaaaaataagattcatgttttatcatctcataacagtaaaaatactaattataaaaaaattaaataagacgaataatcaaagttaaacacgaaaatttattattgcactttgaataggatggagagagtactatttagcatttaaaaacgtgcatgtctacgataatatggtagttcagaagcgaaaagaacatatatggctggttggctggctggctagcttattaaccatacgtacgtgtttcgtggacaatatccataaggctcacatggttattttagatgtagaatattctgatctagtagctacttgtgtgaactattcaattgttccaaagtataggatgtccccggcatatctccctgaatcatttcatctgaatcaaagtgaattattttgccagcatatgccggaccagctgctagctgatcatgaagcatttgttctagctagctccaccgtgcatcttccaagatttattttgtgcgcatcttagccaaagaattaggatgaatgtcgtttgttgcaaggacttggatacatccgaaagaatagttacaccttttccccacctacaaatcttgacgagctaatcatattttgggaaaaaaagaagcgttgatcacttgggaatatctgtttttagtttccagtactctagcttcatccatatcaattttcatgtgaaaatactacctcacacgtgtgatttaagagaataaatcacgttaatgtctaattaactttcaaatcaatccgtttcaagatttgtgcttcacaaccttttgcagcaccagcaaactctaacgagctaattggaggtgttcccttgcttagataaatatcctgtataatggcagctcactagtgtgggccagtttgggcccgctgacaatgagggaagctctcgccgtctttcgagtggttaggaggtgtggtgacggatccggcagcgggaacgacgaaggaggatgaagatacgatcaatgaagtccgagaatatggaagatgagggttaggagagagaatggaaggtgaaggcggattttgtggctccataagggtggttgcatgggaacaccagctgatgatgatggagaagatggcagaggggtgacttattatttttcttaagaagggagagggattacgcaatgtatagattgttcttttttttttatccatgttttactgtacatatatacatacaagtcttatcataagtctacgtcacattaataaaacttgggtatagagcatagatcagtatatttattgaaagaaaaacattcgaaaatacaactatataatcagtgctaccaaaatttgtctagatgggtttaaatataaacatatcctatatatacaagtcgtcatatgtacataccatgcatatcaactaataaatatcataaaaaattatacatgcatgtaatttcaatataatatatagtattacatctacgtgtaaattcccatctttaaattcatcgtacatagagaacagcaaaataaacaaaactgacatatttagtcttaaaaatatcagaatttttaatcatggctaaaatataatgaatttaagattaagactttagatgtaacactattgaagtatttcttctttattttttgacatttgttagttagtttacacgtgaaactaatatacacatgatgtgtttccggtttaaatatggtcatttgtacaaataaaggtagatcttaatcggcaacgagaatgaagattagaaggtctaaatataaattagtacaaattatgtgcttagcgaatagcaattaattaagagaaatcaacatgttatcagaatatagcaatatatttgtaaaggcttaaaagattatatttaattagagatgtcgaattgagtacgtagtatgtgggagatgtagtttgacaagccggtgctttggtatttttggcagtaggtcattcaattattatagctttacatgctctttaacaccttagaagactgtgggggaataactttgagttgattgtagaagtaaaagtggattaagtcggtgtgtggctaagtcttagctaggcatgcaaagaatatgttcgtccaccgccgcctatgacgcatatatccatcctgatcttgccgctgccccatgcgtccaaccgagaaaaccggctccttaaaccttaaacaaaagattaaaaaccggtagagatatgcaaataaaatcatcagtcagagaaaaaaatttgtgctagtcaagtgtggtgatgaggttagtttgtcgtgaccgcaagacttctatcgtgacttcgatacattttgatcttgtttctgggagatagaatatacgtgtaaaactgctaaaaaattagtgtacgtttccgggtaaaaagttttaaatataaatataatatactgtaatgtaattacaatataactacattgtaatctctaatgaataaaattatatatttttcagtacttacatacaaacaagttacttcgtatattataagttaattatatactatagaattatcattccgatccctaattaccacgatccattcagatcctacgtggcgctcgcgcgttgcatgccacatggaaacaacagtttatatataaacttcaaacaatatgtttttatttgatattgttaaaaatagattattacaaattttaaaaatagattgattgatattttaaattaactttatatacaagctaaaatctgcatctgatgtacacgcagatgaagatgcgccggcacccaatcccaccacagcgaattaagcggatccaaagctaataatactcgatccgctgttagtgttagccgcgggcgcagcatttgtctgcatcgttcgatcggtttcggcttcattcattcatgtgctcccccctccccgcccacgcactagcggctgccgtccacgcacaaaccacgtaagcacgcaccacctcgcgcggtataaattccccgcgccctccactcattccattccccaaccccaaccattcctatttctaaacaacacacctcctctgcacttgctccttctcttcttctgtccatcgaatcgacaagaagaaatttacaagcaagaatggccgccaaggtgcatcctaacgtcgccgccgcgccacagccaccctgcattagcagcatcgtctcccaacaacaagaagaagaggagcccccggtggtgctcacggtgtggcgcaagtctctcctcttcaactgccacggcttcaccgtcttcgacgccaagggcaacctcgccttccgcctcgactgctacgactccaccagctcaaggcgcgccgacctcgtcctcatggacgccgccggcaagccgctcctcaccatccgccgcaagaggatgagcctctccgacagctggatcatctacgacggcgacggcgccgccacctccaccgccacgccgctcctctccgtgcgccgccgccgcgtcggcctccgcgcctccaagtccaaggccatcgcgcacgtcacgccgctctcctcctccctgccgctcccggaggcctacgtggtggagggctcgtacgggcgccggagctgcgcggtgcgcgacgcccgcggggacgccgtggcggaggtgaggcggaaggagtcggtcggggacgacgtgttccgcctcgtggcgcagccccgcctgggcgcgccgctcgccatggccatcgtcatcgccatcgacgagatgctccgcggcggcagctcatcgctgctgcggaggacatgctccgcgtaagtccaaaattcttccttctgtacagtagagacattgagctcgctgcaaggggatcagaagctcggggtcccacctgtcagcgactcagaagcagtgttcccgcagcagagtctagctagatgcagggcactaaacacccagaaaagaaaagcacaggaattatgacaaacttattagagttggtgctgtatgctacaatcaagttttagctagctgctgggttacttaagcatcatccatgttgataggaaattaagcaggactgatacagtcaggcttgtgaaagtaaagcacaagtaggacaatacatatagatacagcctagtacaggggagttctttttttttcttccccggatgtaatattacaaaagattattgtttattattatatggagaaatggaactgcttctccttttccttcctttttttttagtgatctgtgtacacggctagcccatacagcagcatgttcagtgtgtgcgtgcttgaccgtctatccgagcgacgagagaccatttctgtgttaatcagatgtgagtagtaaacagatcctatctccagcaatattttattttgtttagaagtgagaatccttattattaggcgattcttctgctagtatcatattgctacccactctttgatatgacacagatcgatgatggatggagcagagcttagcttggaagtgcacaacccttgacagagatgagtaacacacattataaacaacagaacattattcagctgaacatacaagatgttagcagctaacatgcacttgacctgctactgttagtcccagacttgtgccagctgatatttcttgaaattaatcccagtttgttaatttgtttcaggtctcattcactgtgttgtactgtagagccactcgatctgccttgttcatctcgcggtggagctagtactaccaaccgatctagagtatctatcacgttttaatcaccattcattcttgtttgagacgatgaaagagagaaaaggcagtagatgcctcaaggacgacggatcgaggacatccttgtcgatgctctgtcccaactagagtagcttatagctcgatgaagacacatgcatctttcttccggccgtgtggtgtggatgtggtccttgatttgtttgcgctagaaattcatcgcttccgcgtaatacagtagtactacagtatgagagctagatggaaaattagacgaaataattttgtctatagactgtgcatgcagctgagaaaatcaaactcaacatcgtcatcatctcatcgtacagagagaaaaacaaacgcatgcagtgtccccgcccccttgcaaaacacaaaacacatggacacgatgcagactggtttaacacagagttatccctggatatataaaaaaaaaaaggttggacccaaagaaggacttagagtcaatggttttagtaaggaagaggtaaatatttcctgtggtgagcgcgctcgacaagggtcgaacccgggccagcggggtgcatgccagcgaccctgcccttgcgctaatagcgcatctctatccctggatatatcagtctttcaagtgtaacttttgctgactgcagatcgagggtgcttaatttcttcatatcattaaagggtaatttcatgtgtaactttttctggacatgtgcacttcttttattcaagggaaagggaaggaactcagccattcaatataattacaggaggtgaaaagagcttagaacactagaggaaaacacattattacaagctgaacagccaagaagctgatggagcagctagcacaactaatttgacgagtgctccaaagtgattactctggggctggtgcttgtcgtgcttcttctctcgcttataacaaacttctttgccaaatttgctacatcttcaaccgtaccatagacactgttgaatatcctgccatttcgttgcaaccaaatgctccagatcgtttcttgtgcactttttcagacgataaacagagaactctgcactttctcagcgctttctacatgacgatgaacagaggatcgtgcactttttcagcgttcgactacttggtttagttctcgatccattcgtttgatacatatacgtatgttgtggagattatggataccacatgtccacacggcatgtatattcgactgggtatggtggtaccatatgtagatagaatatatttaaggggctcgagttatattcttaacctgtgtatcaaggaaatactcgagattctagtcggttatgattgtattttatctttacttgcctattttgctaggaatatgggctgtatgttataatacggactcctctcactatataaggaggggtccgggtgcctcttggggcataacttttcccccagatcatacgatcaataatacacttggtggatcaatccctgtacatgagtagggtattacttctcattgagagggcctaaacctgtataaaattcatcgtctccaaacccatccacttttcatgcttgatagccacccctttttgtattgccgaaatcttgtttcgacatatgttgacttgattgggatactgatctggactactaattcacaggtcaggcttcagagggagtgccattccaagtttccaacaagccaacaattaccactgatcatacataaacagaggcaggaaatgacggatttgagcgacggctagcccagctttttcatgctgaaaattttaggcggattcatcgaagtacttgctgtacagaaacataatggatgcatgaatggctgctagacttaaatttctgtctgctcattcaatccaatattgatcagagtgtcattttcagtcctgctcctgcatgcgccactgtacgtgcatctgacctttggcgaacttttgcgcttttagccgccgaaattgcccaactctttgagagaaaaagttcggttgcaatacgttttaaggaggggccaaagtcatcttcttgttatactcgatctgctcatttcatgtgcatgattagaacaaaagcacgcgaactgaacaatcaaggaagctgccatacaaatacgtactacggtactagtacgcgcccttctgtaactccattctgagtttcaagtcttcaaaaaattaaagtggcttataatatgaaacgaagggagagtactagttaccatattcatgtttacatcttcactgataatatatttacatgcttctcccttcgtttcacaatgtaagttattttagcattttccatatttatattgatgttaatgaatctagacatgtgagaaatgctaaaatgacttacattgtaaaatagaggaagtagatgctacgtacgaagtactcctaagtaaaaatcatcatgctagagaaatacgtgatgtcggtaatcctggtggtgatattctcaaaccagacatgtacagtaaactcaatagtcaatactatgggtaaggtatggattgagatccggtaaggtatgcatattctcgaacatgatcagtcactgcatattcgatcgatctcctaatcaagatgcattaacaagataggttcgaagaccatttgctgaaaacctaagctagattggtccttcttgcatgatgatatcttgagaaatactccctctgtttcgaaatgtttgacaccgttgactttttagcacatgtttgaccattcgtcttattcaaaaacttttgtgagatatgtaaaattatatgcctacataaaaatatatttaacaacgaatcaaatgataggaaaagaattaataattaattaaattttttaaataagacaaatggtaaaacatgtgataaaaagtcaacggcggtcaaacatttcaaaacggagggagtactaataatcgtaaccatccttttcccttgtgttttttgctgactggttgtgctctttaattatcactttatgcgcacttttctttgacgccttccacaattaacatgcgcgcgcgatgggtggttttgtttatatagtactccacactattgtacccgtatgatggcaatactagtctgactagtgtttgctcttcatctagaattgttgtgtttctgtacagtagtatgcatggaaagcaaagaagttgtggaaatgcggtcatatgcttggctaggaactgaagagatagcaattgggatggttggtttggcgtctaaataaaccacagcgtcctggaattgtgagtcatgcgtgatgcgtgattcctccagtacagaggagagagctgatcaaggaagataactcgagacaagccagtcagctaggatacctaatattccctcttggggctcctacaacgtatggaggaggagaaaaacgtgtcttgtgatcttaattgcgcagaggaagaacaaattcacctccgcctccgccgccgcgccgtgtcgagggatcccgatttatggatgcaaatcgctttttcggatcgtgattaatggtacggtggcccaaagcattccaggccctactagatagtggactcaacatgggccgaaatatcgggggggcctccgaaagcccatatacaattgccttacctgtccccacctgtcacatgcctcacgcagcagagctcaactcaagtcaaggcggcatttcgaaattcgaaaacaccaacggtttcaaatcctcctcacatcttctcttcccccaaatccctcctccccatcgcggctcctcctccggcagccagccatggccacggtcacgccgggggtgctgctcaagctgctccaggcgatgcacaccgacgaccgcgtcgccggcgaccaccgctcccccgtcctccaggtcaccgtcgtcgtccccgcccttaccggcttcaccggcgacttcctctggccctccaacggcttcctcctccagctcttcgacggcctccactccacctacgtccagccctcctccgccgacgccgacgccctcgtctccgcgcgcccgcaactcgtcggccacctcgtccacctcgaccgcctccgcttcgcccgcccggtgccccgcgccgtcgggatccgccccgtcccgtcctctcgcagcgtctccttcgtcggcaacccggagccgctcgtcgcccgccccgccgcgtgctcccgcggctacgtcatccagcccgggtcccactccgacgccgcgccgccgctcatgccatccagttccggcaatgcggcgcagtccgatgcaacgaatgccatcaataggacggttctcgcgcacaagaacgtccccgaggccgcgccgccgcccgccgtttcagccgccaagaggcggttctcgtctccggcgccgtccaagcagcgagatccgtcgccttcggtcaagggcggcgcgtcacggccttcgtcgccctcggtgaagggcgcctcccgagcgtcctcacctgcggtcaggggcacgcccagggcgacgtcaccagcgccgtccaaatgcgtggtgcccagccttgttgcggccaaggaggagaatcgccgcacggcgagggagccggcgattatcgtgccatcaaggtacaggcagccgtcaccagtagaagggaggagaggggcggggtcgcccgcacccggtgggaggcgcgcgtcactgtcgcctagctcccggaggctgtccggggaaggtagcagcaagaagaaggtcggggtgttggtggctggtatctccaagatgacggatttgacgaatgggtcggctgttaagccggggaggaagagctgggacaatacctcaatcgcagcagcggctggctctgtgatgaaatcgaaggtcaaggtggataagagtactattctgaggacacaggtcaggatcatgtttcatttgtgttgcaattgcaatcttggaattgcacttgctatgctactattgctatatagttgtacatgcactgcacatttatcttgttgtagtgaacagacaaatagtacaactctactttgaacaggctaatcgtagtgaaaacagtggttacttcaaatgcttgattcagtacatatgtgaaaaatggcatggttttcttgcagttacttaaaatgtttataagtttattgaggaaagagagaattgaaaacactgttatttattttctttccagatacaatggcagctagtttgtaatctttgaatttgactcatggacatgcccttccctaccatcatcacattgttgtgttactgcaggaagcaatggcaagacgactgagtgatgttacaacagaactatccagtaacgatgatgattcatctgtagatgagaagccaaagccacggaagaagatagagtcacctgcagtaaagacgaaagcaatggctccaaaaattatgcttcatgatcctaaatggaccgatggaagcattccattggatggagtttctgatgtgctttcaaagatgggaaaggtaagcactcccaattcatctttgttagcaatgatcaagtcgcagttcattgatccttgaaacaccacatcttctctgaatttgcaggaagccactgaacgaagagacgcagcagcaattgctgcagctgatgctctgcaggaggcattaatcactgaatccgtaatcaggaacctaaggtaattaaaagccgacttgtgtccccggaatttcattcagcacaaaagtggtttttcctaacactcagcttgctattgtccacagtaaattttctgaactaacttcagcatcgaagacctccaatccccttccaacagttgatatcttccttgctgtctatgaggatactctcaaatggaagaaaattgctgagtctatatccaccaatagaactgaaactgcatcatgggagaattcagttactcattgggttgaagcagcattggcaactgatcttgaagtcctaaagttgatgaataaggcacctgaatcgctctctcggaaaaggggtgctgataagccaaaggctcccttggtggtagaagctccaagaacaaccatatccaagaggcaatcacatgggacttctgcaaaggtccagtcaaaggtcttaccgacctcttcagcgagctgcgcatggaacaaaactcagggcgtgaatgagacggctgagcttgccacgaccttgtgctgtgagatgcatacgtggttcctgaaatttgtggacgaggcaatggatttaggtttccacctttttgaagatcagaatgttgcaagtaggggaaagcagagcagccacataacaatggtactgtcccagttcaagaagatcagtgactggttggatggagtaggcaagattgcagaagaggctacaactaaggataaggttgagcagttgaagtgcaagatttatgggttcgtcatcaatcacatgggatctgcatttgatagctcggtctcgatttcatcaaggaattgaggaatgcttaaagtaagcctttaagtttcttctcttgtatttttgttcattggggatgggatcaaagctacataattctatgacgagaggtctgctacagtttgtagaagctactccttcagttattacctttggttttgccttgtgaataagttgtttgtgaaatggttcttgttttatcggttacaattatgtacacttgatagtttagcttgctgtagtctgagtgaatgactgacttgttaaagctacaagatatcattcttacatccttgcaaatattgtgctaggattaatggtatgttaatttgattggtgcccaatcttttcataacaaaggttaggcaaatgcctgacatgccacaaaaactgtagctagtacaatatgtgccaagtatatttggaatgccgacacattttgctagccgaagaaggaaaacaaatcttcagttgctagaggtccttccatgttgctaatttgctataaatgctggtgaaccatttggtcagaatacatgaagctgtagaattccctttcttgtcgaaacattgatgaaggataggtctagctcctgaacctttcagctgactggtcctaatgattagttgggtcactaatgtcaaagagatgctgcacctgattatggtagtatacaggaggtattggtgccaattcatcttttcaattgaaatttgaaagggacccatagaacttgacaaaaatattttatttgatgcgcttgacgcttgggaggctgtagggtgaagtaaaatcaaacacctacagagaactccctttgagatatgttattgtaaactgattgactgaggcagaaatgccaaattgtctaccggagttgaaaaggagttttatccaaactagtattactatgatactactagactagaattattgaactaacagtcctcaccaaattgaagtctgtagcagttgtttctgttcctttgttttccttgatgtggttggaacttggaaagctgatttgcttgaacatgaagagctgaacaaagacagccctgtttgtaacaaactagtaatcagataattcagccgattactacgacaattcagctgtttggttgtgcagaaggtatattgaccatgcagggtaattcggctgattgcatgaacttgtttggtaaaaactattgtgtataaatcgtgctccaaactcttgagcggatgctattagtgggtgtttttgattggacaatctgagcggcgagtagtgcagtactatgttgtgaagaaacactagtgctgggtgctgctgagttgctaaaaagtatgatatggaagggaagtatggatgtggttggggcagctactgtcccatgatggtttgtgctaatgaaggatggggagttgattgcgggagggatgagtgtggacgcaggcaggcgttcatagttagtgctggatggtgacaggaaacggaacaggaggacttgagagctgggcctaatgtgtggtttgggccgactaaaatgctaaagcactcccttctgatcgtacttgtgattgtagtaattatgtactagtaacgaaaattctgtttagccttttcgattaaaaaagaagaagaattaaactgatagcggacgcactggccgcatcttgtattcttaccaaaaaaaattccatgtcgttgttgtttaaccgccagcagtggactacttttaccaccggtgcacaagccaaattctgagacgcaatgcaacgacgtcatgctatgcttgcagagttgcaggctggtttgtgctgcgcattcgcgtcaacactcccatttattatgccaactaattccaaacaccagcaatactctcctcattaacttcttccgcgggacgagagagggagagagagccaaccgcgcactacttgtacttcctcatcttcctcttgctattaatcgaatcaaattactactagtctccctttcacgccacgcacacgcacccaatcccctatcgatcgagagacatggcctncaccaccggcaccgtcggcggcaacggcagcggcagcatccttcccacccacaccaccacggtgccacccttcagagcccataaggacgccgacctggaatccacgacgcggcggcgccggcgacgctgcctgtgctgctgcctgctcgtcacccttgtggtgctcctcgtccttgccatcaccctcctggtcctcttcctcacggtgctccgcgtccgcgaccccaccacccaccttgtttccacccgcctcaccggcctctccccgcgcctttcctttccggccacgtcggtccagctcaacgtcacgctgctcatcaccgtggcggtgcacaaccccaacccggcctccttcacctacgccacggggggccacaccgacctcacctacaggggcgcacacgtcggcgacgccgagatcgacccgggccgaatcccgagccgtggggacgccaacgtcaccatggcgctcaccctgcaggccgaccgcttcgccggcgacctcacgcagctcgtctccgacgtgatgggcgggtcggtggcgctggacgcgagcactcggatccccgggagggtggccatcctgggcgtgttcaagcgccacgcggtggcgtactcggattgccatttcgtgttcggcgtcacggagatggccgtgcgtagccagcagtgcagcgaccgcaccaagctctgattgatcatgtgattccaacttaatttgcaagtttccaagcacgcaacgtaaggtgggcatgccgcatcgcgacgtgggacaagacgagaagccgtatgatatgctgctttgttacgcaggtgcactgcactagtagtacatagtagagtattatattctacacgggcggcacattagttcgttacagatagtatcagatcaggaattcaggattcagtgctacgattttcttcaatatttcttactgcgtgttgggattgatttgattcatgtatataacacggtgtcagtttggatatatatacagtaatttcactattctctatttcttcaacgtatgcgcccatgatgtttactagcgactgattcaaaaattcctaatccaagcgccaaacttcagttaaacagacctttctcgacagcatgcccacagcttcaagctgccaagtgccaacactcacagaaaactcggcccggtgcaaaaaaaaaaaaggagcatatcctgacttctttcactagcaaatactgagttactaggatttaggaccctcacatggtcaaacaacaaacatactaaacattgttacaggtttcaaaacatataatgaagccacatgtataaaccaaacggccatttccagcggttttctgtttaacctcaccactaacagtcacatcaagcaagcagcactttacattatcaatcatgattttcactactccgctgcattcatcacataaatgaaaacatttaagcacggcacaccatctcacagttcttgtgaaagaaaaatgaactactattgagcagcattcagacgatccacatcatgaacctgcaacagactcactagttcaaccagacacagctatccattttaagacttacaaaaggtacgtggtcacagaccacaactcctaattgtatatgactaacccacccaaaaggaagactgattaaagcttacatatataacttattaaactgcctcctactcctttagcatcactacctacatgtttcagttagcaaagttaccatattggcacagggcaactgaaattggtagccaaaaactgccccaaaatgttgttcctgggcagatcaaaagggtgtcaagatatcacttattctctttaacgaataaacaccttggactgactgaatcaaagtcgagctttcgacaaatgcttgggctgagctgtactgctttaagaggtcgcctcagtggcgcatctgggcaggtgtatgcaatgcttgtaagtagaggctctgaagaagaggtctcacagcttccaagtgaattagaacctatcagatcctttccagtcgtctctagtgcttgatttgagacaatcagatcaataaacatcttgcagatcctttcaagaaactgatcatcctcctcagcatcatcgaattcaaaacttaaccttttaacagggtaatcacctgaatcaaaacttagctgccttcgcggaggaagttctggtgccttgatcacattcttctttggtgcacaagctaactcctttggtcctggagcaaaaggatcaaagatgctttcacgcggtgtctgacagccatacaaaggatcttcatctgcaacatttattgagctagatgattcaattgcttccttctctagtgtaatcacctcagcaacaccactcttgttattttcatgatcacataccatgccaagggatcttgtgtccttattttcgaaggaagattgcacagaaacttcttcatccacacacttttccaacttttttacaacagggaaatcacagtttgaaactagcgaattatcagtaacattcttatccacgccttgatccatttgggagtaatgtggactcaacctctcctgtaacttgcaaaatgaaaacctacaatgaaataaggaatagaaaatttaaataccacaaactaaccaggacataacagaaaatgatcaccgaaacaaacaagggacacccaagaagagtccaaaaggtttctaggagaaaataaggcaaaaagggtcataggagaaactaaagcaaaattaagtggttatcgacaaaacactagccccaaatgtaactgcaactgctatgaatgtaaaatgtgttctaaaagactatgcaaggcgccaaggtagtcgtcagccactaataagcagaacccagcttcaactcttgttagaagccgagtgaaatcactggcatcatctgatctaatataaccgaagccgtttttgtcgataaccgtttttttggccacatttcaaactgttcaaccatcactctgagtccaagtatgtatacaacaattatatatatttctttacttctgcaaaaagaaatcaattaaccatcaacatctattttataaagcaccgtctaattgtaaaatgggaaaactaaaaggtaaaatgctttctatgcatagctccttggaagaccttcacccacactttttacctactatatatgtatcaagggtttatatgcagctatggcagatacataaaagattaaaaatattctctatagccagtgttaaactgaacaccatagcgaaatactcaaagttgctattagtggtaccaatctagagtaataggcgcccaaatgccaaatatgtgtggtctctacaccgagacctattgtagccctattgggtgtcttgcctgagacaaatcttgcgcgcgccgccgctgaacaaaaccataaaccttgtccgagcgctctctcgacggcagcgtggtgcggctaaaaagtttggatttgatccctcacactacaatcaaaggagacaagtctacaacagatatctaatgaagcaaaatagagttacttaccaacaaaagaagaaatcaatccaatccaatccaagcccgggcggatcttccagtccaacccaatagatgagaaggggagcaaaccggatgcgtgttccttgttggcgcacctggaaatcagaatcacatggcaaaagaagcagatttagggctttaagaggtgagaaaagccgaaaaatcacaggaaaaagagataaagctcgctagaaccctaacatgtgaaaaaccataaaaaaatccatacaaagaagaggagctttttggatctgtgtgagagaaagattgagaagtagaaatggttaagaaaatgggaagaaagaaaatacctcgcagcagctctggattggggcgcgagattggtttgggcggcgccgaccgggattgggatgaggcatcccgccgccaaaacaatcccccctattaaaataaaacaaagttttcacaaaacaccccatagaatgtattatttgctaattctattcctttgtacaacatccagcgagctcagctggaccactgaggaatatatgtgaaaaataaagaatcagtgggttgaagagtaaaatgcaccaaaaggagggaaaactaatttgggcgggcaaccttggcgcacgtgtagcaatatagcatatccttcccgcggaataggtgtgcctatacatatcatcatttaggtgaaaaatgagttcttttttaggaaaaaaaataatggttgtgatcactcagaaatctataggtgcaaataatcataaactgagtgggtttgatgtgtatactacgttgagggcttgaggccagtttgcaggttatcgaagaccataatgattaagagacagttaattttctatttttcttgtttactggaatttatctattgcaagcaaaatacccaagtttcacgacgggtgaagatcacaattataactttacataccttgttccgccatttatctcttcgtatgaaacacgtcaatgaggccaaagaataaacatacgtttgttctgtcatttatctcttcatatgaaacacacaagtgaggttaaagaataatcctgtgagattttgatacctaattctaccagtataaagaagtttatgtgaaatacatataaactcgagggcaggcataaaaataattgaatgaataacttttcgtaatattaacaaaatgaaagggttaaaatgaaagattgacgatgaatccgagatattttatcatctaatacacatagatggaatccgtccggtgatggtggaggcattatccagcctctctcattgcaactcgcgagggacggtggcggtgctcccgtagccaaccaacccccttgggcacgatagacgtcctcccttagcgcgtggtagcagtgctcacctggccctaggcagcgagggcagcggtgctcccctgtccttagtagacgacaatggtgacgccagcagcctccataggcggtgaggacggcagtgctccccgtcctccctattcggcgatggcaagtgtatgaggtggcttgctaagatacaagtgtactatactttcttgtgtgttattgagttgttcgaatttttggtattttattatgaagttctcgtcttctactatggtgaaaagctcatataactggatagcgtttgcagcttcatctattcttgttgccgatttttggtcatgttcctccaattttgaaggttttggattggcaaccatgtggacatgtttgttttcctcgaactctgaaggttttaagctggccacgaacgaattggaagcatttgagccggccacgaatggattggaagcagtagcggacatattgcgcttgccgtgggaacattgcggactcttcgcgatccggacgtacacggggaagaagggaatctgacaaaaatacatgcacgggaacaaaagctagacgacgggcaaaaaaaattcctggaagctttaagtattttttatgcaggtataaatatcctcatcaggattttgatatatgtcatttccttatttctgttgtcaacatgtttttattagaatacacttaagccaaattacatgacgaatagatggaactgtatctatcataggctatgcctagtgcttcacctaggcgccttttgctcgctcaaaactattggtagtgtaactagttcaatttccaccttatcttcatccacctttgccagtcctcctatgaagtccccgtgagtcttcacacgtatctacaagtcttcctcccctctccttagcgttcacccatctccaccagtcttagcctatcttgttgggtctttgtcttttttcgttggtttatgcccatcttgctagtgcaaaaacttccgaaaatgtattgcacataatttccttaataaatagagaatattcgtgagtagtacgtagttatggactagttaaaacataataagttattgcctacaatattatcacgagtataccattcattagaaacttccaaatattccatttgtcacaaacttccaaaatacactcaagcaaatatccttcaaaacaaataaaaatatgcacatatcaccattagctagttcaaattggtgaagaaaagtgtgacaaacgctttttatcagttttgtttagataaattgacactaaaaatcgctatcgactactaaacgagaaagttatcaaatgagatccaagaaatatgggcaacatagcacgaagcgttcacggcatctatgtttcgaggtcttgatccttgcagcctttgctctcggctctgatcggtagatttggaattgggatgactagatgagatagggttaatggaaatttggaaagatttaatttcacctccttttcaataattacataatctttttaataaaataaatagttaaacgtatgtctaaaagtcaacaaataaaacaaatggccaaacgtaaataaccgtgcataatacataaatactatttcaatcgtaaacataaacgaagggcaatgcacgtaggtttatcagtccatgaatgaatattatattaaaaaaatatatataatgtcagaagtgggatttgaacccacgccctcgttagaggaccagaacttgagtctggcgccttagaccactcggccatcctgacctcacagttttttttcacctgatgttgtctaaaccattaattgacagacgagaagtaaaagtttcattccacaaataagtaacacttcaatcggtgtacagaattgcatactgtagaatatactactgtttacactcgagttgcagcattgttgcaaacacataccaaacaaatataacaaggggaaaagggaaacatttatataaccttcaagaatctcaagtcagagctctctaaaaattaatggaacacctttcccaggctcgatggtcagtctgaacgcagggcaatgcacatagtttggagaaagcttgaattcaaacttggacagcaggagtgacagaacaaccttgagctcaaccatggctagattctggccggcacatgtccggaccccaacgccgaagggcatgtacatatgagggggtttgcaggcccctgctatgccgttggcgaacctgtccggatcgaatttgtcggcactaggaccccatactgaaggatcccggtgagccatcgcgatcgggatccagatgttagttcctttcggtatgtcgatgccgccaagtttcatgtcattcagagcttcccgggcgacgaaggaggctggtgggtacaatcggagtgtctcctggatcaccattgtcagctgcacaagtatcaacagcacaccattgttagctgtaatctaatgaacggattgttttcatctcttctgttactggaagaggatgagaggacaaaacatacctttttcaacttccgtagaatgtcaaaatctagtggtctcccttgacaaatgtcaagggattccacccgggcacgggactgccattcatggtgtgaagctagaagcatcaaacaccaagcagccgtggtcgaagttgtctcatgccctgcgaagtagatgtttttgcagttgtcgacgatgaaatcctcgggcgtgcatgaagcaaagggaccatccttagaaccttgaataatggagtgcaggagatccttgtttactgaggtcgatgaatcatgttcatatttctttgatatgtttaaaatgagggtacggatgctactatccagattccagatccctctattgctccttgttggtaaatacctagtcggcccagcacaaaaataaaggaaaatccttaaatgattaaccaattacaataagatgataaaacatgagaagccacttattttcatataattattctcatgcaatggtatggattggaaaatacatgttatgatactcttggatctactgtagtatctcacggattctagataaaatattattttttaggccttatatccatttagaatgatatgtaggaattgcaggtagatcagaccaaaatgggacatgtaagttagcccagacaaaatagaagctgtatatttctccaaaaggttattctgatactgctgcaaaccaaaacagtaacacattatctgaattatagtgatttcagaagttgaatctgggcagctacttgggtattgaaatcattcaaactaagcattatctaaaaaaagagctcaacagaggattttgagcagttcaaagacagcattcttttgagttttaaattgtctcaaattgaaatatgtgccacagtagtacatgtgtagtttctgaaatatacctacttccaggaacaccaatgagcatactttgttttgccattgctttctgaagttgtcgtatttttatgaaaatctccttgccttcactaaagctgcttccaaaacaagcccttgatatgacatcagctgaaaaggttctcaagaactcatcaaccacaatctctgcactgcctcctctgtcctcaacttcatttttccatgagttcaacattgacattgcagcctccatcatcaaattcaccattccctatggatgtcattttaacaataaattgagttttagtatatgctacatgtagtgtactagaaagttgctccaagaaaaatattgttttttgacagagagatccatggcccaatacaagtgcctgcagataattaccttaaccctttccatgaatagttcaggtgcaatcacttttctctggtgtacccatagatcaccatttgatgtcagaattcccataccaagaagagctccacgctctttttgcaagtagcaaggttttccaagatccaaagatttgcagttggctagctccttcaccatgtttggatcagtaacatttaaaacttgtatgcttccagtggaatacaggtagatggaacctaacacaacatcaatgtttcaggaacttatcagctttaattttaaatatgaaatgcacaaggcatccgtcgatgttctaaaaataaatctattaggacatggttacagaacatacaacaaaagaatttacagtaatttaaatagcttatatgtaatgagggtaacaatgagactggtcgacaagatgagacagtatatggtacaccatcagaacgtatatgaaaccatgagctatccataaacaggccccaatcaaagaaattatgtttcgatggttgcagagcgaactaccatccaaaatacaaaggtacctaaaactctctgaattcaagtttgcatcaccccaaaataaaaacaatcctgttatgtgggacaataaaaagagaaattttagagaaaaaataagtcaatatcaaaacattcctcttaacaaaattccaatgaattacatttaacatcgaatataaagatgaattaataaactttattttactgaaactattatgcactacaagtttcttaacgtaccataaaccctgctccagtggaggaagtaagggaaaagagttgccacataatttgatgaaaacatgtcggtactccctgcttcttgttcatgtgctgacttggccaattgctggattctcctcatctctggtatgtttccaaagagaaaagaaggcttgggacccctcactccttggctcctcagtttctgcctcaaccgctctggtcttagccatagaatgatatacacataggagaacagaaggatacagaggatgatcggaggtagaagtgctagccattgctgtgatgagaatagctccatttttgtgtgtacgtatctgggtgtgtgtgtgagagaagagggagactacatgttcatagcatatccatatactgtatactgcatatttgctgggtgatccatctccatgtgaagcttggagctgaaaaggacataaagccgcaaagaagcgcctcactcactctgagcagttagcatgtaacgatcatacaacactgcaaatttacaacatagaaaagaaatccaaggttagtggtaggaaaacttaatttaacatgcatttttttaaggaaaccagggtctgttatgaccaaattattcacatggcataaaaaggaacaatttgggggtttcatatatcttcaacagattatgaggttgggcaataaccttgtagtaaagagctttcaacaaacaataaattaagacttttcggcatgatgttgtatgatagtttagccccattaatttggcaagaaattgcacaagatatagacatatagtagcctagaggctgctagaatatagagagataacatcaattggttgcttgaataaaaaactacgggcctctgctaagagtagaggactcaattcattccccacacaagttattaaaggaagtgttagcctgcactaagaaaataaatgagatgagatgagtgagggcacgcaccgtggcatttcgagctcaacaattgggctctgtgactctgcagctagcagctccatgcgaagaccatgctgatgagttgattgattacaagtatcagcgcgagggcgcggaggatgcaaagaggatgaggaaactgactgattaagaagaatctgcggtccagatagatgcagtctccagaaacagccctgtctgtctacttgctaagttttgtcactttgttagactcccatcaatcaacgcttggacccaaacgtcagtggcaaaccagacaaatgcctttttttttttcatacaaaagggagtgatggcctctcttactttttcaacccaaaagaatggatcgcaacaatgttctccatcataaaaccctttgattgggttcaacgagcttagagtgcttaacaacttcatctcaaaaaaggagctttattataacaagcattgctgtctgtggccagcaattataactggagctgtcatgaatcgactgggtgggtgtgagtaacagggctgctagctcatggcagctttgtcaccatgagtggcaagccgaacccgggttcaatggtcagcctgaacgccggcgagtgacggtacctcggcgacggcgagaaggcgaactttgtcagcagcctggccaacaccaccttcagctccgccattgccaggttctgcccgatgcacgtcctgggcccgtgcccgaacggcacgtacatgtgcgccgccctgcacgccgccgtcacgccgttcgcgaaccggtccggccggaactcgtcggcgtcggcgccccaggcttccttgtccaggtgcagcatcagcctgggcacctgcacgatggtgccgcgaggcacctcgatgttgccaagcttcacgtccgtcagggcctcctgcatcatcaccgacgccggcgggtacagccgaagcgtctcctggatcaccatcgtcacctgcatcatttcgacatcgttgtcattcatcatcagtaaacagccattgttaatttctacgatgaacaatgcggtttaagatgttaatttctcacaatctttaaccggcgaagggcgtccacgtccaatgtcgaccttccccggcaaacctccattgcctcagagtgcgtggcgagtagcatcaggcaccagatggcggtgaccgccgtgctctcgtgacctccgaagtagatggtcttacagtttccgacgataaagtcctcagcctctgcagcgctgcgaccatcctgcgcaccatcaatgatggcgttgacaagactgttgtgtgagtcttggtagtggtgttgttcctttgcgacatccaggatcagtaagcggacttgttcatccagcatctgtatttcttggttgctcttggttggcaggtatttcctacaacagcaatatagcatgaaccatctaaattagcatacctgatcacttatagctgtgattgtgacatgtaagtctagtttatgccatgcttgaattataatactttaagcatgtgctgtttgaaaacagtttacggcgaggttttctacctatttgtctctactgaatgacaggacttgttacctactaatctcaaattaataaggagtatacaaaagactatttcttggttaatatcatgatacacacgtgaaggttctcatttcattgcaactaatttcattgacttaccacagtgcagacagaccaacaaacgaatcttgctgagcaattactttttggagctgcctaagcttgcaaaatatttcttctccttttgtgaagctactcccaaagcaagccctggcaattacatctgctgacaagttccgcaagtaatcatcgacaactatttccctacaccctcccacatcgtcaatcatatcctcccatgcttctaacactgtaacagttgcatcctcaatcagctggatcataccctgcatgcatatataaataacaactgcaatcacgcgtgatacgagttctagttttcagtccatgaaacctacaagcaatcacaatttaatggtaccttaatcttatccatgaagaactctggtgcaattatcttcctctgataggcccattcatcaccattctctgtaaataaacctcctccaaagagggccttgcgagatttctttagataattaggcttaccaagctctgatggtgtccaccggcctatatccttcaccatatctgggtgagaaacttgtagtatctccagagctccagttgagtatagaaacactgggcctggtcaaaatacacatgtaaattaacttcattaagaagaactcaacatggacattccctcaaatttgacatgaatatagggaaaatgagatgaaaagcataatctattctaagattgaaatcatttgtcaaacttgcatttttcggagcaaaggaaatgataaatatgattgttattgtattagaattctcactaccaaagtagatcagatcctgcttaatctacaagtagttgggaaatttttagttattcaacacaaaactcgagataacatataaaatgggtgtatgaaaattttaattgatggtcaactactgagtcctttatatgactgtcaagagttgaatggctattatattaagctgtaaaagggtcccacagtctaaataaactattcatcaataattatgatcctgacaaacttgtttaataatactcagtactagcatctgagcttgtttagagtctgaaacagaaacttcgtaggatggtaaatagcatccaaaatggacaaaataaaattacaaaacaaaggattagatatatatttaaaaatgtgtgatggcaccatttcgctgaaaagtgtctgatctgtttatataatttgatatcctactaaaagttgaaaaacagtaaaaagaggagagattaaaaaaattatgattgccctccaactccctactaaatgatcaattcaggcttataaactagattttaatagcaaggatactttgggatcctgcttctccatggtaattcattaattcacttcaacagttgtaggtgactaattttctccaagacatgtcattaataaacttcaggatcctatcatcaatctgatctactcatgagccatgaacatatgagtgcaagagccaatcatggacaaagtcacaacactagcatatgcataccataagtttcccgacagaggagaaagtgtgggaagagggtggagatgaagttgttggtgccttgcttctgtgaaaatttgagttcttgtcggattcttttgatctcctttgtgttgccgtacagaaaagtaggcttgggaccccttatgccttgcctcctcaacttcttccttatcttcacagccctcagccataggatgttgcacaagtagaacagagctaagctaagaagtatgacaagaacaacaatgagtgcaagcaatttctccatgaagcatagggaaccagagaagcaaagtatttctgtcaaatcttcagtacattaggtctttcgtgcgctagctttatatatttgtttaacacctcaagcatgtgaattcttttgtttgaccttttcttcaacaactgattgttttgtaggttgctttcacatcttgggatcaacttacaatcagttagaccttccagttcatgatgaggtgaattcaacagactaaattactgcaagaaaatcattttgatcccctgttttacctgatgacgatctaagaaccagccttaagttctgtgctagcatactgcattatgcacaacctactttagctaccagaagcatttcatgagagaaacaatataccaagaattaacatatagaaaaaaattgagaggcacaaaccaatgaagcctagacgtgagcttcaaacaagagacgaattacctctccactggacactgggtagaattctgacagaagcactgaacgcaaatggagtcttctcttccatggtgatttttaaatgtggcaacaacagaaggaagcataggacatccaatgacacatatatgttaaacaaatagcaagtatcaatacacactttgcttgactgagcaaagtagcagaagaaagtaggcatgtgaattcttttacaaccggtggcatgtgaattcttttacaacactccgaccggtaactgcagcaactacaacgtttgaaaattttaaaataaaactattctaaagaaacaatcacacaccaccatatagtcattttgttatcagatgtaccaacggaacattctagaacatagaccaccaactctttttggtgtccacatgtacttcagtggcacttggggatctacagtacagttgccttctaccactcctagcgggatttgtaaagcataaaactagagcgaaaccgatgaggcttacaactggagcagcagcaataaaaagccatccactgcgcctgcgtgcactgtttggttgctcatcaacacgaacattgtgttcacttgtattagtctcttcgatcacaccagcagccatctgacgagttacctggacctcttgttcatcagaaatttcttccacaacctgaatgtctcttacattggttgtggcttgcttggacctttcatactctgcatcatctgtaggaagctcatatcggcagacaggacatgtatttctagaactaagccatggcaagatgcacgatgaatgataaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaacttctgcagtgngcgccatcacnntcacgcccgc

SEQ ID NO: 53 - DNA, 1375 bp, Oryza sativa
  unsure (1)..(1375): unsure at all n locations
agtagtagtcgagtacaanancncctcatagaagagatctagctaaggtttgcacttcagtgactggaaactaatcccacatatcatttgaatgtgcaggcaacattcacaacaaactatcgagaaacagtaatggataaagaatttaatagagtcaaaaggaccaaaagttgaaaataataccagcaattatattgttttgtttatgtagcaaacatcatccatggttgatgcagattctctactgctcgagcacctcacgtatgcagtgactttaagccctgagagagtgcaaataaccattagatgttattatgatacaataaatcatctattccattgaaaaagatacagtaaatcatctcccaattagtgaacaaggtaacctttggaagattatttgggtgacatattgcattaagatcaaatttgctgtcactaagtagctgtgccaaaatttcagtgagttagcatttatgatgatagatcaggatgtcccccattgtgccaaagacataaataaagatcggcaatcgaactttcttagttgaaattatcatattcatcggctactgatctaatacaggaaagtggcaagtctgctcgcacttgaagctcaacgtctagtggagatggatgaggccttaccgatcatgcaccttgacaaatatcctaagctggagaaacctatcgatggagatcctgtgcttggtggcgtactcatcaagcacacactccttcatggccgcagcggccaccggcggcggcgtagacacacacaactccagtgtgtacttcgcgagcggcctacagaacaagtgaaacactgatgacagcaacacaaaaatgaatcacatagctaaggtcggcggattagggacctgactgcaggcacaatcatcgcaacgcgcgtgctgttgcggatcccggaagttggttgtgttcccctttaatctctctttacatttttgtgaacattgcagctagatttctgctctaaaaaccaaaaactactcatttttgtaaataaaacagagaggatacaatataaatttctaaactactctaaaatttagatgcaaagaaactcaattttcagatgccacattagttgcaaaaaaaacgttgagatgtaaacctgagtgaatgatgtgaatatatgagggtccacaactggttttcaacgaggtggttagtacagggatggaacataggacgttagggtggatagcttacacgatgtcggtgtcaaacgcgtcgactaaccgtgccgttaaggtaggctggcgggcgcgacactggaatgcagatgcagaattctgtgcaaattaaaacctgatgaactactgtacaatctngtagtcgcacgtcactn

SEQ ID NO: 54 - DNA, 1849 bp, Oryza sativa
  unsure (1)..(1849): unsure at all n locations
gtatagggatggcacatagnacgttagggtggatagcttagacgatgtcggtgtcaagcgcgtcgactaaccgcgccgttaaggtaggctggcgggtgcgaaactgtggaacgcagatggagaattctgtgcaaattaaaaccttgataactttgccttccggtcatggaatcgagctaggtttttttttacggctgcagaatcacgggcctcaccatagagagactggatttggagagttggaccccagagatttttctagaaatgacttaccattggccacgaagcagcggttgtttcggcgaaacgtcgaatatctgaaggtccacaactggttttcaacgaggtggttagtatagggatggcacataggatgttagggtggattgcttagacgatgtcggtgttaagcgcatcgactaaccgcgccgttaagttaggctggcgggcgcgacagtatggaatgcagatggagaattctgtgcaaattaaaaccttgataactttgccttctggtcatggaatcgagctaggttttttttgacggcttcagaaccacgggcctgacagaagagagactggatttggagagttggacccccagagatttttctagaaattacttaccattggccacgaagcagcggttgtttcggcgaaacgtcgaatatctgagggtccacaactggttctcaacgaggtggttagtatagggatggcacataggacgttagggtgtataggatcgacgatgtcggtgtcaagcgcgtcgactaaccgcgccgttaagttaagctggcgggcgcgacactgtggaatgcagatggagaattctgtgcaaattaaaaccttgataactttgccttccggtcatggaatcgagctaggtttttttttacggctgcagaatcacgggcctcaccatagagagactggatttggagagttggacccccagagatttttaaaaaacattttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagcggactagcgggcatacggttccatcttacaggcgctcaactggggtataagccacgactccacctaagacttcttctccaaagcttctcttactgaaggggggggggaaagattgagcaagaatgagtacaaccacagtactcagcaagccacaccggtggatgcatgattaatgcaagggggtacaaggggtaataatataggggttaagttttgtagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaactaaaacactaacttgggtacattgctaggcttgcccataaccgagggcgcggctattcgaatagattatactctgatcagaggtgtacatctttacccaaaagacacatctttctcacgtgtaaccacgtgccacataccaccacggtataccgacggaagacgtgacatagttcccaacccatcctagccataaacaagagtaccgacccaaccccacctaccggcggaaacccccggacaagcaggcaagattgaacccctaacaacaagaaacat

SEQ ID NO: 55 - DNA, 750 bp, Oryza sativa
  unsure (1)..(750): unsure at all n locations
ngtgtgtactacatgtacagtagttcatcacattatcggtgatgatccaattggatactccaaacctgtgcacaatgttaatgagaaaatctctagccttgtctgctgtaattgtgacgactggtttggcttcgatccagttggagaatttatcaatagctacaaagagatgagtataaccaccggtgcctttttgaacgggccaaccatatcgagccgccaaaccgcgaacggccaggataatgggatggtttgcaactcctgagctggtagatgagtctgtcgggcaaaaaattgacaaccctcacacgtccgcacaatcttgtcagcatcggatatggcggtaggccagaaaaaaccctgccgataagccttgcaaatgatggttcgcgcagctgcatgattgccgcagatgcccgaatgtatgtccgttagcaattgcctcccttcctccaaagacacgcaacgttgcagaatccctgacggacttttcttgtacagttcagccctatgcatgatgtaaagtttgcttcacctggaaattcgcttggcttcgtctttatcttgagggagttcttgcttagttaaaaatttgatgaagggctctctccagtcggcttcgagcatgttcacttcttgagtgtccgtggcatcggttgtttcttttcttggtacggtcagttcataaagatgttcaacgaacacatcggaaggagctgcttctcgttttgaaccaaagttggctagttn

SEQ ID NO: 56 - DNA, 759 bp, Oryza sativa
  unsure (1)..(759): unsure at all n locations
agtgattgacacttgtcagtanttcatcattgtttcgtacaatataaccaatcacacgtcaacgaattcatgatttgactaaagattattttatgtacattttgagaaatatcagaaactttttaatgcaaattgctggaggaatatcagaaaaagaatgaaataataaatagtgtcgagcactcaagccttggataacatttatcaccagcaactcaattgtgattcaaatagcagaaaaattcaatcttcaaattatgtcctaaataactgtccctatttaggacaaaaaccagcagcgatgtgtagtgcaaagtttatgaatcctagctaaaatagtcctacaacacatttacctgtccaaccaaaatagtgcattcaaaagccatggtttgcagagcaatagagcatcaaaatgcacaaaatatactaaacatttgaagattagcacaacaacaactaatcacaataaatctgagttagcacatggaatttaaaacaacataaaaggaaatattttttctatggaaaggaaggtcaaaatcaactgcctcacaaactaagtgtgcacaaaggaaaagaaaaaacaataccatatgcaacaaggagttctggatcaccatatatatcaacaaggacctacatggttttgtccatgagtcacaaaggattacactaaacatctcaatcctcttgtagaacaggcaaaatatataagaaaccttgggctctacttctttgcgtgtagagtatggaaan

SEQ ID NO: 57 - DNA, 752 bp, Oryza sativa
  unsure (1)..(752): unsure at all n locations
cgtgatttacaccatatggtacagtagctcatcaatggagcggcctaaagtcctgagttgataatattgtaaaatagatttaggaaaccgataccgtattggttaaggtttctatcttgtaatcttgccccccatcctgtataangtgggcaggaggccctggtgggggcatgacacaaactgatcgtcagatcaatatacacccggcggattcaaatccccaaacaggagtagggtattacctctcatcgagagggcctgaacctgtctaaatcctttgtctccgcatccatccacttttaggtctcatgcgctacccccttttcatattgccgaaaatttgttttgacagttggcgcgtcaggtaggggttgcgttgagctttccatcgagaagtgcgatggaatcaatttctggagatgtgctgagatcgatctcaatgagttcgacggtttcaaccttcatctcaatgagttcaacggttttaatctgccactcggtcggcgacctcatgtgtcctgctgatgtaattccgttcgcgctctgtaccgatctacacgccagcataggttaaccggcagtcttcacgcgagaagcattgctgattaccaggggcatataagagcagccgattacaaggagctctgagccatacattgatatatacatatgnctatatacatgcttttatgcttgataacagattaatctacntaatcgtttctttgcatgtatgtatatgctgaccaaga

SEQ ID NO: 58 - DNA, 760 bp, Oryza sativa
  unsure (1)..(760): unsure at all n locations
agtgatgtttacagatggtacagnagctcatcacaaatggtcataacttggccatctggactcggaattggaccgttcaagtctctaatttttccttaagaagtcaagacccatttttgtgctttgttcctgcttgttatatggaatttattagagtaaaagcccttttattttccgttggtcgtgtagacgctgcagcttcggaagatccgctcttcgtggaggttgaagccgacatttgggaaagcgagcaaggcaagtcacatcatccttgaacatattggatcccattttataaaattattttgatttaaattattgcattaccgctttacttaaattcccgcgttatcactgttttatttatccatgcctatttacctttgttatgaccttattattagtttattgatattattaccttgttcaccctagaataaacaaaaccccaactagtggacactctactcatggtaccactagtatgattttaggtagatgcttcgctatttaattaggcaacattatgcggttttacaactctagactttgggatatttatatcacctggacactttggaattggtggattattgtggaattggattcacaccgccccctctattcaaaatccccaaaaatggttttaggctgggctcggggtgcatggttttgatagtagcaccttcgccatataaggaccgctcttcgggcctcttgtgcaaagcactaccgtacttccacatgtctagtgggtaag

SEQ ID NO: 59 - DNA, 16136 bp, Oryza sativa
atgtctaaaatatgttcccctttcctaaatgcatgtaaatgttaataaaagtaatattggaactctcattaacttgaggtgatgttgatatgtaagaatccaatttacattacacaggtcatagctcccttacctattatgcacaagtttactttagtattaaattaagagaatgctaatagagatgattaagatagaatataccctatatgatataattattgtggtcacttccatgttcatgactagtctccagatgaatgaccaaaatagttttgtggggcttgacattggccttgttgatatattttaaggtgtatggtttctattttaacttcctctagctagcactaggccctaatggtttagttgtttatctagatcttagttaatattcatgagacctattatgaaatgcaaatcgaaaatccaaatgcaatccaaatccaaatgcatatgaaggactcaagtcaaacatgtctatgagagtatgcatgcttacacataaatttatatttttgtcctaggttagagatgcaaaggttttaatttgttttaaaattttatcatgcaagagttagatcaacttcacctaggtttaaaatggaaatttttggtttacaaaattgaagaactttcctttcaactagttttgatagaaattccttaatcctagaattcgggtatgttacaacctatcccccttaaataaatctcgtccccgagatttgggtatggttgtgggtggttacattgttcaatgtgttggcttcctgagaattctactcttttagtgtggttcttactatcgagcccccggtaatttgtcaaagttaagaatggattataatcctaaccttgatgacattgaaagacctaccgaaagttttacttgtatgatgctttccgataacactatagtatctgatttaattattttttttttctaaatctctttcaaacataccacatttaatacctctaataaaaggttctacttaatttcctgtgggtgaggttagcttaagtcatgactatctcctgaggattgataaatgatagtaactttcttaagttgtatcatagacttgctaccataaaacattttgaaacttctatttaatagatgggtggcaggttttactcaattgtggtttacgaaggctttggtagataatcaaaaagtggtactagagaagttggttctaacaaggtacattatggtacatatttttttttttggatctatggtcattgatctatcttagttgagcccacatttccaaaattttaaaattttggacagcaagctcgaaggttaccaatttaaagttaagtgggttgcttgatggcatgtatagcaatatttttttttaagaaggcatggatgtatgctatgatttcatgataaatggatgatgcgatgaatgtatggaatgattcaatgcttatgaaggtatttttgtattgcatacatgccatagtacaatccccttcggttcaactgattagtaggttgcggtggtaatttttaaaacaagtagatcattttagagaagttttcaaaatctttaagtcaaggttccaaaccatgtttgtgagttgcttcaatgtacagatcttgcatccaaccataaaggggtacaaaattcgcgcattgagccatctcaacataaatcacatagtttgcttatgacttgttcctagtatggtgggtttcttttaggcattgaggggggcttatcaagattgcatatttgtctctgggtgtataaggtcatggtacactatcccccttaaaaaaaataaagtttttgctatgaggtttatcaaagaaatttttaatgaagggctaaatcgacatatgtgctaggtgctgtcctacccagttccgaggtataaactgaaacaaaagtctatgctagtgggatgacaagctaagaaaaaaaatattatattcatcatcctaacaaagtggtctttaacctggaaaagaatggtgatttttggacaagtggattattttagagaaaatgatcatgccaagtagtgcagtgctggattttgtcagtttactgtctttgttgaacttttaggtcaagttctaaaggtgcaaaaatccaggcaaaaatcagagagatgggtgagttaggttgtgaactaccttgaaggaaccaagattttatcatttatagtttagactacacaaattaaacaaccaggttgactactgttttcagattgggactatgcagtgccatatgaatttttatgccatgatgcaaagactcaaaactttagccaaaattcgtggagactactaggtatgttgataagctactgtgaaaaggtgcatattttatcatgcatgctttgggctacacagaaagatgaatgcagctgtctacagatttcagaacgtagttatgctacctaattaaattgttttaccatgatgcaggggtctaaaaattatgtcaaaattcatgaagcttgcttagttagtctacatgttgcctgtaaaaattctcaggtttatcacctacggtttagcctagacaaaaagaacaaactgactgactcaagattccagaaaaagaataaccggcacaaaatgaaactttatgcaagttttaagttacgtaaatccaccatattttaatggcattatgttagagtggtccagaaactatatgaattttgggtggtccatctaagcaaacaatctaaagttttaagcacaacaaattctatcctattcaaaactactcgttttaggccatatcggtaaaattttaaaatttcgggagaaaggagttcaaaataaacccaatccatttttagtgcagagacgacatagggagatggaaattctatcatgtctatcaagttttaaattttatcaacccattttcaaaacccattcactagaggctatctctaacccgatattttacaaatccgtactagtacataggtgtaggttgcaaatggattttaaaacttttcaaaacactttcatattattttatattgattattaggtgatttcaaacacatttatacagaagtagcattttcaaaatgttacggtcctatagagcaagataagagtttccaaaatcaaaatagagatagaggaaaataatctataaagagggatgagataaaagatagaatataatattcgcaaataatttgtagctgagagcatagtactcaaaataattttaaggaatcattctaaacgaccaacttaaggggctcctatagtcggtatttgctctgataccatgctgtcgtaggctctccggaccttccattataattgagagatgaaatgtataattcaagtcatcaaacaagtataatgaaatatccgacgcctcgagagagaaatattggagacattgccgggcctttagcctgccagtcaacttcagcctgagatgtgcccgtcaaaccactcgaaggcggtgaccagatgtgttacacattcaggagacttgacaaaaatggctaaagatctacaacatctcaaatattcttaactcatactcatgtgaatctagttcccaggatgtgcactagattcacactttcatctcaagcatgattatacatagcaaacacaaataagatgaaagcgattataaactacatctactttagttacatcggccgactggccaaataaatatatagaacagcggaagcttgtctacccaatccacaagcacaccgactaggggtttaccccattaagttcaagtcctagaagaagcagtcgatcacccgcatcactcaaaggctaagtctaaatcctgcaagcaaaaggttaattccatagcaagagtcagtacattattagaaataatgtactggcaagcaccaagacaagcctaagaccctacttgcaaggcatataatcaaggaaggcataatatggttctttttagcataaagcaagttttatttgcataaaacatttctaaatcaggtttactttcaaataaatttcagcaagctagtatttgacgtattgggcatcaaggtaggcattaatcatgtataaatattcaccttattgccatccatggcagcaaggagatcattctcaaatctcatcacaatttgaaggtaaatttcagcatttaggagagtaaacacaagtctatactcaatacatatccacacgccgctcatgaccgcgagcacggctaatcgattagttttaactctgcagagtttgtacactttacccacatgatgcgaaataataatcatgcaagagcatgtcacgcgatacataagtacccgatttattacccacaacaaagcttttccaaaattcatgatttagccttacaccagcacgatacgtgttactccatcctaagccatacacgttatatgacctagaaccgttaagtggcgggcccacgccttaaacttaacgccgtggtggcggacacaacgggaacccacccacgtggcacaataccgttgtattggacagacttagtcacctaaactaccacgtcggggtaaataggaagttcctctgagttatccgaactcatacacaccagcctaccagaatgtaaggctaaaccataaataatttactaagcttgggctatcccatactagcacatgtggttgcactgtatacgaaatgaactgacattgagtgaagtccttaggtcggtttgggcacactctccccctatcggtacacaactaatcaccatatgtgcaccacttgaggcccaaacctaaaatccatgtttttccaccattttatttatcaaaatcacaagtattaaagttctgtccagattaattaaaaatttattttcatgtttgtaatgagcccataatgacaaggaagacaattctaagcatggctaagctttatatagtaacctagtgtcaccaaaagtcatatataaagtggtatagtcatattgttcctaaggttaggagtgagggatatggatatatgtggggtcaaggtgaatgcaaacaataggagtttgtccaacaagtttaacaaaattttaatttattagtgtacaatcgacatgcaagatttgcaaacattttcaataacctccaaaacataggttcaaagtgatcaaagagagggaggtgggacttgccttgaatcaggaaaatatcagcacctaaatcacttcttcaccgattaagcaatcatctatacaaagtacacgttatgcaattaaacaccgaaatatgcgaaaaatccaaaatgctctaaaatggatgatttgtgcacagcgaataggtactggtctaaaatgaatttaggtgaaagaatttctattttatctcatttcatttgagaattatgaattttagaagtttcatcggtatagcgtaggatttacttaggtactattgtgaaatgctgttataaggtgattcttattaagtttatgtttgctggggtgaagatatgtgttttctaagactaacacatttggtttcataatttttagagttaatatgaattctttatgtattttacaaattataacgtgttataggtgtatagtgttctataggttcatggctttagaggtttaggtctagaacttgcctcatctagctagtgatgtataaaatgagtattttagttaactaatctaaccttagttcataggcttatggtctttattatcatggttcatattttataaactaggggagctctagtccatgttagcaatttattatatcaacctagaaattattacataagctaagtgccttaagttttggtggatgggaatggaactatgcattcactggtctaacaagttttatttgggtttcattatagctagagtgtatttctatgtacatttatatatatacatattgctcaatcgatactatgtgattagctcctatcctataaatttaaagtttagagctataacctgtacagaaggttccatattttattttactatgttgaagcccactgtttgctggttctatagatatttggttcacttcatttagactaaagatgaattttctacaaattttacattttaaggttgctctatgatggttattacttacataagtaagtatataattttattttataacttggaagtatatgttttggtgattatacagaacttgggtttattcaaaaaggatctaagatgagttttatataaacttctaaagttcatcttatgccaaactagttattttaaagataatagttttagaggcatttgatgtaaagtgtttatatgttttattttaatttatttttagagaacatgttggtggatctgtagaaactaagtttgctctaaaatgagttgaaatgaattttgtatgcattttataaatttgtgcgtgctttatgtgtgatttaacttggataaattttagaggctaaatttgtactgtgagtgcaagtttttattccataacatcaaatttcccaatttggtgagttcacagaaatttgaatcatcttaaaatgagctatatttaattttatatggattttacaagttttagttactgttcttttataattccagattttgtttccaaggggtccactgtcagtgagagatcaatatacaaaaagatccctgaggtttctaagaatcaacccgcagacctaggctcatatgtcagtgaattgaaaagttgcacattaaaccttatagttgtttaaattctcgaaacaaggtccctgacttcttttctcacgcagagaggcagaacagccatggctgagctcgatctcaagcttgccagcggcaaacggtggctcgtttgagggtgcgaccaaaagacaaaatgaagatcatgctattgcgattccattcctcttcttttcttggtcagtggacatcggagtaacgccggcggcgagtccgagcggcggctgtgcttaggctgctactgcatgttgagttggtgctcaattctaagtgaatgaaatgcatgaatgcaatcctatgggctcaagggtgctcaccgaaccttgaacgaggcgccggaaagtctggacagcggcagcggagaagaagatggtccggcgacggtgtagagctccgggaagacggcaacggctcgatccactcatcgaattgacatgcatgtgttttcatggggttagtgaggtcccagggatggtgtatacgcgaagaatcggacaatggctcaccggaggaggcggaatcgacaatggcgacggcgaccggaggtggagaagacggtggacgatctccacactcgtagcaccattcttcaagattcttgaggggaaatggagaggaggttgaggtgaagctggtggcgtggtggctcgctccggcttgatctagattgatggcaacggcgacgatgtcgctgcggcggtgcgcagagcgcgctccagagctccggtgtgcacggcagcgttcccgccgattggctgcaccagagaggatgaaatcaaaaggagaaatattcggcatggtgaggagagtatggaacgcaagagaagaggaaacaaccgcggctcatcaacgattgcggccattgtcttcttcgtggccggcgatggagaaccagtggagaagagcagcgaggatgctctccctcggatggatcggcactggaatggtgggtgaagagtggcgacgcgtctgggagaggcagaaatggagctcggcgtttttagggcgtcgacacgtcgtggccacgcgtcgcgcggcgtccagagccggtcggcgctcgatctctccctctcagtgtttctcggtcggctagggaagttgcacagaggaagggcaagccggagggactgacaagggggcccaggtcgaagtaaactaggtggaagagagatgtgtaggcagagacatgggtgagcttggtttttggacgaatttccggaattattttctcctctaattttgtagcttcaatacttaatgtgttgatcagattaactagtgttgattttactggaggtaggtgtatgtacctagtttccattttctttggttgcactcaaaaattatggatagattactcacagaaattagaggaatatgggttctttggaaactagttcgaatttttaggagacctaaatagagaagataaattctggaaaatttatttttattcattataaatgacctagtatttgaataaattattttacttatacacttttatgcagttaaatgcacttttagacaaagtatggttttagccgattaagaactacagttaatctagtttttattagtttgactgatttatttgaggtaccaaatttagttattaaatcataccaaaattacagtgagttgcatgtgttgattagagcctacatgaattttcccatggttttatcttgcacgaattattttagataattcgcaagacttatgtcttatatatgtttccctttcctaaatgcatgtaaatgtttataaaagttatatttggactctcattaacctgaggtgatgttgatatgttagaattacaatttacattacacaggtcataagctccttacctattatgcacaagtttactttagtattaaattaagagaatgcttatagagatgattaagatagaatataccctatatgatataatttatttggtcacttccatgttcatgactagtcttcagatggatgaccaaaatagttttgtggggcttgacattggccttgttgatatattttaaggtgtatggtttctattttaacttcctctagctagcactaggccctaatggtttagttgtttatctagatcttagttaatattcatgagacctattatgaaatgcaaatcgaaaatccaaatgcaatccaaatccaaatgcatatgaaggactcaagtcaaacatgtctatgagagtatgcatgcttacacataaatttatatttttgtcctaggttagagatgcaaaggttttaatttgttttaaaattttatcatgcaagagttagatcaacttcacctaggtttaaaatggaaatttttggtttacaaaattgaagaactttcctttcaactagttttgatagaaattccttaatcctagaattcgggtatgttacaccaacatgctacctgatcggcatttttggcaacagccatgctatgcctcgcaccatccatccatcccaaaagagaagacacaaagacaatatcaaaatccgatagcaatagagctgaaaggcattgtcgctgccaaggaacccggcttgcttgtactccctatcacctatatagtccatggcaagctctctccatcctccattgtcaacgtcatcatctccatcctcttccttctccaaagaaaacaaagggcgtgccaccgaagtggaagaagtagagggcaagaagatgggggattgagcccagagcgacggcgatgtgggggaggtcgacataaatggtggttgcacggacattcaccagcatgagggggaagggggacagacgagcatgaggggaacaagggagagagagatatagacttggggggagggggggatgagctttacgaaggtccagaggataaggcaatgtgtgtgtggtggcctgatactctgatctgttgaatggatttcgtcattaatttatcccgttaggacaggacaccgttgcgtagattttctgttttttaatgtgcttgatttttttgcttcctaagcttttcttttgcagactgagttgatcgttgagccagagaagttcacacctcagagctgtttaaagcttcagacgattaacaaggaggaaaaactcgcaaaacaagatctggtatgtttctttttttttctctatattgttccttcttttcatgaattggtaggtttttgttgcattagctcacactaaaatgtcttagactatacatatttattgttttagtacatatgcacagagaatctctgacattagttcatttttttctatctcctagctcttcttcccaattgtttgggacgggcactaggtgttgttatgcatgaatattcttcatgaccagatcaattatttcgacccaaaatgcaatgactcaaaatggttccagtactctcagaacctggtaactatgtcagcacgttccattttattatgttcaattgtttcagcacaacatacatttgtatctcgcaactcattaactaatgttcctgcatttgtcaaagcatagtaactatgcatgttccatcttgttttctacaactttttcaacacaacatatattcttgttcgcaatccatgagctaatgtttcaacattttccttatgtaatgtagctgattaacttctccaaggttgcgcttgatgccaaaattgcaataaaagatataacaaagtttcagaaccactccaccacagtacccactacagtccaatgcgtaaattgcttttaaattacttgtttcaccttttttttcattatactgtttttcctatctcatcaccttgtgccatcacttatttttttctcctaggtttgattgtggctttttctgcatgagatacatgaacaattgggatggaacaaagatggactattttgatgacagtacgtcagtaccatgaacatctacaggaagatcatgacttacctgttagccaattcacatttggcgacaaccgacttcagacaactccctccaaagcagttagggattagtctggcctcccacctcctcaatttatccgataactttcgcataacttttgtctagtctttttgtttgatgatattttggttatcctatacatatgcaaggaatatttgtgttggccaaagcaagaaacaagggattatctatgatcactaaatacatgtgaagctagcttgatgcatgggccatgcaaatgtgtggatgtatcagtctggccaaccatatgactcatgtactcaactatatatgtgtgctaaatatatacatatgcatgaaccagccaacaagagagtggagttgcatatatatatatatatatatgtgcgattcatgtgcttgcgcttgtggtcgtttacttagcaaatacgtatacgtataatagatgatctttcatggacttaaagaagcagcaagctgggactagctctgggctgcatatgggctggtgccagtagttgcgctgctcgtgtgtatgtgcagccggatattcacgccaacgggagtgagctactgctgtggggataacgtcggatgactcattcttatctggatgattcaaatgaaggcaatccacagcaattgaacccagaggcatcgaatcgatctgacgcgcggtcgtagcggcgccagagaatgcgcgtctacccgttaggccaccctatgcctataaaacccatcgaaagcaagccaggccaaggggagaaacacacatccatccattgacgagcaacccttcatccgcattcattcatagcaatattcacacacattcctcacacattcaacgacacagccatcgagcaattcactcaccatcaacacacacatatgcagagatcgatatcaaaagcagctcttctattcctcatctgatcgatttgcacaagcggcgcagacgcagcctcatcggagtagccaggcgggaccagctcgacgggaggagacctcaccgacaacaagaggcagcatcagatcatgggcatcaacaacctctgtaccatgggtaatgatcctgtggctttcttattgatttttctttttcagttcatgcatgcatgagatggcgatggtgatgagatgctggagcactgctagttggcgcccgcacgccgtcgtcgagtttgccaagtctcatggaagtgtcatttgtgggaccaggaggcaagccgccgtttttctacgtcgtcatgaccggccgaatgacctcgtcgcgctacctcgccggagcatgttgtcacggcatcgtgaatgtcgtcgagtcgtgcccgactgaggaggtctcgtcggagtcgtcggaaacgtcgccaagtctcccgcgtctacatcaaccaaacacatcattgggcgatggagattgtcgcactgccctcggagccatggtgctgccctcgtcggagtcgccgtgccaatcatctgatcgacatcatccagtcgagtcgctggtgatgacactactcgttgctgtgatctcatcgccgacgtccgccggccatcttcggtggtgttaccatcttcctcacactcgtcgttgagccgcgtgacgagaatgccaatcgaagcgccgctagctgctcggtgcccgcatcgtcacgctggggttgctaagccgttcgtgatgctgtgaagccatcccttcatcacaccggagcaccatcgcttggtgcccgcacaccgtcgtcaagttcatctgcgatgctttcacctcgtcaagccagagtcatcgtgccgtccgtccgtgtctccttttatctatagtaacatgatgagatgccatctgtctacaacgcttccacttcgtcatggcgagatcgatgctgtccgtccatgatgcactctctcttcatcacgccaagatgagatgttgtccgtccgtgattctctccctcttcatcgagatcaatatgccgccgcttgtttgtgtattggagcgtcgctcgtctatatcaacatgaagaaagaatagtgccgtctgtgatgccaatgtaccgttcgtgttagatctacaccaaccaatgtcctcggctattccgccgatgaggcatttacttcttccaaggtcgccgttactatcggcacactcatagagccccttttgcaggctcgtcatcatatcaaccggatcaatagtagattcatcatccgaaggaggtgccaaagccacgtttgttcggttattgtctgcaccaacttcttcatcaacatcttcgttacaagtccctgttgtataagggacatgacgagtcaggaggtgcttagccatggatatccggctgccatctacaccaactgtcatcgtcaactctttgttactttgatcccatcaagtcaggaggtgcccagccatggatattcggctgttgtgtacaccaactgacttgaccaactcctcttccctttaacaccatcctgatgtcgttgctgatccaagcgacacgagatctatgcatgttgaagatcaatccatctactccaccacgttgctcaagactgatgaggcggagcgacgagggtgggcggagcctatatgaaggctacatcaccaacaccggcgcacggaccgatgaggccgcggatgcgttgccggcgcctagatatatatccacaatcttcaccaacattcatcgtgcatggagaacgtgaagcgaagacgacgagacgaccacatgcagcttaatcggaggtgctctgtaggcctaaacctgtggcagtaattaactaggagtctttcgagaccccaggaattagaagaccacttatccaagtttagatttgtccaacgacaggctatggagcgcacatacatatatacatatatattacattgggaatttgtatttatgatccttgagattaataaagcacatgttccctatgttttctgtttattttgtgtccttagttacactggcacgctctcgcatatcgttaccgtttgttatttttttttgtcctaaacacttttttgtgggaaagaacccaaattatgtgtgctcattttactttgaatggcattttttggaatgtacttatttattatggatggtagttggaaaagttgtgcacataaagagttttgagacttatccaatctgtccattctcctttgcacataaagagttttgagacttaaccaatctatccgcttcactgacatcgttagtcaaacacggaggtacaacagcaaagcacggtgccagccgcacgcaacaactgcctccatgacagtcaccacattctcaaccaggagcaaaccgttatttctctgccaatcactatttgtcaaggcatgcggtgttagtgtatctgtataagtggatgtatttaatacaaagattgattctctagttaattctgcatgtcaaaagataggagtcaatgcttaagacacctatacaatgttatggcaaggttttagattatgataaatcactgtcggagtaccctttacactgaacttaattattgagattcgttatcgagaaagagccggacagtgaatattatctatttaaaactgatgttaatttcctttatttatatatgtctataacattgtgttttgctgcatgccaatgacaatcgatcaaaaatgcaatgttagtgatggattattgtactgtactattccattacatccagatatttaagatgttggaatcattgcaccccatgatgcggtttttcttggatttcatcttctacaatattcaaaaggtgttgatgcatgttactagactgcatcgtgaagagttgagctttaatacaacttttattggccagaacaagatttttcttcatggccctacagtgtcatttgatgcaagcccatgtgctagggattatacaagtctttacactatatttcctgtaaggtttgggccaatgtatttactgcatttcgaatatctccttgaattcttaaggacatgtccttatggggtgaactctagagattaagcaatagttgtgtttgttacatatcatcctagtattgaatcatatgttgacaggatgaaacaactgatgattttacacaatttgctaaatgaacaccctagacatcatacggctaatgtagttgctctggaaggatatacttgtagatccaaggagttgtccagaactcaataacgttaccaaccgaacagggttccgtcaacatggttgaattccttgcatattgatgatgcaagaggttgtctgcattttgctaataactttttgaagcatgcaaaaaatatggttcatataattcttactacattattctttcactggtactgtgtttttctctaaatagtttcaagaagaacaaaacgaggtagcattttctctacacatggcaaactttttatcaacgatattacaaaggcttgctcgacttgctcaacgcaaccaaaacaagccatatatcattgacttgtaagtggatctcaagtcttttccaatcgagttcaatctcaaatctctcaatcaagttcaaaagatggagtgtgattatttatgtaggctttcaaactgaatgaccgacgtaaggacgggaaattaggtgcaactatgctaacttgatcagaaattgacttatcagaatatcattatattcttcttaccatcattgcattcttctcttgatctgtaggaaacaatctgcaggtatttcagttgcaaagttgtgaatgaatgttcttgtatctgttgtggctagttgttctggcctcatggagatatgtatggtatcaatctggggacatcattagtcatactcgggtgctgactatcgctgcgcagtgcacgtcgcgctcaccagactgacacatgaccgtcgccagattctgaacgcacgacagaccgttatttgtcttgcaattactgttgtgaacggcatgccggggtgcttgatgattgggaagacaaggcttccgtgctctatatgattatttggccagtccggcgggtgaactaataggaatgtaagctataaacgcctttatcatattatgggttggtatgtgataatcatctagagatgaaagtgtgaacctaacgcccatcctgggaactagattcacatgagtatgagttaacaatatttgagatgttgtagatctttagccatgtttgtcacgtcttctgaatgggtaacacatctggtcaccggcttcgagtggattgaccggcacatatcatgcttgagttgactgggaggcttaagggcccgtaatgtctccatatttctctctggaggcggggatatttcattttcttgtgcgatgacttggatattcaatttatccataattaaaggggaggtccgagaacctaccacggcttggatagagcaattccgaccatggagcccgtaagacggcgtttagaaggatccctaaattttttggtccatgc

SEQ ID NO: 60 - DNA, 4603 bp, Oryza sativa
  unsure (1)..(4603): unsure at all n locations
attttttcgttgtttcttggggcgggggtgttctttcccgagtcggaagagaaggagaggtttgggttctccctcataagcccccgggccgacccggcaaaaggggggcctgcccggtcccccggttaggagcccacgagttccgttcttaggcgccctccctcccgtccaaatatatcctccctttggtactccgacatggttttgagaatgctcctttgaccagcaatatctatagaaattaaattgttttaaataaaaggagttgcatattatgatagtttgtttaatcataagtctagtaacatcatttttccgtgattattcttttttttttttttgctattaatagtcagagttaaaattgtttggcttatcccttttctacaaatgtttatattttcggacgaagggaatgagatattaggactagatgtgatacttcataatactgcccatctattcagtttcatagtgctatgctttgtctcatccggttctaatatctagtgttttggaagagagagcgtaatatctcgtgtgttcattagcgactccctgtcatgtgtcctcgcgggtgcgttcctacctcattcaatgtccccacattacgcccagctatgcctttttttggttagcggttttcgtcagcacatatctcgggccgttccctgttaactggtcaactgaaacacctccagatttcttcctacagttcaagagaagaatgcgaggatggtatgaggaatatattgatagtttgaaaagtcaatttctgatcaagttagcatagctgtacctaatttcctattcttacatctgtcattcggtttaaaagcctacataaataatctcacttcaccttttgaacttcactgagaaatatttgagattgaaattgactgggaaatattttgaatccacttacaagtcaatgatatatagcatgtgttagttccgtggagcaagtcaagcaagcctttgtaatatcattggcaagtagtttgtcatgtgtagacagaatattgtcttgatttgttcttctaggaactgtttaggggaaaacacaattttagacttaaatatattttcaccagtgaaagaataatgaagtaagtactatacgaaccatgtttcttgcatgttttaaaaaagttattagcaaaatgcagacaaccccttagatttcaatgtatatcctcccaacgcaactacattagccgtatgatgtctagagtgtgtatgtagcacattatctaaaattattagttgtttcattctgtcaacatatgattcaacactaggatggtatgtaacaaaggcaactatttactaatctctagagttcatcccaaggacacatccttaaaaatttgaaagagatgctcgaaatgcaatgggtacaccggtccaaaccttgtagagaatataatgtaaatacctgtataatccctacatacagacctgcattaaatgacactgtagagacgtttactacagtaaatgcatcatgatgaaaaataatgttttggctagtaaaagccccattatagcacaacccttcacgatgtagtccagcaacatgcatcaacagcttctgaatattgtaggaggcaaaatataagaaagaccacgtcttggggtacaatgattccaacatcttaacgatctagatgtaatggaacagtatggtacaataatctgtcattaacattgatttttttttatcgaatgtcattcacctacagcaaaacacaatgttacaacgttatagacacgtataaataaagaaaattaacatcagttttaaatagataatactcactgtccgactctttctcggtaacgtatttcaatagttgagtttcgatgtaaagtatactccgacaatgatttatcatagtcaacagtgcataggtgtcttgagttttgactcctatcttttgacaagcaaaattgactagagaatcaacctttgtattatatttatatccacttgcacagatacactaacaccgcatgccttgacaaatagtgattgtagcccctgtaaaaaaatggcaaaagagcataaacaccagtatataacaacaaagaacgaatgagagattgaataaatcttgttaatacgatgaagtgcatcaataaaaaaaaagtggcgtacacattactctaagttgtttacatgttataatcatgtacagagattagtttcaatattgttaaaaattgaaaatctaagataattatgtatatacacattactaagatgaagtgcagcagtgcattcaaagaagtggagcacacattactctaagatgtttatagattataatcatgtatacatattagtttcatcatttctctctagattaaaaattaaaaatccaagataattgtggttagcttcagaaagaaaggaattacgtcatactgctttgtaactaaaccgtcagcccaaaaagtagacaaatttatgcatgacttgagaattagaggggatcttttttacctagacttgagcaagtaagaagatggcgcaggcacattttgcttcacatggacttccttcacctcctcctgcgtgttcctgtagttaagacaacccaaaggacagaatccgcaaaagagcataaagagtagcaaatagcaacaaagaacgaatgcaagcatgattccctcccaatgcgaagggctgcaccatcttcacccaaaattttgttagtaagacaaaaccctctataattgccaatgcattaagaaagaaaaagaaaagaagtagcagcatgtttgcattacacatgggaatagcatagtccattctcggtcgcatccaaaggcagatggcgagggaggtatattcgaacaagaaaggaagaagataggtatattatgggagggagcccttagtagatctaaggagacacacacagcagaaccaacaaacaccacggatgacgtgtacaagaaaaggtaccttcttcttgcatagcgtagagttgccggagaactccatccatacgagagctaacattgctacagccttactagctggcatacaacttggcgcgtgcgcttccgtccccctctccatcgccagctgagatttattctcacacccctacagtgttttcaggtgcttaaagtgacatgctcgcttgggggaaacgggagtagaagcacagctgcattccacactgccaccttaatctttaaagttgtcatgatttttataataaaggaattgtacccttgttaagttgcactagatgaatctgagagttcaaattagtttatttcatccctgaatgttcctttctccttttttttgtggatggctacttgcaatgctatacttatatttgacgcttccgcaatgcttatgttttagaggagttgctgtcaaaatttctccttcttcattaaatgtatttctatttagtagcatcccggtgtctttgtagtttctggggtgttacacatcacctcctacgtgttcctctgcggtcaagacaaagacaacccaaagaaaagaatcgacaaaagatcaaacaacggtagatagcaagcaagaatgaatgcgagattgatcacatcctgcaagtaaggcgaagtgcaacaatgcatcaaaaaacaagttgcatgtctgcacacttcaatcggagcccattctcggatgcgaagcgcatcctaaggcctggcggcgatgcacgcaatcactgtcttttggcgcaatttcattttcaaatcagacatagatttgctcttttttattctatgtgtgtggggtcaaattttcatttgattcttttttattttgtgtgaagtcctagacgacaacatcacctatgcacctgatttttcttttccagatttccaaattactttctagatgtgtattgtaacacttgagcggtgctctaggagggagcagtatccgtgatacattcttgtatgatggattgagtacgtgatacgtttgaggtttaggttgtgatggggaaatatgaagtgagaattctaacatagagtagatataagggtgcacacacggcagaacgaagaaacaccacggatgacagcgtaaaagaagaggtaccttcttcttgcacagagtagagtcgcccgagaacacatccatgcgggagtcggtgtcactgcagccttagcagctagcgggctcgtcaagtcaaagcagccactgctcaacgtcgagcttgcctttgcagccatcgccgccgcatccatgcagcccttggtagctttgtccacgtcgttgcggcaacaagcgcatgcgcttctgtccccctaaagcacatgtctaccgcaacaacaacatctttgtcaatgatgacacaaatgatgctcgcgttcagtggatcaagaacaccaattcgcagtgtgttccacagacctcctcatcccttcacctcgcagattcgaccaagcaccacctgatgctctagcgtccagctgctgccatcgtcgttaagggcaaatgagctgagcacgaaaggatccttctaaaacaactcgatgtagcgcaacctaccctcgctgnnnnnnnnnnnnnnnnnnnnnnnnnnnnnnnnnncgaatgcgg

SEQ ID NO: 61 - DNA, 1155 bp, Oryza sativa
  unsure (1)..(1155): unsure at all n locations
ccaccaggcgccggtgcataccntgctcttgtattatatttgtgctgggctctaggcacacactgttcttcgggagctcaaaaaaaacgagctccacccggtcgttgaacgggtcggtgaagacgatgtaccatgtcagatcgagccacccaagctatccaacgaactccaccgcctcgatgtacatgtttatctgccatggaaccggaagcggggatggtttcaaaaaggaaccgccgcatgttgaaggctccactgttactgtcctcgcagagcacggtgacgacatagctgtcagccggcccgtggccggcatcggagcaggtgaagaggctagtgttgcggcacccggggaacatggtgctccgcttggtgccttcgatgtccgggaggcggaacagctcgccggtgagcgggttgcagacggattgcatgtattctggttctgggtcaccgaggtggcttccgcgagtggcgccggtggcggcgacatgcttggagaggccgctttcccaagtagcacgggctatgaggtcggagacgacagaggccgggacgcgggcatccatgtagatgaggtggaggccattgccgcttgtgcgtagaccttgccgcttacgaaccccatggtgtcgcttgttggtggcctagctcacaagatcacgcactcacttattgtttacacactatagaaagagtctaacagatgaacataagaactctcacgcacaagcgctagatgtacgcacaagcaatattttgtggcgctgcgcaccagcgcgcagctaatgcactgtctattctccacaaacaatataactaaacggaatgcttacatgcttaattagccacacaataataaaacaataacttagccacgattggccgcacgacgcggccgagcattctcgtggctaagtacccactcactaacttatcgacatgcaagccacaattgcttgcatgcagatcaccactaacatatgcatgcatgctagctgatccacacttcacgccataactctcacttcacttgacttggccactcctccaaggcaacttgcactagctgcatgtaatcannnnnnnnnnnnnnnnnnnnnnnnnnnnnnnnnngtncaaagcggatgctcatgttcatcatcggnggcggca

SEQ ID NO: 62 - DNA, 7545 bp, Oryza sativa
atggcttacagatcgacattagcacatcatccaagtatcctagcccactcctaagcaacttgggactaatacaccactaagaatgtcatcttcttgcttcaccttgagggttgtcaacgtcaacaccattttgctattgggactattctcacctacactcattaagcatattagtcccaaatcaattatacctttgctttgatcaatgcccactttggattttgacttgatgttcatcgaagaaccacatcctcttgatcctcggcattccatcttgcggtcttcttataattgatacggattactcatagcttcaaatggcctcacatggtccatcatgaccatcatgacaaagccttcactcgcccttcaccaccggattcggtccatcggcgccaagcctcttgcttgcccttcaccccacgcatggtctattgtagccgagccttgcttgcccttcaccgttttgccataaatagtcacttcatactccgcatcatcaatgccttcacttactcctcattaaggtataatgtctgtcacgcccagaaattcaatagcaatttccgaacttatttgtgcattaaatcctcgtgcaggaatcagccgaggtacacaaactaacaatttaatatacagattcatcaatataataatgttacatacttacaaaagaaaagaaaactgcagcggaattacggtctagcgaagctccggctccactcccacaggtagctcaactggggtataagccaaacgtcttctccttcgcaacttgtcttcaactgaggtttgattgattattgcaaggtgagcatatgacatactcagcaagccacacagcaatatgcaagtgcacaaggataccaaaggatggcataatatagggctcatttgcaaaagcagaatttagcaaacatttgagaattgtaaaacagtagagtaattaatcatcaatattaatcaacactgaacagcacacccatgctgcacaggcccaaccatcctgaataaccatacccggctgcacagatctatctccaaaccaggaatataccattccaaaccaggagctaaattaaattattaccagttatagcatcatttattatggtgagaagtgtgagactaatcacgaaagacattgttagacccgcccatgaccgcgggcacggctattcgaatagttttattctggccagaggtgtaccactgtacccacaagacacaacccaccagcatgttaccgtgtccgcgcagacacgtcaccatgttgagtgattgtgacaagacccctcgcataactcaactcaaagcagtgcaccgttcccggatcatagtcacccccttataaacaaggcatggactccccagcgacccccgtgggcttattttcgccacttctcagtctggtgctccgcaatgagtcttgttatacaaagtgtccagccgttgcccattatggcttgtggttggcacggttaatgtttcacaaccgaaaatcgtgaaccggtccttaattgtcatgagcacgaccatcaaaaccatgtgctcacaacccaccattatcaagttttagttggcacattaattaattaaccaatcacgattgaccatcatgagctatcattaaatatccatcattaagtaatagtgaaacattagttatcccaattgtgtgctaatgtttctaagcatggctaagcaattatgtctaacatctagctgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggaactgtgtttgggatctgtgtgacttgccttgcaataaagggtcttcaattaatcttcttaacacttccagcgcactcacgaaccttcgaaacgacggaaacgacaagctaacacacaaaacgaggaaaaagactaataaaaaccaaatagacaatacataaaaagtaaacaaacatgtagatcataattttagatgaattatgagacttgaacggcctcattcggacttcatatgaatttattacgaattttacaagattaaatctaattaaagcctatttaaaaaggattaaataaatttaattcaatttatggataattttaatatgtagatctttattttatacaacttttgcaacttgaaccacattaaactgagttacaaagaattagttatgaatttttaaagattaaaccggattaaagcatttttatggattttaattgaattatgacgaaataatgaattatttttaaaaaggaaaagggaattattgcgtcatcggctagggtttgcggaggaccgggtgcatggcgacggttcacgaaaacgaacgaccgagattcatccatccaaaagggatggccaagatccattggtccacgaccggaccacggcggacggcaacgatgacgtcggcgatgacgtcatcaccggcgacggctcggcctcgcgtgctcgccggcgaacgatggcgcggcggcgcaaacggaggacacctacgcgtagcggacggcacggcgaactcaccggtgaccaaaacgacggcggaagatcaacggacgacgacggcgacgaggaagagtggcggcgacgatcgggtcaacggcggcgacgatgctccggcggctgacagtgacggcgaaaaggcggacgaggacggcgacgcgacggcgaccacggcggtgacctccccgagcgacgatgacgactggagcgacgccggcgcacggctggagcggcggcgacaacggcggcgcgaggcggcacggcgctagagctctaccggctacgagagactaaggcgagggtggcggcgggtagaggggagctcgggggtcaatttatagggggtagggagcggcagcgaaggcccacggcgaccggcgacgggaaggaaggtttagggttcggaggagagaaatcgatccgaatcgaactcaaatccggcgatttccaaagcgatttagacgatgtttccaaaagggaaaaggtagagtggatcacggggatcctttcccctcaatcaatttcaccggaaacggaaagggacgaccggatttggaatggcggcggcggcgcagctcggctagggtttcagcgagaggaagacgacgactgacgggtgggacctacctgtcagcggcggtcgcacgcgcgcgcgcgggcggctcggcttgggccgacttgggctgagggagagagagagcggtttgggccggcttttggcccaaaaccaaaagggacttttaaaaacctttttccctttaaattattcatgaaatgcaattccatttattaaaaatacttccttggctcaaataaatcccagaaaaatctaggaactatagaaacaagagaagtatttaacaaaattttatctagcctacttttatattgagatttaacaaattaaaattagatcttctcttctaggcttttaaaatcatttctaataattcccttttagacaacaatttataaattaaggatttttaaacaagaaaagcacttaacataattataattagatcattaatgattaaataattactgaactgttctttgtatcatttaggaattgagctccgaaaaatccgagaaaatttcagagagtataattaatcatggagaatttaataaaaattaaatccatccatgctttaaatttaggaaattttatttcccacatttaacttcacttgtaaattaatgaacatttaatataaattctattaataatttattagataatttataaatcctaaaacaaaaatctggttgtgacaatgtccatcttctagccgagccttgctttctcttcaccggtttgccatagatagccatttcataccccgcatcatcaatgtcttcacttgctcctcatcaaggtataatgtccatcttctagcttcaatcttttaacttgatgccggaacttaacctaatctcaccaactcatggaaatagttagttccaacaatgggttgtcattaatcaccaaaacaatcaccgcactcttaggatcatagatattccaatctccccttacaaggcaattctagtgcatagatctttcaatctccccctttttggtgattgatgacaacactaccacaaaataggaatttaaagagaatactctagtatatgttaccatgagcatgaaacatatactagagggttggtttcatcaacatatgaaacgagtatacactttcccctctatctatctctctttatacttctccccctttggcatcaaacaccaaaagattgaatgtttgggtgggagcataaagaaaaagaaatcatatcaagtatataagaactacacaagtcctatacacttgaaggagaaaaggtttaacatacctttggtgttccaaagaggctacaacaagatgaaactctatcaaaagcgttagtttcaaaatagcaaagtacaaatagcctcgaggtacacacaagaagatatacaagaaaaacatgtgcaccaacaccgaataaagcaattgaactcatcgaaattccaatagaaagagttggagtccaaagaaacaccaatccaaatcaagctctttttggttttgtgcatatgaaccacaccaattgatagaagaataccaatcaaaagagatagacctagataatagtcacaattggtaagaacccatatgcacatatagcaaatacattgattagttaaactcgcttaatttggagcaaggcacaaaagcatgattccaaaaaaaaaatattttatctttaatgcatctcccaaaactcacttaaaggagggcaaaaagtatgttgggcatatgatgctatagacaagtcatgtatgcccgaaagaaatgtctcataagccaaaacccaataagtagtgatgatgaagagacatatcaagacttatgaaacatcacaacataggatgaactccttctaaatacgtgcataccaaagagtgaaaagaaatcttatgcactttcacaaaagaaatgaaggaacacaagaatccatcctatattatgaaatcaaggttgcaaagaaaattcatagaagcaataatgaaatctaccttaggagtcgtccacttccgacatgagactaaaaggataaactcaatttaaaccattagtcttccaaggtatagaataaatttcccctcaaggtgtgcatataaggataaatttaatgcatacatatgcactttactcaaatgagaataggggagtagtttacactatattttgggtcaaggaggcaaatatcaccaaaagaaataaatttaaggactagaattgtaaagcacactttcataaacctcacatctcaagatgatggtacttaaccaatctcatccttcgttatccattcctttggttatcataaatcaatctccccttgatccatcattttctcttttctctatttgaatcaatagaaaagagaaagcaccaaaagcacaagagtttcacaaataatgatcctttagatgtggaggaaaattggatcacttattcgtgaaactcataatataaattaaattctcccaaaagtaatgcacacatactgtggaaggcaaatttatgtgcactatttgacatttaaatcaagcaagggaatttaatctatattatgaaaggtagctaggtaaaatataagatgaaaaggtaattgaattaccacttgtaaatagcatacatttgagaatgtttcacttcccatgagactaaacataaaatacacttaacaagaagttagtctcaaaaatacaaaacataggacatgctccccctaaatatgtgcatgcaagcatttgaattacttgatagaagcatgcacttgtctaatgaaaagaaatgaggagtacaccctataatttgaacaatttgcacataaatgatttgcaagaatatacatgtgccaaacattgggtagtaaaaatgcatgtaaattgccacaagataatagatgaatgcatggcaatctaccataagaaagaatattcatgacacttgaagcttgtatatgtagagatgatgtaaaagatttaccattggagcatacaagtccttagtagaccgggacttccggttgacacatgaaggtaatccaatccatgggctgaaaaatctacaacaaacctttgagatagatcacacgataatgcacaaatttcattgtgggagcattgcacctttctcaaccaacatgcatgtacaaggatcacaataattaagaaagctgaaaatttgaagatgttcaaatcttggaaactcaaaaaataacttagaaggagcattgaaatgacattcaaatgacctttgataatttagacaaaatttggcaatgaagtccaactatagagaatcgaaagtcacaatgtaagctctttccaaatcacaacaacacaacccattttgagatataaagatcacgaattagctcaaagtcagttttttctgaaaatttctacaagttgagaaaagagagaaaaagtccgaaataattcaagcttgcaaaaaatatctttgaacttgagagaaacttctccaaaattaatttcactaaatgaattttctatcaagtgtatgacttttaaaacaatgaatttcaaccaaaggatttttttaagaagtttgacatttggaaagacttagatgggttagaaataccaaattaggccaatgttcacaaagaacattagtcaaattgcttaaacccaccatatgcatgtttggaccaaatatgattaaagcaacatgttggagaaatgacattttgttccaaaaacaaaaatttcactccaaaagctttttagaacacttgagataaaacttgaaacgctttgaaacatttttcacaaactttggaccgtcaaataagagttttgaatttttaccagagggactcttttagaaaacatttcatgtaagcttttgaacttttgaattttggaagcttgagctaaaagtatttgggtcaaaacaaacttttcggttaagccaagattttaaaactatgttttgaggcaagttggaccggaagttccggaaaaattggtaggaagttcctatcaatttttccggaacttcctatcggccctctttgtctcaacagagactgctgaccggaacttccaagcattttggccggaacttcctagccgacaaaatcagtacccgagagtacccgagaacttttaagattttgctccaaatcacccgaacaaactcggaatttcacgaaatttgaaccacaagctcacaacaacatgggaaatcagatgaaacaagaaattaccaaaatatttaatatttcatcaccaaatttaaagaacttggaaaaccaaaggtaaaaaccaagtttttgggaaaccatcaaaaaccatggtgctcgtgcgaaggg

SEQ ID NO: 63 - DNA, 3355 bp, Oryza sativa
  unsure (1)..(3355): unsure at all n locations
nttaattcattgctcaaaaaacgataaaatgttgaagttccaacaaaatgacccaaaaggcaattttgagcgaatgagttgttttggagacgttttggtttttatgagtttgaaatacctccatgaaccaatatacatcacaatatatggttctagtggctaaactcactcgatgccataataggaccaaatatggtcaatataagttttcatgtgaattttgagatcaaataatttcaaatcgtttatcatataaaatatatttaaataccaaaaacatttgaaatgaccaactctagtggcttgacaaaaggattatttgcaaaaaccttttaggacatattttgacataaacacattttaaaagcaaaaacaagatcctagcatctacatttagaggctaaaaacattttctttccaaaacttatttttgttttgaatcaacttttgaaatacttctcaaattggtgtaggaacctttttgaacaaacaaaaccaagttttcacaactaattttatagagtttgactttttaactaaaatagaattttgaagactattatagcatcaatttaatcaaaacacatttgagggatgcaaatgatttgagaagttataacactctccctaaatgtgataaccaaaacattactcgaaattaaatttgaaaaatgaatcaagcaacattaaaggatagacattatacacaagcgaaaacctacacaaggttaggacatagatatttcaatgtaaatacttgttaccgagatggcattggttcttaatgtagagcaattattcacatccttgattccatatttggctcatggtacaaacttagttcttcaaggatgaattgagcctccaatgcacctccaagtacctaattgacaatctaagcatattttggtacccaaatcacgttgggtccatggatgttagtcacaagagatttaggcacccaaatggcctttgtgctagcatgtagtgaactaatcaccctagtagcacaagtgccatttatggccttcctaagcaaattgtgatgaaatgagaggtttggcttaggaatgttaccaatgggacaatttttaccaatatgtcccttagcctggcaattgtagcaaagttgagttttgcttttatcttgctttttgacttgtttgttgccggtttgcctcttgcttgatcggttgcaatgatcatccttcttgtgaggacaaaatccaatttcatgccccttctcatttcaaccatagcacttccttttgttgattctagatgtctttgttggaagtgtgatttcatcatcaatcttgcgaggacaacttgaggcaaagtgtccctctttggtggacttgaagaacttgtgagcaagatcctcattcttgttcaacttcttctctttcttccaaggacaatctctcacatgatgtcccattttcttgcacttgaagcaagtaatggaagttttgttcttcctttgatcttgccccttgatcttgttgttggacttgatatcttcttgatagaacttgttgcaagctacggttgttcccttctcaagcttcttcaccatgctctcacggttatcttgagaaggttgagcattgccaacaagtccatgatcgatgcgcttatcctttttctctacataatccaggtcacatatagtgctcggaaaaatatttgcttgagagcaataagagttagcacaagtaaagtcaacttgaatatgaggcacataggattttaccgttgttatgatcacctcatgagttacttctagcatggcatgtgaatctacaatatttccatgagagcacaaaagttcatcatacttttcttgtaggtccacatgcttgctagtgagctctacaagttgagctttaagctctagattttctttctccaaagatgatttctccatgatgcaagaatattcatcggagcgtggagatgagcatcttggagatgtaaattcttcacttggccatttttttccacatacttcttccttcaaaagattagtttcacaagcactgtaggaggtagaagtatccacattgacgctactcaccatttcattaccttcaatgaagacatgtgtctatgaggaggtgaatgtggtgaggcaatcttgaccattggatagaatcacttgaggctctttacaaattgtcgatgaatttgagtactccacaagtggttcttctatagcgagctttacctcatcacactcggacttgtcatatctctccttgagtgtgttccaaatgagatgagcatcctcaagtggcatgatggattcaaacacatcttcactcaaagcactaaacaaaacattagtagcttgagcattgagatgtatgcatttctcttcctcttcaaatgatagcatttgatcactaggaggagaaatgctcacaactataacttgctctatttgaggacccatggccctaaacacataaagaatgcgagtactccaagacatgtaatttgaaccatttagcatgagaagttcaaggaaattttcacctcttgttgacattgtagcatcttgagtatcaaccatattaccccttcacacttttctcgccatcccccgacatcttctctccaagcggttaagccaatccagagattaggctttgataccaattgaaagggccttgatgtcgcctagaggggggggtgaataggcgttcctaaaatttacttcaaatcgcagcggttaaaatcagagcccggaactttctggcaaaaggtccggaacttccttgcagctttttctcacaagcagagaaagctgcccggaacttccggagttcttcctaggaacttcctagcagttgtgaattgctatttcaagcacctcacaacaagtaaattaaatcacaaggaagcctaaaccatagagaggtacaacatgtctcaaacaagagtaatacacatgaaaatacacaagatatcacaagtgatcgtacaatgggagacatgatagcacaactaggcaaataaggagataagcatcccaatcacaaagataaagagagtgggaggagacaaaagatttgttttccgaagttcggattctccactgagaatcctacgtctccgttgaggagctccaaagaaccgagtcttgattaactccttgcctcaccaagcaaaggcctaggaagaggtctccggtattcaagccaacacccctaggtacttctctttggtttcaagtgaccactaagatccctaacttgaacaccaagagaacaccacaagtgaggattgctctaccaagacgacctcctaaacctgatgngctncttacagagaagtccatcaatcgccg

SEQ ID NO: 64 - DNA, 837 bp, Oryza sativa
  unsure (1)..(837): unsure at all n locations
naaatgcttagtcgcgacgacagcaantaatccatgacactttgttggagnctaacgnnnccngggntgnanttnaagggaannnttgngatacaaaaanangnnnnaangtgatttttttgttannagnnannnnnnaaggaaaaaaagttttttttttattaaagnannaaaaaaganagccccaaaagcnnaaaanccaaannnnggnnnnnnnnggnnnnnnnnnnnnnggggngnnnnnnagngnaagaggaggggaaaaaagggannnaaaaaaagaaaaggnnnnnnggnggannaaaaaaanggnagnggaaaggaaaaaanngnaaaagaaaaaaggaaggngaaggggnaaaaaaaaagggaaagaggnggnaaaagggaaaaaaaaaaaaaaaaaaaagagaaaaaaaaagaaaaaaaaaaagaaaaaaaaagaaaaaaaaaaaaacaaaaaaaaaaaaaagaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65 - DNA, 47815 bp, Oryza sativa
  unsure (1)..(47815): unsure at all n locations
naatggtagattcgagttttctgcatgtcgcacatcaaanttttggtatatatacacgagtcccacatgtcagagctcattctctaacatggatggaatggtacacgggtaaacgaaagtttgtgttcatggacaggtaactctcaaattttttacggcacacgcgtaagcttcaacttacttaatggtacagggggttaaaagactctccctccacgccgcaacgcaaaggcagcaaaaccctctcctagattcccccctctgcttcgctccgccgcctccgacttcgaaatgcagcacccgctccgccgcggcgcccgtggcgcgcgccctctccacggccgccggcgccggcgcctcggcctcgcgccctcggtgggggatgatccaccacacgggcctgctcatgcccccgtcgtcgccgcgcgccgcgttccagctcgccgagccaccgtgcgcctcccacatcctcgtccccgagcacctcgtcgaaccgcagccctgcccccccggcatgatgcgcgcctgcagttcccacgcccgcgcctccagcggcgacggcctcctcgtcctcgacttcacggacggcctcaccgcggcccccgccgccggtgcgcgcggcccgataccgctcgacggcaagcaactgaagcccgacgtcacgcgcttcgtctgcaaccctctcagcggcgagctgttccgcgtcccggacatcgacgggacgaagaagaccttgaagtggcaactcgtcggcatcctcacccaatctgaccgccccaacgggccgccggataggtacgctctcgcttcgttcagctcaaacgccgccgccgccgacaacgatgagtggtccttcgccgttcggcggtttctctcgcaaaagggggaatgggacgagccggtggttttcccgtccccgctcccgctcgagcggccattgttcgtggatcacgatccggtgaccttcgccggccgtatttggtgggtcgacgtgagctggggcgccatttccgtcgatccgctcagcgaccaaccggagctgcgctttgtcgagctgccagggggcagtgtgatggagcccgtgaaggatgagaagcggaggggcctagtcaggtaccgccgcttgggcgtcagcgaggggaggctgcgctacgctgaggcgtcccagaaggagccattcgtgctcagctcctttgcccttgacgacaatggcagcagctggacgctggagcaccgggtggcgctcagccggctccgggtggatgggggactcccattgcagcaggaggacacgccacagattggtgtcattgacccactgaatgctagcataatgtacctcaaaatcggcgtgcaatgtatctccgttgacatggagaggggtaaggtgcttgggcgttctctgttaggtgatgagagttatactcgctcatgtctcaccgctctcctaactccgtgtgttctcccaccgtggcttccatcataccggataccttctgcaggttctttctcatgctttctttgagatgcatgttttccatacgatgtgaatatgcagatttttattgttacgctcatatgttctgatttgtccttgaaatttaaccgtgtggttggaggcctgtttatagtaggatgatttgtttcatgaataatctatgggatttttgcaaatgctaattgtcaagcgtctgaaagccacttaaatttcaatcgatgtgcctgctagctatctgattctgtttctagatgagtgtgttgtgcggattggtaattcaatggggtgatagatgaaaaaaattatgtatgtccagtcaactaacctatgctcttttgaatctgttttttttttcctatgttaatgattcatgcataaattctgtatcatcatttgtgaagatttattgtaggtcaggagagatatcttaatgcaattatatttcgcagtcttttttgttgcagtttagaattcactatgcaagactaatagactatactaaaactctataagttatcactttcacattttactctagaacttacatgcatttactttagaattattgtacggacggtacgaactgccaggagtggcttaatgcaaaatttcacattggtccaggaaaacttatctagactggaaccaaaataaattgccttgttattatcttgagacattgtctatgttgcttcctgcttcttgacaatgatcctgtcatacggttttgatgtaatgatgtaagtggcatgtagaagaaaaatataatcacattattttttctattagaagagtaaaaaacaaacatgtatatgggactataatattgtttttgtttgcttgtgttcctgatgaataaataaatattggttcatttcatatcacttactcccctcgcacgttcccactgcttaactttcgctttctaggtttctaaaatttaacaagtgtaagctgttctgatggattaggatttttctcttttcggtgaggtgatgtattattatgcaattggagctgtgattccaatttctcattatggaaaacaatggccgagtcctcaactttgggtttactgatgcatattgaacttaaaattagccgagtagagattccaaacatgaacccataagttggcatcagattgttagactccttttgggagcaatctgggaaaaggctgtcttacatgtcattcgaaaataaaccatatagttggatgttttttgatattagtattgtgtcataagtcatttccaatttcagttgttcattgaatggtggaattagttgctgtaatctgggaatttaggtaggcatgttgaaacatccaaaaaaaaacagaaatacccattgcaaattgcttgaaacttacctaaatttctgtcaacatgcatagccattttattctgtttgttgatgagtacgttattgatctgcactagcccaatgtggagctaaatggtgatggaaaattatgcatttacagccaactgagctgaacatgtttcagtgtataaacatggtttatctgttgaatgtgtcagagacaagatgctatgctcttgcatactgtatacgaatgtacacaaaagtacagttccatttcttatgttgtattggttaactccctcactgtaggaactccaaataccaagagcaacatcaaaagcaaaaccttgtcagacatattggttcgtgcagataaggacacgaagaattgaggtaaagaaccaagttcgcttgatactttattctgctattcttgtctaactagcatatggcccgtgcattgcaacaaaattttaattaaagaaaattatcattaacccgttattaccatcattttctacatatataatcttttaattgctgcatatatttgctacggatatgtggaccctttggccccacattatcctttttctttccaaaaagtagagagttggtgggggtggttgacatgtggaccctctagccccacctctcctttttcttctccagaaaaggtaggagttggtggtgggggtggtggcagaatcaccaccatgacaactctcttttaaaggagtactacactcttttaaaggagtatagacaacccgttattactaacattctttgcacatatcatctcttagttgccacatatattttgttactgatatatggaccctttgaccctacattgtcatttttctttccaaaatgtagagagttggtgggggtggttgacatgtgagccctctagcctcacctgttctttttcctctcaaaaaaggttgggagtttgatgggggtggtggcagaaccaccaccactattcccttttaacaaagtatagatgatatatttgatcctttcctatgttaaggaaacatgagtcctgactagttacttttgctgaccattactgtggtgcactttaaattaaattcacctcaccataaaacagtacacaaataactatggctactatgtcatactatagaccttggagctgtacaggttgtagctgtggttttatctgccagttatcactgaatacaaacttcaaacagtaaattatgagtcggtagtctaggaatctaggatgcaagcctaaataaagtcggtagtcttgttgtcattatgagctactaagtaaattgcttcctgtttcttgtcaagtgatcatattgtaagtttttctaccctgtggaaatggtttgtggaatatatatctggtactttctctagttatccttttttgaaccaccaactatttcattctttattgtgttaaggaaattgcatttatggctggctactttctctgcctatatgtccctgttgtcatttgagacaggcttgtttacaaaatgactactacttactcactccatcccataaaaaaccaacctaataccggatgtgcggtcctagattcgttttttatgggacggagggagtaggtttcaaacagtaaaatattcctatctacagtgctcttgtagttgcagtttagattcactatgcaggagtatgctaaaaaatattgatattgcattttactcaagaccttctattagctgtacatacttgttacagtatgatttaaactacctcgtatgacttgatgggagtatttcccatccttgtgagacataaggacgtattttatctttgtgtaataagtagttattttttgttgcaacgagagatataaatacccctatatacatcataaaatcatccttcttgtgatagatgactataatttcttcgtatacatctcaaccttcgtattttttttctcatgatagggaggtacacaagcttcaaattcgtcctgtaaacctaaatgaaacctttagttttgttggcatcttgagttactgtctacaatgattaatgtttctttatcaagctatcctgccttaaggttttgatgcaacaaaaaaatgcacatggaaaataaacatgcaattatacttttctctatatgaaactgcaaagaggtatatgggagtacactattatttctgttaatacgtgtttttatagtagcaagaagaaatggttaatttctcatgtcactcccttgttatgatcaataagatgtatctaacgtttaacttgttatctccagatttctgaaatttaacaggtgaaagtgaaagccattatgatagattaggaagtcttttgttgaagttgttctgaacttctgatagattaggaagcttttctttcttacgaagtgatgcactacgatgcaattagtgctacataaacttccttttttttttttggaaatgttggctgacagctgaatttcgagtttcacttatgcatgcgaacttaaaattagctgagcaaaggttccctaagtgagtttgctttgaactgtaggttcatgttggcagcagattacgagtcttcgtttttggacgtagggaaaacattgtgtatgtcatcttagatactcgttttctagcaactctttgatttgatgttgatctgctggaagatgagcaactatttgatgttaatctgttggaagattggcagctttgtgtgttaacacaatcgatgactggcagtctgattactgatggtagtaaattggtaacttgctgaagtttttgagacatttggttgtctgattcatgcaattcgaatgtgatgtttggaaattttttttgccatttttattgcattctttgtccttcggcatgctcaattgaagcgaatatcgcattgtttatttattttgtttctaccattagacttctgtagcccccaaaatattagtcatcgttaaccctgcttgccagaaaaataaacagtctgctttttacaacgcgagatcgtgcttagtataatttggtttaagttggaaatgcatcaatgttggatgcactgccaatctattgatgcatgctgaacttaactgccaatctgctgatggtaagtaaacagtctgcttttactgtaagtctgtaaccaaggttggtagtacctgcgtatactaagatattactctctacatatttcctccgtccaaaaaaaaaagctaaacctaggagctaaacctaggggtcctaggttggctctgtccaaaaaaaagtcaacctaggattaggaggttggctaccctaatcctaggttggctttttttttttgacaggagtatataaaaagaaacttcaatgaaggaatctggaagcatttgacccgttcattttcataagttggaagcatttgacccgttcattttcataagttgattttttatgagacgaatatattctcaaacgttgatttttcactactattgaaatgatcattgcgtgcgggcggtaactcacaccccacggaaaaatcagctcattttcgcatgtgatccatttaagaggactgcatgggaaaatcgatttttccgtgcggtcctcttaaataggctgcacgtgaaaatgagccaaatttcccgtgcaatatattaagagaaccgcaggggaaaatagtttccctcctacccacttcaaaaaattccctttttctctcctttcccctatccgtgcgcgcctaagtccccccctctctctctcttttatttatccggccgatctgactctctctatcctccctctctctctctcactcctctctcctcgatctcctcctggcgacgggcgtaggcggtggcgacagcggtggcggcggacggtggcgcgtggcccctccccttgcagatccggcggaggggaggcatgggggagggggtggcggcgacgacaacgacggcagcccgcggctcctcccctcccttccccggcggcgatgggagcgggcggcggatccgtcgccagcgcttgcagcggcgacagcggcggacctcagctagggtggcggtggcggcggctggattagggttaggctttggtttttttttcgatttttcattttcccgtgcgggtggcttaagcgcctgcacgcgcgggtgcgtcgcctgcacgaaaaagtcgcgattttcgcagatacttccttccagacggtcaaattctctacacgcgaaaattgaattcatccatacgggaaaatccttaatgtagtagtgttttcatgagacgaatgcaaaagttgctctgaactctcttttgagcaaaacacaccgacgtggggagggggggggggctttgttcgatctggctgaacgggtgggattttttggaatgcaaaattattagcacatgattaattaattgttaactataatttgattttttataaaaagatataaaaagctttttataaaaaatacatcgtggttatgaaaaacgagatacgttgtactcccttcaggcttcatcccacgaagatttcattttccagtttttgaatatactcttcgtcttatttaaaatttttctatgattaatatttttgttgttattacatgataaaacaagaatagtacttttatgcgtgactaatttttttataaaatttttaaataagataaacaaccaaatgttggcgttggacgcagacaaaaaaaaagtcttcgttagacggagagagtagtacacaaatcaaaaggctaattctaactgaagaattatcttcatattgttacgttggaccttgaggatcacagcccattgggccaacaccgtctgtggctcccaggccgacacaacctgagcattttggcgggaaaccgttgccatgctttttgtaggccagctgtcaacggatcgttcaaaaaggatgaacaagtacagaggcaggagcagatggatagagacaggtaacgtcaccaagtagaacaacgcaaaatgctgcaccgagtctatgcgcaccgggccacaccgttgcgaaaccctctcggctccaaatgccctggctcacggtggaccgagcccacggccggacgtcacggctccctgcccctctgctgctcgtgtcagagctccacttctttccatggacctcacccaccgtgaacaaccgaccccgccgcctcgccttctccggtagggtagggtaggctaggctaggctacgctcgccacgatacgcgcgccgcctccgcccaaagatgcagcgcctcccgctccggcgcgccctgtccgccgccgcgtccgcgcccgtacgccgcgccctctccacggcgtcgcggcgccctccgtgggcgatggtggagaagtacgtggcggtcggatctcccgagcggcgcgtatccctccggctcgcggagcccccgtgcggctccaggctcatcgcccccgcccacctcgtcggctacgcgccgcgcgtgcccgaccccgacacggacgagctgaacgccttcttcgccggcttcgtcaaggccgcgagcggcgacggcctcctcctcctcaccttcatggaagtcaccggcacggcccccctcgtccccggcggcggtgggtggcgcgcgctgactggcatcagcatcgaccccgacatgacgcggttcgtgtgcaaccccatctccggcgagctgttcggcctcccggacatcgacggcaccaagaagaccgcgtggttctccgacatcggcatcctcacccaatccgaacgcccgcacgggccgccggacaggtatgccgtcgctttgttcagggaggactcggtgggctaccgcggcggggacgaacggttcgccatgcgccggtttctctcacaaacgggcaagtgggacaagctggtgggcttgccgtcctcgctcccgctccaccggcgtcgcatgaacacatccacgcaggaggtggtggccttccccggccggctgtggtgggtcgacctgagctggggcgccctctccgccgaccctttcagcgatcgcccggagctccgcttcgtcgagctgccgagaggcagcgtgacacagcccatggagaaggagcgccgggagctgcgcaggttccgccgcgtcggcgtcagcgaggggaggctgcgctacgccgaggtgtcccaggaggagccatacgtgctcagttcgttcgccctcgacgacgacggcggcgggtgaacgctggagcaccgcgtggctcttagccggctctggccgcatgaccaaaacctctgcaagaacacgccgcagatcgcagccattgacccactgaacgctggctgcatgcacctcgtagttggcaggcaggttgtctccatagacatggacaatggggatttgcttgggtgcacgctgggaggtggaagtgatccatccgtggatacacttacaccatgtttgctccctccgtggcttgcatcgtgccggatcccccgtgcaggtgatcatctttcatgtgatttctcccgtgtacatgcatgcttgacacaccagatttgcttattaagtgttaattagatagatccaggactttgttcgttttacatctctgttgaaacttgaaacggtataatgttagtgggaggcttagcttgtgcatagtggtactggtagtatcatttgttttgtcacttcaatatgcaatgttggaaacgtgtatctacttacattattgttttctcttgtaaaattttgaaaatccttctgtttgtgattgaagaaactctttcaaggaacaaggcggatgcgaaaagcaagagtttatcagacatgttggttcgtgtagataggaagaagatgacttgagaccaaacagcaaatgggtcagcaggtacttcattaagctaactattattcaatcagtcgtcttgttaattcttttcaccatacatggatgccgttcgattaccacttttcactgcttgtattccttattttcttgaagtgtgtgctccgaatcatgaaaggccattttataagataagatggatattttagttgaattagcataacatttgagcaaatattgctttttcttccgtcttgtggtagcactttagacgaaggggcagatccagcacacattcatcactgtcatttgacaccggttactctttgccaatcactgtataagtcctctttagattaagaaatttctcttataatctgcaatggcacgattattttttaaagaaatttgattagtgacctagatgatattttctcctggatccatccctaatacaaggtgcatcctagggtaaagtacactaaaaattatcagtcatgttttactcttcagtattgactttgcataaaaaagcagattatagctgttgtttaaacagcattgcataaagcaaactccaaatttggccaataaaatatgaagtaggtaaccaagtcactaagtataaaagccttaaaggtgtttggtcttgtcatcattataagtatctattttcataagagttaattatagtttgttgcattgtgtataatattatgagcaaccacttaaaagcttcatgtaatatttttgctgggataaaaaaaattgatggaaggtaagcagtagatgtgattaagtgcaaactagaaacttttgcctataaaacataatagtattgtgtaagagctgaaaggattccctgcattgtaatcatgctgagtcactgtcattctttggtcctaaaatattatctcttatcaagcctaagagtctaagatgatgaagcttgctactacgatttgatagtaaaaatcataattaggtattctgctgaataaagacatgaatataaaataaaattgttgtgtaatatagtactgaatcaggacttgaataaaagataacatgctctcttttcaatttcttaagtagaaatggctagatggactatcatagttttccatttacttgtttatgttttcattttttttataccgctcattctattcaaacatatcctaatgtttcctgtttgattcagatttcttaaaaaccaactgaagaggtgttttaacgaatgaggaagctgatggatggtagttgtagaagtcccgtttcggaaacccaatggaagttccaagtgttttgacctcacagtttatctacatatttttggagaaacaggaacccttttttttttcctttttttgggtggaggctttgcttgtgagcatattgagaacattgcagtagagtgactcaattcagccagcatgtcatgaccatcacataagaatatacatgctgtgtttggtgctggacaatatggtcaatcttgcacttgaaaatagatcgatgnatgttaatgtactttccaagattcttgttagggcatctcttgtgcttgcttattcatatcgaatacctgtcatcacattgtttcagctggtaaaaaattcaatactaaatctcgggttgtatcttcatgcttggttatacgtgtgcatcagcacctaagtgccaatctattgttactggtaggcaagatatgtaaaatatctctctgttacttatttgaggcagaagagcagggaatcattcgaatatatcgcagtgatttcatgatttatacgcagaaaacagtgttttgctttcatttgatagaaccattgcactactatgaagtacaacgaatccagacatggttatgaagtgttttatctggtactaggttgctttataggacggagggagtagcagctagcatggcaaacatgatggtcaatctctgaactttcaatgccatttgcttcaccccgctttaagacaaaaaccaccttggtttcacattttcacttgtacgttacgccgcgtggttttatcaagctttggtgaagggacctaatgatttatgtattcagcatatttcagtgcatatataaaaaagtttctcactgttcttataataaattttcctccctaagataaataagaaggatgtaaagagaggaggctgcttattattcagcggtggacaaaatgacgatgaagataaaaggcataaacatttttacataaaagagaacacagaacacaagtacacaacaataacatagagcgaatatttcttaaaaaaaaacataggacgaatattttacatggagtcgatatatatgtacatgatacttatatttgtatagcataaccattaacaagtgtcaataacgtatagggatataatgtttgcctcattagttatgatggattagggcctgtttagatcctctggcaaattttttcaccctatcacatcgaacgtttgaacacatgtatagaatattaaatgtagagaaaaaaaaaactaattacacagtttgcgtgtaaattgcgagacgaattttttaagcctaattagtccatgatttgataatatggtgctacagtaaacatttgctaatgatggattaattaagcttaataaattcatttcgtagtttataggcagaatctgtaatttgttttgttattagtctacgtttaatacttcaatttagtgtccgtatatctgatgtaacacgctaaaacttttcacccccggatctaaatacagccttaatctatttgaccatatggtaaaaaaaaaaaggctacatgcaagctagcattgtggacacagtactttgatggttaagccacgtttggatttcctagcccatttgacatacaccattgtttaacctacaaaatggaaatccatgcgattcactatttgagatgtatagttgggttatcttaatgaaagataacctcacaaagagagaatggagggaaaacaagcaatctaatctgttttttttttaaatatacaaaagaccatccaatatcttttctcttactgtcatgttgcacgtttttcttgatgatatgtcttctttgacattaatattcccttttccaaaatgtaaaagatatttttggtaactggctaaggggagtgcctagactaaaaaatgattttatttggagttagtgctctatgttggtcaatctgtcgttgccgtaatgttgtaatttttaaccataaaaaaatgtctagcatcatgcatgttatcttcatgtgttccaactggcttcactcttggtgtatgatactttcacaagaacaacaagataagatactatgtacaatgatgctacacgtttggaatttatagccaaggaacttttattacagtttagatggtgtagtacctacagaattttgtcatacaatctatttgattttggaaacattattttattagatcatcttattggcagaagttgggggtttatcctatcatgtattttttttaatttcttttatgtttacttctgagacttttttgctgtatgcccacgagcagagaccggagatgtaatccatttccaatctaaaaaaagacattgtttagtaataacctgttggtgcattcaaaatacttatatgtataatgtaggagcatgaataatacttgcctagtcactccgtcctaaaataaatcaatctaatataagatgtaatgctacctactataatgaatatacatctgtttagtcacctatcccgattcattgtcatagataatatcaaatctcatgttagatccatttattattggacagaagttgtgtgtgggatgggaaggatgattgatcacgcttgtactgcatgagagcaaacaattttaaaggaatttaaggaactttgttccaaagtaccacccgttctttcctatctaagatacaaattctacctcgatttttattagcatgtttttcaaaccagtgaatgatgtgtttcatccgataaattttctatataaaagttgctttaaaatattagatactatatagaagttgctttaaaatattaaataaatccaaatttctaatttgtaataattaatacttaatcaatcatgtgctaatggctttcttgatttgtgccctagcttcaccttcacctttattagaaacgaacaccaccatatgttacaaattcttttacaaaatatatctctattttttaacttatctatatgaaactaggtgtcacaacgcaaggttgtctatctgtaaaaatacggcttctaaaggctcgttcgaaactccaaaatgaaggagaatattagtggcacatatataatgggataactcattagcacataattaattaagtattagctattataaattttaaaaatatatttatttgattttaagaaaaacttctacatagaatttttcactccatgtaccatttaacatttaacggttcgagaagtgtgcttacgaaaactgtgaattaaagaagtttagaactaggcatcaggttgtttttttgaatgggttaggaaccattccccgtcgacacataaaatggagttgctaattaacacatgaataattactctctctcttccaaaacattagatattagaaccggatgagacaaatcatagtactatgaatctgaatagattggtagtattatgatgtatcacatctagtcctaatatcttattccctccgtccgaaaatataaacatttttagaatagggataagtcaaacatttttaactttgactattaatagcaaaaaaataaaaaagattaatcacgtaaaattgatgttactagatttatcattaaacaaactatcataatatgcaactctttttatttaaaacattttatttttatagatattgttggtcaaagtagcatctcgaaaatcatgtcggagtacgaagggagtatatatttggatggagggagtgcgcttatgacggagctcgtggctcctcaccgggagaccgcgcaggcccccctttgccggttcggccgggggcttagggtgagatctcaagctctctctctctctgtatctggaaagatcacccgcccgcaagacacacgagacacagtgatgtatacaggttcgggccgctgcgaagcgtaataccctactcctgtgtttttgtggatttgtgtatggacgagtcacaaaggattaactccctttcccctcagccttccaaaagggaaaaaagtcccgtccccctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgttcaccacgcgtcagcttaacaacgtgcatgtttgccctttttcgtgtaacaccttgcctgtaatggttaggatgaagcctggtgtaaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactggaataaatgctggtaggtgagcacagctgtgctcacttatcccatatatgtggtgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacagcgcgggcgagcgccgccggggggaacaatctgccccaggagggggtcgtgcttctgggccccgcgtcgggggctcggggagcagccgccctgccgacgcccaggggaagaggaagctgggaggaacacctcccccatctcctccccgagggggcggggcggcgcgtgccaacagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagttttttcttactcattttgttcgtcttctggttttttcttctgcttcagcgatgtcccgtcgcattcctcccgccaccccaagtccggccagtccgaggccgaagatccagcggccgcagaggagcggaggcgagaatctgaccggcgtgaagccgcagaccgccttcgggaagctgaagaggccgcccgggaggccgcccggattcgccaagcggaggaagccgctcgggaggaggccgcccgggctgaggaagccgctaaggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggtccgggggacatccccgagcccagcacgtcctccggggggccgagccgcatcgccttctctccaaggcggctcttctccttatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccgccgctgcccgagagcggcgggtaacagaggctgaggcggcgtcccggcggcgcgaggagtcccttgaggcccgtgctatggcgctggaagaacacgccggcgccgtggagaaaggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaggaggagcaggcgcgccgcaatcttgaatgcgtccgcgccgagagagccgcactggagcagcgggctgctgacctcgaggcgcgggaaaaggagctggacgcgagggcgcatatcggtggggcggccgcgggcgaaagcgacttagccgcccgcctcgcagctgccgaacacaccgtcgccgatatgcagcgagcgctggacttctccaccggggaggccgaggcccttcgcttggcgggcgagattgggcccgacatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttcccccccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcacattggaatgagcccccaggcccccgccaatctccaattttttctttttctttcttctttttgtatagatcaacttaatctgcaatcaaaaatgatgaaaaatttcttatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggtaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccaaaacctgacacccgacccccctcctcaggggtagaagcgacgaaggtgttcgatgttccacgggtttggcagctcagtgccgtcgcccgtggccagccgtacggagcccgcccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgtggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcatttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaaacccccagacagcaaatggccatgacagtggtatgatctgcagggcctgggccggctgatggatttgcttggcgtggaactgacacgctctgcatcgccggaccagatcgactgcatcattgagggctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgtacgtaggcgtccatctgtgggtcagagcaccggtactccttacagacttggttaacaaccaactgagagtcgcctaacaccaggaggcggcggagccccagcccggccgccactctgagtccggcaaggagtccctcgtactctgccatattattggtcgctcgaaagtcgaggcggaccaggtatctgaggacgtctccgtttggagaggtcaacgtgacccccgcaccagcgccctggagagacagagaaccgtcgaactgcatcacccagtgggtggtgcgaggcagctgagaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcattttctgggcctgagggtatcgggtcttggcatcccggagggcctcactaacaaagtagacaggccgctgcacccttcggtggggccgatcctctttgctgggggccgtatccccggggcgttcttcattcaagtggcctttcggggcgcacttgtcttctgtgccgatgacctcggggtcggaggatgaaaggggcggccttccctcagtggcctcggggccgtcctgggggtcgggggctcctggcatcgtcggacaagcgggcaaaggtcctactccggtcgtcaggggcctcaggcctccgttcggctcgggggcctcttctccctgctctttcccgggtcgagtcagcacagggttagcctcggggtcaaagggcgttaagtgcggccttcccgcagtggccttggggccctcctgagggtcgggggcacttagcaccgtctgacaagcgggcagagggccgactccggtcgtcaggggccgtaggccaccgtccgactcgggggcctctcctccccgctcgctcccgggccaagttagcacagaatgggggtgcacgaaatgaggattattttcatcgcgctccacaaccaacgctgcactaactacttgaggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttagcctcaatgcctcgggcagagaccaagaacccgagaagcttgcccgcaggtacaccaaacacacacttatcggggttcagctttatgcgggcggagcggaggttctcaaaagtttccgctagatctaaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacgcaaaaggtcgcaccccgcagtggagtcgacgatctgatctatgcgaggcagggggtaaggatctttaggacatgccttgttaaggtcggtgtagtcgatgcacatccgaagcttgccgttcgccttgggaacgaccaccgggttcgccagccactccggatggatgacttcacggatgaatccggcctcgagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcacatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaatggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaactaccatcgcaacctgccctccccgggcaatgcacggtgggtggtcggtctggtcgaaggtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgtacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctctcgtccatgtcgaggtgacactctggacgaagaggcgccctccgttgcgcggggagtacgccggttattacgccggcgctcgatgtcgatgcgggcatccggctctccatgctgatcctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgcagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacactcggtgagaggtcgtgcgccttcgcttgctcggccattaggcagaacaagaaaaacttggcgcacacggaagagtatgagagctcagaaaacacacactgagccccctacctggcgcgccagatgacggagctcgtggctcctcaccgggagaccgcgcaggcccccctttgccggttcggccgggggcttagggtgagatctcaagctctctctctctgtatctggaaagatcacccgcccgcaagacacacgagacacagtgatgtatacaggttcgggccgctgcgaagcgtaataccctactcctgtgtttttgtggatttgtgtatggacgagtcacaaaggattaactccctttcccctcagccttccaaaagggaaaaaagtcccgtccccctctaaatgggcaaggtcctccttttatatctcaaggggataccacatgcacctttctcttttcaaaactggactgttctttttctctttaatgggcggagatcgggacggttttccatccggagccccttttgatgggacaggccacacctacccccacctcccccgaagacagagatgacgcgggaccgtggctgtctgtcgatgacgcgaccagtgccagaccggtcattcttgttcaccacgcgtcagcttaacaacgtgcatgtttgccctttttcgtgtaacaccttgcctgtaatggttaggatgaagcctggtgtaaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagcttaaaaaaacttttaaaagtgcattaatataatttcaaaattatttttctattaatttatttttataaaactgcatcatcatctaatagttcgagaaatcaggggaggccaaaaatgcaatatcgaaaacagccttgttcatattccaaaacaatttgaccaaaagcgtcacatcaaatatttaaatacatgcgtggagtattaaatataaatgaaaaaaaaatcaattgcacagtttgcatgtaaatcgcgagacgaatcttttgagtctaattacgccatgatttaacaatgtgatgctacggatcaattagacttaataaatttgataaaatttataatttattttattattaatctttatttaataccaaatatttgtccgcatactttaaaaaaaatttacacgcagaaactaaacacacccaacgtcaaagggctacgcactttccccctccgtgtctcgtccggtcgctcatctggacatgtgggcctatagaagagaacccccaccgcaactgtagcaatggcaaaacactgtagcgctactcacattttactgttcccctctgccatttaccccctaatggcagaggatgcgaaccccacggcaacgggtagaaggacccacagcaggtgcccactgcgtgcgccaggtctagtgcaccagctcacacaactgcaaaatccaacctgccgcggcttgtcagagctccacccaccacgcctcttcggcttctccttcgctggcaagccgactactcccaaaatgcagcggctcccgctccggcgcgccctctccgccgccgcgtncgtggccggccggcgcgcccttttcaccggggncggcttggcctcgcgcacgccggcgtgggcgatgatctaccacatcccggcggtcagatccaccgcgccgcgcgcctttttcatccttgccgaccccccgggcgccttcaacctttacgtgcccgaccaccttttgaaccgccggcccggccccggccccaacatcggcaacgtcatggccctcctcggcggcatggtgtgcaccaccagcgatgacggcctcctcctcctatgctactcggatgcccacgcccccgtcgtctccacgcacagcggcactcgggagcataagctgatcggcgtcgacatggacccggacatcacgcgcttcgtctgcaaccccatcggcggcgaattgtccggcttccggacaatcgacggcaccaagaagaacatgtcctacggccacaacgccggcctcctcatccggtccgcctcttcctccgggcacgggccgcatgacaggtacactgtcgctatgctcagcgaggccggcagccgcaacgggtatgaacgagccttcgtcatgcggcgtttcctctcgcaaaccggaaagtggaagaagctggtgggcttgccgttaccgtcgccgctcccgctcccgcggcggatggagctatacctcgaggcggtggcgttcgccggacagttgttgtgggtcgatccgacttggggcgccatctccgccgacccgttcagccaccggccggagctccgcttcgtcgagctcccgaggggcagtgtgtggccaatgcccagcacccatccagtacaagcgttgggtatgttccggcgcctaggagtcagcgaggggaggctgcgctacgtcgagttgtccaaccaggatcctttcgtgctcagctcatttgccctcgacgaccacggcggcagctggacgatggagcaccaggtggagcttgctccactctgcagggaccatgttaatggaggaggcctcccctcaaaggattacacttccaccccgcggattggcgttattgacccactaaactcaagctgcatttgtgtcctaattggcaaacatgttcttgcggtcgacatggatatgggcaaggtgctagggtgttcgctcactgatgaaagtgaaggctcgccatgggctatcaccacttgccttaagccgtgcgtgctcccaccatggcttggatcaagccaaatccctaatgcaggtaggtaaccaaatttcacaccttcatgttttgtttaagataagatacttatggatattagcagagtaattttgaataacatttctgaatatatcctgaaaaactgaaatttcagaatagaaagttggtattagtaactcccctttgtcttaatagttcatttgatatgagaatgctatgctcttgttgcctcagtttacctatttggatgttcatctattatatgcaatgtacaaaaatgtgagcttctacttttcgttttgtggtataattgttcatgtcctgcgattgaaggaactttttcgtgcaacaaaggtgatgccaaaggcaagactttatcagacatgttggttcgtgtacacagcgacaagaataattgaggtgaaaaaaaattctgtccttgtgttctctcatttgatactcttgtttaatatttaccatccatttccttatctcccctgttaaagaaactgtgttaacaacttattaattagtgttaatttgctgctgatcatgatagcgtagcttacaaaattggtacttctgctttaagaaaatcaacgatgctatctaccatcttgtaaattgtaatatcacttctgaattaaaaatggttgtttgcatcctttgttgatgtataggccggaattcatttctaccttttttttttaaaaaaaaagagtatgccaaacattaatgtcttgaccttgcatcagctgtaagatctgtagttgcctgatggtagtcactagttaatacaatgttcgcattggtccagtaaaacttatttagtagtcaaacgtaaataaagactatagtcttattattgtttatattgcttagtgttagttaacaagtgatcatgtctctaatttttgtagcatattgattttgatcagaaaatcaacgaaaatcaatatgcagtgtgcttttattaaaaaaaaaaggacaggcatatagtacaataccatcatttttgttcgcttcttcctcagctcattctctgcatatgatcaattagatgtccctaatgtctgaaatttaacaggtgaaagatgttcttggtggagtaggaagctctttctttttggatattacgtattaggatgtcaatgattctgcaacaatgaactcattttgggggaaatgttaacagaagactgacacagttatgatcttcacatggtatcacaaagagttgtgcttcacttaattgctctaatacaatattttttaataggatagttcagatctgttggcatgtaaccattgtcaagactcaagaatatagatgcagtgtcctcatgttttcaagtgtttactctgaatcatgagagtccagtttataagatcgatatttcagatgagaataatacttcagcaactttcgcttcttctgcagtctttagtgtagtagtagactacattcaaaattatcacaatcatgttctactcttgagccttggatcagtgtgcagattatagcttttctctgaacaagcattgcacggcctataaacatataccaaattaggccaataaaataccaagtataaaaatgatagtcaacatcatgatttgttttcagtaaacaaatcaatatgatttattgtcccatataaaattatgggcaactaattaagagctttctgtttgtcacaagtgatcctgttctactattttgtcctgggaggctgggaccaataatctagaaagtaataagaatatcatgttcattggtttaaagacaataaaaagcagttatagggggctacggtggtatttcttttggcttgtgtggtatactgaacaagcagacattactaggtgcacactaggactgtacaaaatcttgcccagcattgtcatcatgatgagccactgtcagttttctgtttacttgcttttatgtcgatcactaaattattttctatatacattctaatgttttctattcgattcaggtttcataaaaacctactgacatgagttttaatgaattaggaagctgatgaatggtagcatggagaactctcgttttgactttttgagaaacctggaaagttgagtgttttgatcctcgcagttagctgtcgtattttgggagaaactggaactattttatgttttctttggtagaggctttgcttacgagcacattgagagcattgcagtaaaagtgacccagttcagtcagcatgtcactgccatcacataagactatacatggtgtgttaattgaaagacaatgagctcattttttgtcattgaaaaagatgatgcataattctgtaaatcatgatatctcagttctctgcttattcattctcttcatacctgtgatcacattgtttcagctagcaaacaattcactattagcttgatatttttttcctgcaaggtcagtgttagcttgctgatggtaaaagaacttaaaaagtatctctatgcttggttaggaagcatcaggtactactaggtgccattgtgtgccaatctagtgttactggtgctcttgtaggaagatagtatgaaaaagtctctattatttgaggcggatggttaggaattcgaaattcatttgaacatgtctctgtgtgcaaacacaattgttttgcttgcataggtggtgtatattttgtctggtttggaagagaaattgagccggcctgttatttttcactcacacagccagggtttacgattccgacgaaatccgatcgaatttcgtgaaatttcgatattctgacgaggctcgaaagtagaaaccgtctgagatttcgaggagtttcatccaaattcaaatttgaattgataaaaaaagaaaaaacaaataaaatcttataaatactatgatattcatagaacctattgggatataaatattcaaaaaaaatgatgtattgtgttttatttactgaaacttacatcaggaaagaaaagaataaagaattaaaaaaaaaggaaaacacttatatgggccaaattgtatgtactaggcccagctagtagttggtccaaattacatattactggtcatttcgatgattttgatcggaatttcgctaaaaccgaccggttttcgagaacttgtcagcaaactcagagaatttgtattcaaattttggtttatgaaatttgtttgaaatttaccggttttccaccagatttcgcgaaatttcgaattccgccagtgcccgaaacggaagggcatgtcggaatcgtaaaccctgcacacagcacaaactcaatgtcacggttcaaattgaaggagaaattttggttaataattcggtcttacgtgctgggggtgcaaaaggatggtcataactgggccttgaggtttagttgatcgatagcccatagcttgggcccatctgtcggcccacatagcgtagaattttggcgggaaaaccagtaagagcacttttcccctccgagtttcaaactctcaatacggcctttcgcctgacatgtggacccaaaagaagagaagctacaacaacacggcaaagcaagtacaaaactgaataggtgcacctagtccacgtacaccgggtgtcagtgtcacgaccccctgctgcagaacaccgggcgctcggtggaacaggtccacgctcgcgcggctcccctctgccgctgtcagagtctgagctcacctccgtgaacctggtccaccgtgaaccagcacctcctcctcggcttctcctcgacgccacgcgggtccctttctctctcgctttcgcagttcgccggcctcctccacggctccaccggcgcaggatgcaactcccgctccgccgcgcgctctccgccgttgtttccgcgtccgcgcctgtccggcgcgccctctctgccgcggccgccgccgccgcgcccgttcggcgcgccctttccgccgccgcggccgacgccgacgcctcgcgccatcctgggtgggtgatgatccacagcatccaccacgcgacggaggccagaactccgtcgccgcgcgcgtcccttcttctcgccgagccaccgtgttcctcctacctcctcctgcctgaccacctcgtcgaccggcggcccggccccaaacccggcaccggcatcgacgtcgtggggttgctgagcgccgtgatctacgccacgagcggcgacggcctcctcctcttcgcctacgtggactcccacgccccgctctccgtcgtctccaaggccttcgccgccggcgctacccctactcgggaaggcgagctcgacctcgacggcctcaacccgcaggatcaggacctcacgcgcttcgtctgcaaccccatcaccggcgagctgttccgcctcccggacatcgacggcaccaagaagaccttcttctggcgccacaccggcctcctcacccgctccgccgccggccatgggccgcccgacagctacgccgtcgccatgctccgggagcacagcaacagcgggaccttccacatgtggcggttcctctcgcgaaccgggaagtgggacaagattgacggcttgccgtccccgctcccgcttgtgcggcggctggacatcgacaccgaggcggtggcgttcgccggacggctgtggtgggtcgatctgacatggggcgtcatctccgccgacccgttcagcgaccggccggagctccacttcgtcgagctcccgaggggcagtgtgtggccaatgcccagcgaagatctactagtagaagtgcagagtattcatcggcgcgtgggggtcagtgaggggaggctgcgctatgtcgaggtgtccgacaaggatcctttcgtgctcagctccttcgcgcttgacgacgatggcggcagctggacgctggagcaccgtgtggcgcttggtcgaatctgcgaggtgaagggaggaggaccagaggacaccccgcgaattgccgtcattgacccactaaactcgagcgtcatttgtgtcatcgttggcaaacatgttctttctgtagacatggagatggggaaggtgcttgggtcttcgccgatagaagaaggtgaaggctcaccctggtttatcacctctatccttaaatcatgtgtgctcccaccgtggcttgcatcaagcaaaatccccgctgctggtaatcatctttcacgcgttcatgttttgtttaagatgatgcttttgtgatatgtgtgggtaaggatgctagaattgttagatccatagcaacttttatatttttccatgttctctaaaataattgcatggttataggcagcttgtgaatagcagatggaccacttcttatgattagcgtttacaaaatacaaacctcaaactcttagtggtgggataatttgctacttcctctgtttcacaatgtaagactttctagtattgctcacattcatttagatgttaatgaatctagacatatgtatgtgtttagattcattaacatctatatgtatatggacaatgctagaaagtcttacattgtgaaacggagggagtagctgtttgtaattcaggtacatggttaggccttggtgaatgattgtcctaagacaccaaggcgcttacccatagcacgtgaatatatattagcagtgtaaacatgaacaaatttcagaatatttcctgaaaaactaaaattcagaatagaagtgtggtgtcgtggtctctttcaagtatatttgacatgcgaatgccatactctcgatgcctcagtttgcctttggcagttcagctatttcatgcaatgtatgaaaatgtgagcttctacttttgttcttgctgtataattgttcatgtccttcaattgaaggaacatctgcgagcaacaagggtgatgccaaaagcaagaccttatcagacatattggttcgtgtagacagggacaagaagaattgaggtgaagaagattctgttactgtatgctttcctttgctactgttgtttaattcatcgtctattccctcatatactgtgttaaggaaaccatgttaacaattaattatcaggcgttaatttgttgctgacaatgaaagcctgtttattaaattgctatgtctgttttatgccaaccaatgatgctattctgccatgtcgtaggagtatgtattaccaaattttaatgagttgactttccatcatctgaacatatttgtatttgccagatgctgatatctatataaagtttgcgctggcccagtaaaaattatttagtagtatatcgaaataaagtctgtcgtcatgttacacctgaagttattgtctatggttttgtattccttaacaaggttttgctgcaatagaggaatggtatacagaaaataaacacagtccacttaaagaaatggaaacaggaatatggttcaaaagatctatagactatagttgccagatggtagttattactcaatagtagatacagagtttgcattggtccagtaacacttattctgtagtaaaacctaaataaagcctatagtcttgttattgtctatataacatattgcttagtgtttcttgaaaagtgatcatgtcgctaatttctgtcgaactaacgaaacagtatacagaaaatcaataatgcagtgcgctttaagaaaaaaagggaacatgcacatagtacaataccatcatttctgtttccttgttttaattaaccaagaaaattcacttcttctttagacttcacttaattgcttctagtacactcatttttagtaggataattcagttctgatggcacataaccattgtcaagactcaagaacatggacgaagtgtcctcattttttgaagtgtttactctgaatcatgagaggccagtttataatatggtagataatgaatgtggcttgtggtgtttagctggaacatctgcgctccatgagttcctgtttaggtgacttaggctgtgttcgattgtccaccttcctaacttctccttccttgttttccacgcgcacaacccaaactgctaaacggtgtgttttttttaaagttttctataggaaagttgttttaaaaaatcataataatccactttcaagtttttttagctaatacttaattaatcatgtcctaatgaactatctcgttttccgtgtgaagggagtgtgttccaaaccttgacatctgaacgcaccccttaacctgggcaattatgcctttggatgatgatgatgtgtgtgtgtgtgtcgggggagggggaggggggttctttggagttttcttttgctcccctgttcttgtcaatattttaacttccgttctccttaatgaaatgaaacgcagtcctgtgctttcgagagaacgaatatgagaataatagatgagccactgttgtgtcttctgctgtctttagggtagtggtatactactacactaaaaattatcatgatcatgttctactcttgatcttgaccttgcatcagtgtgcaaattatagcttttttttcttgaacagcattgcatgacttactaacatactccaaatcaggccaataaaacaccaacgaagtaatcttgatttagtttcatcaaacaaatcatcacaatttattgtctttgtctcgtataatattatgggcgactaattataagagctttctgttttttcatgagtgatcctgttctgatatttttcctgggaccaataattgatagatagtaataataatatcatgttcattgctttaatgaaaatacaaagcggttataggggagtatggtatttctgttggcttgtgtgtgtgaacaagcagacattattaggtgcacacaaacacaagtactaagagcttaaaggatgcctagcattgtcatcatgatgaaccactatcattctttagtcctaaagtattatcacttgtcaagcctgaaatgaagcttagtattttagagaagggatcatgggtgtaatcttctgccgaatcaagacatgaatattaaaaaaaataatttgttgcgtcatattctgctgaatgaggacaagaacaaaacatagtacaacactaccttttcaattttcatgagtaaaaaaggactacatatggactgtcatagtttcctatatacttgcatttatgttgaacaccgtaattgttcctttatataccagttgtcgttctcttcgtataattattgagatgaatcctaatcttctgtctgattcaggtttcatagaaaccaactggcatgcgttctaatgaataggaggcttctcgttttggaaaacttggagaagttgagtgttttggccctcgcagtttaccgtacagtcttatttttcggacaaactggaactgttttatgtttctatttttgtggaggctttgctggtaagcacattgaggacattgcagtaaaaagtgacccagttcagtcaagcgtgttactatcatcaagactatatgttgtgttagttgcaggacaatccgctcatcttttcacatgaaaaagaggaggcctagttgttgaatataccgtgtgcgtcttattcaggcatcttctctctcgtcagatacctgtgatcacattgtttcagctagcaaacaattcagtattagcttgcttctttttttgcaaggtcagtattagcttgctgatggtaacagaatttagtgtctcctggttatgatgcatcagcaaccaggtgccaatctattgttactggtaggtaatatatgcaaaagaaaagaaaaacctctattatttgtggcagaaggttaggaattccttcgaatatatctcagtggtttaatttaatgtgtacaaacactagtgtttgcttgcataggtggtgtttataagacattcggaaaagaaaaattgagccgaggctcattgttttactcactcacacagcacgaaatccatgtgcactccacggttcaaaatgaagtttgtatgatattcatgcaaaatgctttgttatattggatcttgaggtctactggagatagctcggccatggatatcataccaaggaaaacgaccattttgcctccctccctcatctatagccgaagcctgatgtctgattaaactctctcaactgtaaagctagatacataaactcatttaagaatcaaacctgggtttatttttcatcccaacggtttaaacggtggtttcatcctatatgatgctcatctgacacgtagcatcatgtgtacataacctctaacgtgtccatttctcaatctcaaaaatggccaaatcccacatgtcatcatcttcttccccttctctctctcctgctggtacattctccctctgccttttcgcatgccatggccaccgaggagctgccgccttgagccaatgtgacttcggtgcaccacatacgcctcctcctttgtgcatcaccagtcatcggaagtcgcgatgttggcaaggtaagacaggtgcgacagggaggagagcaaagcagagtggagctcgaggcagtaaatgccgcccgacgagctcaaacattagagcaaggctaatattacaaccgatctgttggctataaggtttttttagccttctctcagtttactcatataatagttagttctttacaattaatatagggtccacttgtctttctcacagagtttcttggttattgtgtccaagccggttgtaagttacagtccgcttctcctttctcttctatcttctctcctccacctcagcatttagccggcttatagcctactattatacttgctcttagaaggcgtcatgacgcggaccagcaataattttcacatgtaccaccaaaaaattcttgctgcagggatgggtgtgtggacagggatgacgcgcaccagcgataaatttcacatgtaccagtagcaataatcgaccatactacatccacgtccacgcggttagagaatccagtgttgcggtcttgcggatgaaacaagggggtgatcagggctgtccacaagagaaatgatggcggcgctccttcgagcttcgtctgtctgatcatatcaggtgtgggtcggtgtagctgtggccgacgtacgtcgcccggcagggacaacacagtgaaccgatctcccgtcgtccactccttatcatcccatgcttcctgcttccaaggtgctgccacagagctcgatgcatgcggatcagcaatatctttgtgtcgacatcaagtttgataacccctatattctaaaatataacaacctaagactagattaaatatatcttaatactattaatctggatacatgctttttttaaattcataataaaactaaggtatatcccatccagggtttgcacttttggaaggcaccaaaatttctgtgggtgttgaaattctgaaatttcggatatttcgaacgatttttttaatgaaattttgacacattttattgaattttgaataaattgttaccaaattcacaaatatttgaaaaaaatgaaaattttggacaaaatatttgcttggcagggtgtggaaattaccgcgttccaaaactttaatcccattccatctaatattgtgttatagtttgaggcaaagtgagtacactatagtttttcgcgccaccgatgcaccagagcccaacactgccgccaccagtaggccatcgtttgctagacaacaagagggttgtgtttttcttttgctctcggtgacatctggatagtctagacagatagtatcttttttccctattgtttgccacgtgtatatcccctaagttttttttagcaccttgaaatgaaaaatccttgttttttcctaacacgtttttattgtttactctataaaattttgttaagaaacaaattatttattttcaaaattataattgttaatattcaatttaattatacactaattatccgtctcgttttatgtgtggctaattagactatagcaatatatcattccaaacacggcatgagttagggctatttggatgcttgtttttgtttatcaaactttttatagctaaggtgtggcatgacacaatttgtgtggctaaaaaatctttggccacaagttaggcaagtattggcaaagatatgtatatatgacaggtggggacacaaaagaaaaagatagcgcagaaaaaagatggcagccaaataaacactaggataagctgatcaaagtagcactaggataagttgatcaaagtagcttatcaaagttgtggcaaaatatggtgaccatcaaaactcccccttaggccatccccagtgtggatctttggctcttacccctgaagacgccatcaactcaaatcaaggcgtggccaatctcgactgggggtagtttctcgtgaacagctaagccaagatgcaacctacctcaattgcacaaccccactggtcttgcttatagacattagggcgtgcatagctccactcatcttattcaaaaatactttcttcgtcccaatataagtgtatctagaatcggatgtgatatttcatagaacagaaaatctggacaaatagttctactatggaatatcgccttcaatcttaggtggacggagggagtattagggtatctccattgtttgttttttcctgcagtagtcaaaaaagaaatgctttagtttcacactagatggatcatatggagttagaactacggttaccgataaagaaccaaccttgtattagctccgagttcttcacaaatgcattgcaagagtaggtcacagttgatagcatgaccaaataacatcttttcactaattcactctgaatgaaagccattcaaaattttaggtttactagcagtctggtttggaaatttgaacagttctaccaagttccaggcacataattcctatacatgccatgcacttggggaatataaattttattaattaattttacggcatgtgccaccatttcaattatttttgaatcttttatgcttccaatattgagatggattatttgtaatggtacttcgcaactgtgcccctatcagttatcttgtgaaaagttttgcctatgtactaactatttcaagattgtatcatcagccaattctcagggtctccttactgctaaacatgattatgcagtgataaatgtttttcatgtagttgtgctgatgtgattggtgattcatgccactccttactataatgtactattctaggttttataggtcacagaggaaattcaagaaataagatttaacattgcaatttcagcaatgatggaatttgtgaatgctgcatacaaggtaaccttaagctatgtttacatgcatagtttcatctataaattctgttgcatatccattttgtagttgcctacacattatctatttaagttccatgccagatgacttgctattaaataagacacatagttttatttttttatacactgttcccatatgaacataagtttaaaaaatgtgtctgctttgttaaaattcaagttatttgccttgaatttgcaaaatattttgttcagattattttactatatgtctccattgttatattatcgctagtcattgattagttgttcagacaggaatatggaactggtgtcttgaaagggccttgatgtcgcctagagggggggtggtgaataggcgttcctaaaatttacttcaaatcgcagcggttaaaatcagggcccggaacttcctggcaaaaggtccggaacttcctggcaactttttctcacaagcagagaaagctgcccggaacttccggagttcttcctaggaacttccgggcagttgtgaattgctatttcaagcacctcacaacaagtaaattaaattacaaggaagcctaaaccatagagaggtacaacatatctcaaacaagagtaatacacatgaaaatacacaagatatcacaagtgatcgtacaatgggagacatgatagcacaactaggcaaataaggagataagcatcacaatcacaaagataaagagagtgagaggagacaaaagatttgttttccgaagttcggattctccaccgagaatcctacgtctccgttgaggagctccaaagagccgggtcttaattaaccccttgccttaccaagcaaaggcctaggaagaggtctccggtattcaagccaacacccctaggtacttctctttggtttcaagtgaccactaagatccccaacttgaacaccaagagaacaccacaagtgaggcctgctctaccaagacgacatcctaaacctcagctcggaattcacttaccgtgtattccgtttcctttcggaggtggaataacgccctcacaaacttgcccgggtcaatccacaaccttgttggaaactcgcgggcgacacctaaccatctaggaggtcaccctccaagagtaacaagctccaaataacagcccaacgagataccccaagtgctcaagtcatcctagcctttaaaaccttctccaatcctcaccaccaccctcaaaatcactctctcactcaagaaatacacaagatttgggtggagaaagcaaaatcacattgggagaggctagaacaagctagggaacacaagaactaaagtggaatggccaaagggtgacgtggggacgagatcaatatatataacggctaggtgacgtcatctagacgttactcacaagtttgaactggaaacctgccaggaggttccgggtaaaagtgccaggaacttccgggcagcacttaggaaaattttcaacctcacctcggcgccaggaagttccggacagaaccttcgggtgggactctctgtcccgagtagagccattttcaaaaatagctcctaaaaatatttcaacacttggacactactaagagcacttgtgttatctcagaaccacacttggaacccctcttaatagtacggtttttcctaaactcaaagcgaaaaggtaaactagtctaactcggctccaagtcttcttgccgctttgttttggggggtctccaagcatcctagcccactcctaagcaacctgggactaatacaccactaagaatgtcatcttcttgcttcaccttgagggttgtcaacgtcaacgccagttcgctattgggactattctcacctacactcattaagcatattagtcccaaatcaattatacctttgctttgatcaatgcccactttggattttgacttgatgttcatcgaagaaccacatcctcttgatcctcgacattccatcttgcggtcttcttataattgatacggattactcatagcttcaaatggcctcgcacggtccatcatgaccatcatgacaaagccttcactcgcccttcaccaccggattcggtccatcggcgccaagcctcttgcttgcccttcaccccacacatggtccattgtagccgagccttgcttgcccttcaccgttttgccattaatagccacctcatactccgcatcatcaatgcgttcacttacgcctcattaaggtataatgtccatcttctagccgagccttgctttctcttcaccggtttgccatagatagccatttcataccccgcatcatcaatgtcttcacttgctcctcatcaaggtataatgtccatcttctagcttcaatcttttaacttgatgccggaacttaacctaatctcaccaactcatgaaaatagttagttccaacaatgggttgtcattaatcaccaaaacaatcaccgcactcttaggataatagatattccaatctccccttacaaggcaattctagtacatagatctttcatgtctgtactgcaattattcaaatccaaacaagcttatatatgtgctttcgtgcagtaaaggcttaaaatgtgcttaagaacttttatgcatgtacttctttattttctgcttagcacttgctaaattcgcacataaccttttgcaatttataaacctgatgttagtaaaacccaataggatgccttgaatattcaaattgaactgtaaaagaatggatgacaagatcagtttaacatggcattggccacaatatctgtactctagtaaacgtgtttcttttacttctcttataatgctttcttcttacggtgggacacccaaccaaagtcagtttattgaatcctttgttctgttgctttcttcttttgcaccacacatggctaaggagctttggtttcaccttgggcactcaagatcattggcccacgagcaattttcagaggtaagcctaaacattccatgcttctgcacatcagccagaaagtgtgcattaccttcacagcaaatataggttcatggtgttcaccatgtctgatattagaagttctaccttccatggattaccataaattttagcgaattgttgtgagatgaatgatgcaactgcaattattgtgagagtgccttctctagttgctcagtctccgtcagcttccaggccatcttctccagtagcagctacgtcagcttctcctgcagatcattccctggtagcaatgaggtctccttctccagtacctcagtctccgacaacggcaaatacatctaccattgttgttttgtctttacctgcaggtataacaattaccacaaatattttttttattttcttgttgatcattttttttgtcactaactataaatacctgtctttttttttgtctgcatccaggtgatgcaagtagtggcctaagcactcatgacaaaaaaaaggaagaaaagggcaaggaaggggaaggatattgatgatgtggtggagatgagaagaaaatgagaaccatagctgaagtggggaatgtttacacgagatgtgttacatccatgccaaacaggaggagcaaggaatcctccagtgatgtgtgagtttcaaatttcccttttctctttttgctaattcttacatgttgcagtgaacaacaaatggttgtttcacactactgtttttatatgtcccaccacattttacatacttgtttcatcacattcccaattatgttgcatcaggcatgcacatacatagatgaccactgcatactgcccctcttttatgtttcagtacaatggttatgattgtttcaggacattttatccatatgtttgagtagactgtacatgtttgctgcatcaataccttttgtttttttttgttcaacacactacctccatgttccagtttttttcatactactgtgtttaaatgctccagtatgtcacatatacttgtttcacaacatttatgattatgttacatcagcactgcacatacatgtgcaatgcacatttgttttttttatggtttagaactatattattcatacttgttttatcacataatcccattttgttacatcaaactaacatgttagtttgattacttccatattttccatatcatgctaccacctccattcttaaagatggatggattccatgtttcactaagtatttttgcgatgcaatgaaagctagaggtcgaacaatgaagtcatggcttgttggatacagatgttcaacgatgaatgtagagaagagagcaagatgcaatcaaacataaaaaaaatatgtcttctctcctttcttaatttttttttatctagcttttgttacatttttttaatgagaattgctagcgcacgggatcccgtgagggatagagagttacgggatagttaaatgaatctgtccacatcaagctttagtctcctaccacgctaccttcttttctttttcgtaagacattgcatgtggtctcctatcgcaaggccacgtgcagccaccactcactggaaaattagccagtgttgtctttgatgtgagtacaaggtccgacctagccccatacacaatatatatgatacctacatgtaccagaccgggtaccaagtatcatgtccagtatcaatgaataccaaacatgataccaatatgtatcatatctaggtactaggtatcatacccgatacctatatgtaccagacctgatacttaggtgtaccatgcttaatactcatgatacctatatgtaccatatatgggtaccaggtaccatacctgatacctatatgtaccagacctgatacttagatgtaccatgcttagtactcacgatacctatatgcaccatatctaagtctcaggtaccatacctgatacctatatgtatcatacctgatacttagatgtatcatgcttaatacctaggtatcatatttgatacacactggtaatgtgcatgtataggctggtaccagccctaccccaaaagtagccacgatccaagcaacccatctatctgtttatccatccatccatccaaaacaacaaaaaacagagaagacaaaagaagtctagcaaccatggagctagagatgttgttgccaactgtcgtaggctctccggaccttccattataattgagagatgaaatgtataattcaagtcatcaaacaagtataatgaaatatccgacgcctcgagagagaaatattggagacattgccgggcctttagcctgccagtcaacttcagcctgagatgtgcccgtcaaaccactcgaaggcggtgaccagatgtgttacacattcaggagacttgacaaaaatggctaaagatctacaacatctcaaatattcttaactcatactcatgtgaatctagttcccaggatgtgcactagattcacactttcatctcaagcatgattatacatagcaaacacaaataagatgaaagcgattataaactacatctactttagttacatcggccgactggccaaataaatatatagaacagcggaagcttgtctacccaatccacaagcacaccgactaggggtttaccccattaagttcaagtcctagaagaagcagtcgatcacccgcatcactcaaaggctaagtctaaatcctgcaagcaaaaggttaattccatagcaagagtcagtacattattagaaataatgtactggcaagcaccaagacaagcctaagaccctacttgcaaggcatataatcaaggaaggcataatatggttctttttagcataaagcaagttttatttgcataaaacatttctaaatcaggtttactttcaaataaatttcagcaagctagtatttgacgtattgggcatcaaggtaggcattaatcatgtataaatattcaccttattgccatncatggcagcagggagatcattctcaaatctcatcacaatttggagggtaattcagcatttaggagagtaaacacaagtctatactcaatacatattcacacgccgntcatgaccgcgagcacggctaatccgattagttaactttgagagntngtcaccttaccacatgatgcgaaatatattatgn

SEQ ID NO: 66 - DNA, 1802 bp, Oryza sativa
  unsure (1)..(1802): unsure at all n locations
gggaggtgagtataaaaagccccctcccccaaagaaaaagggaaagtttttcgtaaggggaggttgataagaagagcgcagaggattttcaagaggaaacgaaagattttatatgtccggaaggtttagcccccttgaattaaggggaattttttgtaaccccgcaaggagggagagccaataaaaaaggccaacagggaggctttttagagtttcgagccctttagaggccttttgataacatgtcttttcggagattatgcccgaattttgtgaataccgaatttcccgcctttaataagttaaaaccgttcccaaaaccgattgtccaaggcaggaatcaataacaagaaacggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaatatatttatttgatattttagagcaacttttatatagaaaattttcgcacgaaacacaccgtttagtagtttaaaaagcgcaaatattcaaattttcatccaacttttgttcaagaaaagaacagggcctcttttcgaaaatcagctatttacgagggatgtttctgtaatttcacacaaagaagagggtacaagctctcgctctctctcggagtctcgggaatcctctcccctccaccacagccgccgccgccatcaccggcgctccgagccctacctccctcccctcccctcccctcccaacccggctgtctcatggaccggcaagcccaggactacgcggccgcggccatggcgtacgcgcaggcgcagcagcagcaaccgcagtacggcttccaccctcaggcgccgccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67 - DNA, 1607 bp, Oryza sativa
  unsure (1)..(1607): unsure at all n locations
ccttttttttattcttttcaggggggggtcctttgaaacccccccccccggcccttttagggttcggccctttggggccctttggtaaaagttttttccgggttatcccccattttgtggaaaccgaattcccgcttagatgaaataaaccccttccccacccaaaaccgagggccncggttttattttacaagaaagggaaaaaggccccaaaagcaaagcgctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatgaaatcacaagtgaaaatacagttatccctgtctgattccttcataagggtgctgagaatactttaatctgacacagttttgatgaacctatatctccttttaaattctatggctgttcgtgcagattaatcttttgtgagttgaatgcgaattgttggattggatctgatgcctttgatgacatgatggtttcagaactggcacacatcgttgttgccagagctatgttgatattgctcatgaactaggacggtctgaggcctttccaatccgatactatagaaaaataagagttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68 - DNA, 7259 bp, Oryza sativa
  unsure (1)..(7259): unsure at all n locations
ccgggnnnnnatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctacacatttaaactgtaaatggcccagacaaaacttgcactgggataatttcctaacaatataatacgtcagacattgatgcttggagatacaaaagtgcgcaagcaattagttttcataaattactagaaattgttgaagcaaaggttggcaaacatttgacctaacttccaggatgcctggatttgcacattcctggttaaatgaccagttcagatttctttgaaaaataatcaattcaggttccatcagatcatccgtaaaactataattcaaatttaaaagaacaacgtaattggtcaaggcaaagttcacatttttaatcccaacataattagccaaaaggtaaacttcatgtcccagattacatatcaggaacaaatgaagtaaataacataaaggaggtacaggaattcatgaattatggataactcaccttgtagcgatggtagtgatcaacagcaacatctgcattgctgaaatcaatcacccgacctgaagaaagattacattgctcatattgcagtcatagtttgcacctcagattagagtacttctacaaataaatccccattactgaacctggtcttttcgtgagagtatcccatatggtaggtccacgttggccctcattcacggcaccttcatactggtaatatattgaccagaaatatccatcagacatccatctaaaagaactcaagtgaaattagagatcttttggtaacactagacctggtaagctgaagaagctgtgccaaagataaaaccgggagggaagtctgctctgcttatagcttcaacacaggcagaaaagctgacaaggatatgaacaagtgttaagagactcatggccttcccttcagtaggtagcactaactactaatgtccacagtctatagataagtagcagacaggattgtaagatatatataaaccttgttgagttggtggggtgtgggaagcaactgaaggctgatcatcacttgtcttggaatccaacgcgcgtctctgctaagtagctcttgtggaggtgacaggttgcaatatctctatcacactggacattttatcaaaaagggaaggaaactttgacatgtccaactctgaaagtgtcacgggtgtagcaaactaaagctttacttgagtgcaacaattccaggcgcattaaggatttcccaggattccagcatttaagaataaaaattgtgtaactgagccagtctttaggaagctacaccagtttgagaggagtgcaagcaacatggaagaaaggctgtgttaatatcacgataacacatttccttcctaaaataccatcctgcagtattgaccccccttttttttctcttatgcaatgatgctaagtgataatgacaataaggagcctaaaaaattatgattaggaaaatacagtggttaaccccaatataataggaatctttgttatccaactagtttggcagcacggcataccaacaaacaagtactactaattattgatcaccacatttgttgcattgatttaatgagtggataaaccaaaactgatagcaacgatttagtgatgaatttatcctgagattatagcacagtcacacacttatcccattggaaagaaaacggtttgcttgcacggcagagcctttcaagaattgaatagctccagtgatagccacacgaaagggacaggagcgatttgctgatggtgaccagtggaacaggcaagaatgtagtgcacgtgttatccatgaaatccctcacatgtacacctaaggtttatcactaaatacagtaacacacaaatacacaatgcatataaacgtagacttttgagtcaacagttttgtttatcacgaaatatagtaactaacactcaaatacacaatgcatagaaacgtagacttctgagtcaaccgtgttagaatagcttggccaaagatgctcgatgattcgaaatcttcggtcaaaaagcttggaattcatagtataacgaccactgtcactatgctatttggttttaggtagagaaaccaagagttcttcgattcgaaattaggttggttcctcaacctcctcacatggatcggaaggcttcgattcgaagtcgtccgattcacatcggtgccatctacctacccatccccattccccaccggccacgcccaaccctatcaaatgaaacgcgagattgcaaccccccaaagagaagaaaacggcagcggaaatggcgacgtcccgatcccccacgcggcgtgatggggaagaactcctcaggcgtacgcgcatcggcagcgtcgtcaccgcgaaagcgccccccaaaagagagaggaaatgggtcccagaaaagcgcaaaagggacggaacttggggggttgcttgcctccgcaactgtcgcttggcttgcgcgcgtcgccggcgacgtcgaagccgccggaatccgggaggcgccacgcctgggcgcccccgccgaagcagcatctcgcggcgcgtggcgtggtgatgatgcgtgtggagacgaagccacgcaacgcaacgaggaagacgacgagcgtatgctgggctgggccttatccgaaaacgggtgtcggcccatatcaacccaggacgttcggcccacgttacttgaccacaaacgggattgcggacgacgagcggcccacgacatttgggccttaaccggattgctgacgtgcgtgatagtaagtctattttgcctccctcatgttctctgcgagtcagcctgccacgtcaacaggaaccaccctacaaaccatctaagggttgatctgctacggttttcgcttattcgaatcgtttattagcaaataaaaatttatttatgagtaaaatgtttatatatgtccataataacttaaagcaaatgttgtaaaatataagcattttaaaaaaacaaaaaagcaaattcaaaactaagttctcaaattcaaattttggctcataaatataagcataaccaaacaataagaccgattttcctccattttgcggttgagggaggtaattcaatcaggagcagagatgagaaatgtacaatagattttatctgtgtaggtgcgacctgttcttgttgggtcgagacgggattgcggcttacgtgaggcccgctatatttgagcctgaacgggatcgcggctgacttgggccgtaaggtccgttgtagttgggctggattacgataggcctttcattaggcctttatgagtcttacaagtgggccaatccattcggcctagaggcccatttgtcatgtagaaaagcgctcgccattatcctgtccgcgagcacacgaaggcgttcgttatcctctgctgcttctctgcggtttgagcgagcgagggaggaagaggaggggaggagacgaagatggccggggtggcggcgttgcagggcgcgatggcgtccctctccatctctgcgccgggggcggcgagcaccagcagcttctggggccacccgctctccaccttcgccgccgcgccggctggggtttgtgccgactcccaaccctgattctcatttttcgcattcctttatgtttgctctgctcttatgattcgctggaaaagtagaaatgccagcttgcactgagatttaggattttagagctcaccaacagcgtggcattgcaatggtgatgtctacatcgcctcactgtactgttgttgccttcaggagttcaggctcaggacctcaactagccaacaaccaacgttgtgtcaaaattttgtggtatattttttttagagaaaaggtctcaaggattttgtggtatagttgaacctagttggctagtataaggagggtttatatgaattaatgaatgcttgaaatctcaagtttgagtatatcaactgagtgaattcagaagttagaaattgtgttgtctaccatgggatgtggcctgttatgtttcagtttaaacttgaatattatttttttcctatggtggtataagcgatggatacccaatattcagcctttcaagcagaggattatttttctgaaagatgtgccctctagtgagacagaccatttcttgttctaacctgctgtatagatcacatttcgctggctagaaacaattttgcctttgaactttaaattactcaacagtagaaatttcacagaagacttccatgggaaaatgatggaaactcatttcactcggggatagcctgtagcaaatgattggcacactcggtatacttatcagactgaacttgttctatcttttgtatattctttttggcgttccttagctcttctagatagtctactgcacttcgtcctcagaatgagactcactcacgactaattacttacctggaaagtggtgatgagagaaaataaggccgaataattgctcttgaatggagtgactgagctatatatggcacttatatgatgaactgtactaaaatctgcacttatatgaagaaactcgtactaaaagatcatatgattatcctagatattcttgcctaagaaacatcgtgagcatgattcatgtcatatctcaaaagcagctgattattacattttatgtcattttcataagaaactctgacaagatatgcataaatttttatatgcaggttaaatttatgatcaagacatgcccaattcaaatgagggtaagtttcaattcttttttggtctgcagcttgctatttactcaaatgtctgaaatttccctttttccaatgcagcttaagcgatgggagaggaagaagtgtaaaccaaacagtcttcctgtcctgcacaagatgcatgttaggattggcgatacagtacaagtcattgcaggccgtgagaaaggtaaagttggagaagttacgcggctttttaagcacaacagcactgtaatagtgaaggacttgaacttgaagtccaagcacaagaaaggaacagaagatgaaccgggtgaaatcgtcatggtcagcattgtttctcttgaaacttctttctgtgctgcttctagctagtgtcgtatatatagtttcagatgcctgatcgttaacctatggttgttggtgttttctttgatcagattgaaggccccattcacagctcaaatgtgatgctctactcaaaggaaaagaatgtggcgagtagggttggacacaaattccttgaggatggaacgaaggttcggtacctggtcaagactggtgaaataattgacagtgctgagaattgggtcaaggtgttcaaggaaggaagttcggagtgatcatggtagcatgggagtcctgcacattttctgaactgcactttttgtatgcccaaatgagttgatgcttttctagattcagatttcagagtcttgtaaatttctatacagttgccaacatttttttgtatccaatgacatgcttggcttgttaaccagctactagaatggttcagctacattcgctcatacaaatgattttgtaatgttgttgctgtcccctgtcctgagctattattcgcaaccattgactaatttggtccatttccatatagaaatatagatgagatgtacatataaaacccatgaatgattgataagttcttttttttaaggagtagtaagataggagtatcataaaagaaacaagcttagcaattttttttttgaaacaacccgcagcgatgtttctattgatatagtaggaaaaaaatacaaatatatagtgctaaaagatagcgatgtttctattgatatagtaggaaaaaaaatacaaatatatagtgctaaaagattatagtcagaaaaaggaaaaaacaaatctgatttgccattgataacatgaaagctcaagagctcgtgctgacggctgagaatcaacatagcagatatggcacgcaaatatcaaatccaggtgatcgtaagcaaaccacagttttctgcttgcgttttgctccgcgagggaaacctgacacctgtccagatcccatgagacgaagatgcaacccatcaaggtcacgaaaacaacgggaagtcggcaacctgtgctgcacagtgcacacagcctttgacagcacgtgcgcagcgcgcgagccagatctagctggtagtacagatgggcagcatcggcggcggcggcttgccggaagagcgcgcggcggccggtgggccggtgtgcgtgacggggtcgaccggctacgtcggctcgtggctcgtccgcgccctgctccgccgcggttaccgngtacacgccaccgccgcgacccaggtacgccgtacgcgcgagctcgctcgctagcatcgatgaagctcgtggcgtggtgaaactgacgatcatgcggccgccgccggngttggtgcagaccacgcgtggcggtgttcttcgccgggaagaagggaaggaccacctgcgttgtccggccgacacntgccgcgaaggnagcttnnacnccgcccnacccgctgcntggngttcttcatgtngccgcttcatggacatcacgttccacccagaatggcaccgccacaacatcgtnatttacgaagttaatctccgcaaataaagatccttcataatcgtactacccatgccatttggatagaccgaataaatagttcgggtctggaggatttganaagacacttaggaccgtgcttgaacggcaacagggaaccatacggcttaaacttctccgnccggaaggggcagtnntttactntcataacaaataaggggaacacgagggaccggcggg

SEQ ID NO: 69 - DNA, 2630 bp, Oryza sativa
  unsure (1)..(2630): unsure at all n locations
ctgcgatggcgttcttcccatgtcgccgccttcattggacaatccacgtcccaccccaagaatggcaccgacaacaacatcggtaatttacgaagtttaatctccgccaaatcaagattacttccatcaatcgctactaaccgcatgcacatttggattagaccgtaattaattagttttcgtgttcttgatggattcttgaagaggagcacgtgaggacgcgggtgctggagccggcgacgaggggaaccatcaacgtgcttcaatcctgcgtccgcgcggggacagtgcgcagggtcgtcttcacgtcgtccatcagcacgatgacggcggcgacgacgacggcggcgaccgggcggcgcaaggccgtcgtcgacgagtcctgcctccgcgccgccgccgacgtctggaacaccaagcccatcggctgggtgcgtatacataggcgcgcgcacacacacacacacacctgctacactccatgaatcctctgaaaaacttagtgttccatggatcaatgaacattttgcaggtttacatcctgtcgaagctgatgacggaggaggcggcattcgggttcgcgagggagaatggcatcaatctggcgtcgctcgtgctgccgacggtggccggcccgttcttgacgccgaatgtgcctaccagcatccagctcctcctctcaccaattacaggcaaacaaattctccatcacacaagtacataatcatgtacagattgtactaatcttgcaatgatcaacagcattgttctgaaaatcaatttgtgtgttcatctccatatgcaggtgatccgaagctgtattctctgctggcatctgtgcactccaggttcgggtgtgtgccattggcacacatccaggacgtgtgcgacgctcacgtgttcttgatggagacggagcaagcggatggacggtatctgtgcgccggagggagctatccgatggcccagattgctcagattctgtccttgcactaccctcctttcaaacctgcaaaaaggcaagcagctgtcaaccagccacatccatgtctttcagatcatagtagtagtatttttttagggtcaagttgatcttgtgcttttctggtgtttgattaggactacgttgatctggtgtgttttggcatgaagctgcaggttaagcaaagatttccatggctcaaacccgtcggtggtatcgtccaagcggctgagggatttggggttcaggttcgagtatgatgttgaggaaatcatcaagaacagcgtcgtacagtgcgttgatcatggattcctgcaggatcccgacagttccaactgttagtggtagtagagtagtgagtagtgacgctcagtgagacagtgactgagccaagttgctgtctggttgggcctgaaaggctttctttcttgtactactagtagttagtacttgtaattcagtaatgtattgtattgacaagagatcaaggcggtatgaaatcagtttcagaaccacacacacacacacacacacacacacacacattttcagtattatccatgcagctcaacattcaccactatctcgaattgatgccatattcctaagcaccacaacatcatgcaaacatccactgataaacacacgcatttgcaaatctaaaaaaaaaaactgctaaaatcatgtgctttttttttctgaagaagaaacaacagcaaaatgtacatactaacaaatcgccagcatctaacagaacagaacaatacctgggatcagatcaccactctaaacaatgattcgattcctcaattcttaaaagcagttttgcagaaggaatcatcaaggtttacagatgacgacgaagcaagggaggagagctctcgggttgagcaggtagagctcctcgatgctggcgtaggcgcccaccttgccggcgacggagtcgaaccccggctgcgccgccacttcctggagattctccagcggccggtggatcctcccggcgaccaccctgcacaccagcagcgccttcctcacgcccgcgttcgccgcctcgtcgccgtctccgtctccggcgatgcattccagcgcgcgcttgctggtggaggtggtgaacacgccgacgccgtccttgatctctctggtcgccgagaagccgtggcggatgatgcggcagacgctgcagctgcccgacgtgcagagggtggaggagtcgccagcgccgagggagcaagcgagcgtcctggcgtggaacccgaggagctcgttgccgtcggcgaggcaacgcgggtgctttttggacagncttgccggctttcccttcacccncttccctgaactccttgaaccgngcccaccgaccttccgggtgtggaaccttaccacccgctcgaaccggcccaggcgtttttcggttgcgccaacccggcttggagatgaactcaaccaccttccttgagagttgccttcaaccagttggttacttgaagaaacccgccctggtgttttaacaaaagggcgaaccaaactttgctttagaattccnccagggggtgggggccccctttacccgcggttggagagtgggcccaacccaggccctgggtgtgaaaaacggcgccaacaggggccccttgcctcactccgg

SEQ ID NO: 70 - DNA, 36761 bp, Oryza sativa
  unsure (1)..(36761): unsure at all n locations
cgcggaccgccntttgaaatgctttgtacnatccnnnnnnnnnnnnnnnnnnnnnnnnnnnnnnnnnnnnnnnnnnnnnnnnnnnnnnnnnnnnnnnnnntggatgatgaaacagagaggcagagcaaagcttgccttgagagttcgtccatggtgtttggtgctccgcttaccggcgtgtctggagtggtggtgcgactccagggcgtcgtggttggcgaaacggtcgccgcagcggtggcaccggatgccgacctcgcaggaggccctggcgggagcgggcgacggcgcctcggcgttgtcgtcgtcgtcatcggcgcggcggagcggcgacatggcggacggggacttcctcgtcgagacaggggtggtgctgcaccgcaacaggagcgggctgtgcgggaacggcaccccgccgccggtgccggcccacgcgccgcggccgggggtgctgatccggagctcgcacttcgcgtccgacctggcggcgagcagcacgtcgtgggtcaccgggttcagcacgtcgttgctccctatcgacctcgggctaccgcatcccccatcgccttcgccggcggcggcggcggcgacggcgtcctcctgcctccggctgccaccgtactggctgtggaacacgtccctcaggttggcgatggaccgcgagcaccccgacctgcgcagcgccgccgccgacgtcgacgacgacttcttgccggctgtgacgccgccctgagattcctcccgctcgatcacgccgcaagaatcccccgatttgcagttgagcgacttcttgagcgccgcccacaccgtcggcatctcccccttctccggcgactccccttcctcgccggacaatccgattgctgccaatcaaaccactccatttttaacaagacacgcaacacacattccatgattccatctagagaaaaaggatccaaaactaaagcagatagtactaatcactgtatattcaagaaagaaattatctacaagatgaacagggggaagaacctgaatactgcaatgactgtgcactgctaactgtaagtctgtaactgctaatgtcattcattcctcatcattgccttcttcttcttctaccttcagctggccagagagtattactgtctccatggatgcaaagttcaaactgaacgggtctcattggcacatgcagctagctagaggccggcattatcttggagtaaactggtaggtaaaaacaattgggactggctggcctctgaaattgctctttggtcttatgcatggactatgccagtgacatgggctcactcttcagtcttgagacgttttgctacttccaaggggaccagaaacggacgaacggatcgtaaatgggtctgcggcttaggagaatctttggcactgcgtacaatgcacactctggtctaatctttgaacaaaatacagtaataatactgggctatggggattaaaaaaagtttgagctgatcggtaacagttcagttcgtgccaatgggctaagctatggcctgattgatcgacaaccggcactgaaatgcggcagggttttgttcatttgtcaccgcataatggcatgatccaaccacgcatggccgttagcaagtcctaggataccgttcagtaagcggtgatgcaacgtgggtgctcagttggcacggcatgagctgatcagattggccattttggctccaggattcatagtcaaaagaaattacatgtcctgcttaaacatatagtaataaatgcaaaagaaaccttgaaaatctaccaaaactcaatgagctaaacagtgtgaaacaaattaattttagagtgaagtgcttgccggtctctagtccacttgtgtcctctaaattcccgaactttcaaaatacattttcaagtctccaatttatcaaagtttatcattttggtcctaaattgacacgagcctattggattctacgtggtgattatctggcatgccacatgaacactaaagtgacatgtcagatagatattctagtcttttttttcttcttcttctttttccttcccttcttcgtttcccttctgtcgttttttccccacatgaatgggaaggaagacaagaaaagaaaaagagaaagaaaatgagtcaataccggcatgccacgtgagcgtcacgtaggatcccagaggagttgtggcgatttaggcactttgataagtttggagacatgaaaatatgttttgagagttcaagtacttgaatgacacaagcaaacaactttagggaccgaaacaatacactttactcttaaatttaggctatgtgcgacaaatgggttataagatgtgtgattggaaaaggaaaatgaatgaatgtctaggattaaatgaggtgtgaataataaatagctaagatacaataatgtcctttgaataatgttccatttgtcaaatgaatccttaaggcatgcatgttgaccagatgatcaccgaagcattaaatttgacaaaaaaaatctctggaaaaaaaggcgtatcaaacaaggactattttaccatcattcgaaggtggtgtcaaattatagccagccaatacatgaacaagttagaaaactgtcaaaacccaattcatcaatagttgagatttggtggtggtatattttttttccttttttttgattatgaccttttagggttgtaatcttgtaattttttttctctatcaatggaactttgcacggttgttaaaaaaaaaacagttgggacttttcaagaaaaaaaaaacggccggagcactgtcaaacgaactcactaataggcctcgaaatctgattgggcttttcacgaacaaaggcccataaaatgtagcccatttaggcccaaactgtacatcacccgtgattaaacggcccagcccaaacatcataacactggatagggtgcagacaagggtcccacccgtcagatcccaacacgtcatcattgccgatccgcttccagaagcagcggcaagtttccatctccttcttccccttggctttttatcgctcgatcaggtggcagcgacaacgagagggagagcgagagctaagttcgccggaaaagatggcgatgcggcggtggaaagaggatgcggtggcgctgtcgctgcgcgggtgcggattcggcgacggggacgacgaccggccggagaagccgcggcggtacggggtgacggagatgaggagccccttctacgccttccgccccgcccaccacgcgctccaggttctcggagagccccccgcctaatccatccccatttttgtttcatgcttctacgaatcgctgctgggttgtggaatttggtgtagttttaacttttaatcgcgttctgattcccaccgaatcgtgtttgaaatgaagccctatctgctgcataattcttcgtgacttgattgtttatttgttaattcctaaacagggccaccatattggaatcttcagtctgtgcgatcaacgatcagtgtcagtttgtagatcaagtggtacatttgtggatgtcagaatgcgtagcagctacagctagttttatcagttagattcttaaccaagctgttccctcttatgtcgacatagcatggtcccgtgattatatgaagtgcttaatgccatttgagaatttgagaattgaggatgcttacttgcaatgcaaatgaactttctggctactttattgctgcattgaagctgtgactaggaagattttatattactgtttcctttcaaatgaagaaaattctagaatctagataggagtacatcacttgaaaacagaatgaacctcctggttagggatttcaaggaataaaacagctcgttctcaaggctgtcatttcctgttctatttcaggaaatattggattctctaggtccttttgttgatggtttgaagtttactggtggatctcatagtttgatgggaaaagaactggttagagagattactgatttagcacacaagcatgacatatatgtgagtacaggagattgggcagagcatcttctgcgtcaaggaccttcttttttcaagcaatatgtcgaggtatgcaggcattttgtttgttttgaggtacattggtagtggtacactgtgatacacacttgtctctgaaaattctgaaaccacatgcatgacattagatgttccgtttcaggagtgcaaggcattaggatttgacaccatcgagctgaatgctggatctctcaagctcccggaagaagctctcctgagattagtccgcctcatcaagactagtggtttgcaagcaaagcccctgttttcagtgaagtttgacagttctgatattcctccatctggagatagggcatttggggcatacatagttccagtgaagcagaattcaggtaactataataagcaatcgctttctaatgcccttgtttagctacttctctgcgtactaagcaatgtaagtacaaacgcaagaaaacagcattaagggaaaagttgctcaacatacatttgtcaacatcagtttttccttggggaatttagttacaaagcaatttaatactatcaccgtatgtttatttggctatgctgttggctctgtgattgtactgtctacattttcctatgatgccttcctcactttgatgtggtgcagaaagagtcgaggatgttgacctgttgataaggagggccgagaggtgcttggaagcaggggcagacatgatcatgatcgatgccgacgacatttgccagcgcgctgactctctacgggcagacatcgtcgccaagattgtaggccggctcgggctcgagaagaccatgttcgaggcttccaaccccaacacctccgagtggttcgtcagaagatacgggccacgggtaaacgaatcttcaattcttccctgagaccctgaagctgtgcacaatgctatgcttattacaatgctatgctgacagaccattttgcaagcaagaagcttagactcgttcatgaggcatttccaggtgtatctaacgtgttgcgttgtgaatgtaggtgaatctgttcgtggatcactccgacgtgatgaacctggagcgtctccgaggcttcaacatgcgtggagtctgcaactctcccttattcggaatcggctcgcccttcttcctgatgtgacgacctccctgaatcctcctgatgtatacgaccttcctgaatcgtgccagtcctatctcgcatggaatgctgtgttcgtggtgttgagatgccttcctgcaataactggatctggatgatgtgtagtatgaaaaaaatgtactcctgtctgctagcagtatcagctcatgtatcgtatgtactcttcattctctactcctgcccggaaacttattactccttgtcacagtttatagggtgttcttttacaagaaaaaaataactcggtaaatgtttgactaataacaattgcccctaatcgtcgtattaacagtgctaaatattatacacgttatcttactagattcatattttgaagcattcatcgggaatatagcatagaataaattaatggttcaagtatgcaattgaagattgtgtaaaaaaaaaaagaccacctataatttggtacggaaggaatattatcattggtttgggcttgtttggttgggccgctaatggtgcgcagagaacatgggcctgatttgccgggccacatgggccggactttgctatgaggcccatttcgtcgtcgtcgtcgtcgtcgtcccgtctcccgaactcgccgtgcggcactcgtgctttgctcttctcgtctccccactggccgccgccacgtctagtctcctcctcctcctcgccgccgccgccgccgccgcgggagaagggttgggttggtgaaagagagatgagggagatgatgggtcctccccgccgcggcccggcgtacaagacgaagctgtgcgcgctgtggaggcaaggcgagtgcaaccgcgcctcctgcagcttcgcccacggcgacgccgagctccgtggcccgccgcctcgttccccgttcccgcctcgcggtggacctggtatgcgcgcaccccctctccctcctccccttccccgtctcgctctccccttcccatctgcttttctgcttctcggcggttgccgtgtgctctcgatccgcagctaggtggctctaaatctgttcttctgcaatggaattactgtctccgccgatgttctattgtggacagattgtgccgattgttttctaggaaattattcagacggagtgaaactgggttgagtgtgatctgctatcagtttgaaaagtttgggggatattcatattttgagaagattcatggtgtcctaccatggccccaagaaagagcattctttttaaaataggagtatacatcgtttcatctgtttatgttggatttcgtttataaatcctgagaggatgggctgcatatgtggggaatatgacagacagtgcgggatgctggttgtacagcgaagtgaaagagatatcaattccatctgcgctgtgtgctttctgcagaaacttttggaaatgttgtggaactgagctagtagtaagagaaaatgattagaagaataccaaccatggtaacatctgacaagagctgccctgtaagataaacactgatgacctggtttctatctctggctacttgttggaagaaatatactctacagcctgcacctggtcatgtgatatcagcactagagtcatttatatacaaaactagagcgtaataattccatcagtttgtgtgatatcattttgttgtactgttttatcgcccatatattatccttttcttatagtactttggctgccaaagtttcatgaacaatgtgacatctttgctaatcatatttttgctactgtacaaattagctgttcccagagagattttctccaaccgactacttgcagaggatgacgcatcctattttcattgcacaccttttcagttggtaatcagacattttatggtcgctggaatgcttatcttgctacaggagatttcttgagggatatcatgtggtttcagtcagatgcatgttatcttaatgtgctaaagcacctagcagcttttgcaactaattgtaacaaatttgctgaatacacagcggcaaggtctcctcttgggctttattcttgcctgccattccaagtatgatcacagaaatataaaatttgaagtcaataccaataatatctggacaagtggaattaggtttgttcgacaatattggaatttggaagatctttcttcgtgataatctcagtatgatgtcaaaaattggatattccatccattattcacttctcatgactgacacgttacaaggtgctggatttattttttaagtggtgcatcatacacgtgatatgtgatcatatattggtctccctcatgcattagtctcattggatctgctcttttatgcccccctggggttatgttggtgcctctgctacttactgataattgaataatcatatggctcaaggttgtggtaagcttaatgggtttgtgtgctgcctcatatgtgtatagctcctctatcttttgtggcatattgcttctttgtacatatatgtatgtaaaaactaccatactgaattgtagggagacgagaccatagacctgatgactttagaggtaggcatctgagaccccataggaggaattcccctgaaagagatgccagggatcatttgttccgtgatcacagaccgcgctctcgagatagaggtaatatgctaccaataaaattcttcgttgtaactagtctattctatttttaaacttctatataatctctgaacttttgtatgttgaaatcttccctgcaggctctagtcattcaagatctcccatcaggaagaggtatggggctagggtatacatacatctttgtaatcgagtccttacatgtggttatgcctgtttttatctattttattgggcatataatctaccttcatgtgaccgaatgacttggttcctgctaattgttaatgccctttgcttgtgatgcacccaagggttagcaggtagcctggggcatgcttatgttaaaggcacttgtgcttgttgatatacttataaattacaaactacacaactacatacacatcagagtatcagacaaatataaacatgttgctcttaggcttccatgcaagtaattatgttcacaggaccattttgttaaatatgcaagctgagaaatgtgtatattaatcctctcatacaaatgattcttttttcaaaattttcaagaaaattattatttgttgcaccatttaatgcagtgtttatacagcaacctactgtagagtataatactatcttatcttgctctgtttaatgagggaaccctttgggtttgttgttttcacgaaagatagttctactatgttgccatgtaaccgctgcatgtttttgtcttgcaatttggtcgtttggtgcaattgtatttatgtattccatggatctttcattgagggaaggcatagaaagaagcttgagggtggaaaaactaattcatcagaaagtttgaactcctctgataacgaagatagaaaaaaggatgatagattcaacaaagctgatgataaacatgataatgaagcacaggtttgattatgatctatgcaatccatctcgctagcaaacagttatagtcgtcccaatgctactgaatctcttttatatatttgcttatgttatgcagctgcaacgcattcaactggatatggaagcattacatgaggagaaatcttcactggaggtataatgttcttcatacatatgttacatgtccagcacaaccattagttacttctgctttattattatatgcatgcacatttgaaaagctgatacctgcactacatggattgtgttgagcattctaccacttggctgcaatttatgtttagtttatataaattttggactgctccaatttttctgttttgttttcctgccttaactataatgattatctgtgggaacttttgtgttgagtaaagttcataagatgttcaatccattcagatataatcagatggctccagatatgatgtgtcaatattgacgttaactgatgctacaattgaacaaattgatggctagtttacctttttaagtgacaaatgatacacttcttgaatctcttttagttgcgcctgttgcacttattgtactcttgaggtgtttcaaattcttcttattgttcattcttgcctgtatgttgatattgtaccctattgatgcatccttcttccttgtattataggtgatactgaatggcaagatcaatgaagcatccaaactttctagcagaatagctgatcttgaatcacaattgaacgatgaaaaagaagcttgcgaaaggttttttatttctacaacacatgagcataatcttctctctttttgacaaaaacatcagtttgtggattcttcagctgattaaaaatatccccatgtcgtctgactattcataatactgctctgtcacttaggatggcctcaaaaacaaagaaactcatcaaagcacatgcacgctatgtgaaagctcaggatgatttaaagaggcaggtttcctgtttgtcacctatctgatctgcatacttctattttgtctatatgagaagacaaccctttttttagtctttacatctattaacacattaaagggggtgcaggtcgcaagctcgttttgagaggttcgctgatttgcttgcttcagataccttgaagccgtgtagcaaggatcagggttctagtgctgctaaggaagatccatataatgcttatgaaatgagtccaagtgatcaacggcagaatcatgaaacaactagaaaaagatccgttgccctctcaactagcgaagaaggaaggaatggtaagctaactagatgacatgtttggagatatctatttaatagtcgaatggtttgtccgtattaacgctgccaactagatattagacacatccatgattttcctctgtggtaaataaacaaatgattgacatcctgttactctcacctgtggcttcttcagggaagaaaaggagagagagttatgacaacagggatcctatgtcagagaaatatagaccagaagatgctctagaaccttttcagagcagcaagggaactgaggcaaaagaactattatctgtgaagaagaatttgggggatggtgacaacaatgagaaaggaaatgttgtttcttctgcaaatgtttttacagatagggtgagatgctttcttgcttattctctttatattctctgtggttgctagttgctcgttgctatttctcagtaaaaattagctaatgttatgattcaaagttgatttcctttttgtttattatcaaatctggtagctcgtttggctagaatcaaatccgataatctaatgtttgttcattagcagctaataaccagaatactataatccatcagtttcaaggttttgctgattggttctaaatgaatcatttgtgttctgtgatccaagtttgataactagaataacttcgtgacaccatatggtaattgcatgatttatatgtatcatatgtgttctttatgatccaaatttgatatctaaaacaactctgacagcatttggtaattgcatgattttcttttatttcttgatctctttccatgttttaattttttttctaatatacgtcctccacataattccctcccactagtattatgcttccgtttccaaacattgccttggtatttttctcagagcatcatcctgacaatttgtgccctattttgcttacagtatgagggcggtgatgatgatgatgttcttgtggactagtaaattcatgcagatggagattgacaaagatttcagcagtaaggagtagggtgaagtatggaacatgcgttcattgccatgccagttgcgttttcacagactaacctgaaactaaggctgccagcctgttatttatcttaatgtatcatttaatacaccgggcattaggaattaagcatctcgataacttctgtggcgaagacgagttgcattgttctcaaacaggttattctcacatttgggcaaactgtgcgtcgttattaccatggattccaagtagcctgtatggataatgtatctggcagcctattcgagttaggtttggtattcatggattcatcattgtgttgtaaatttgtaatgctgcgatctttagcgtctgtgttactacagcatcccatggtttcactcggcatgaagcttcaatcctttttcttttttctttgagatggaagttgaactgtggatgctaaggccaccatcgtttggcttagaggtgaaaatggtaacggtaattcccggccgactggcgttcgtttttgacttttaaccggccgaactatatggaaatggtaatcgaccaaaaaaatatggaaatggtaaaaaatatggaaacagaaacggaaatggttttgctgttgtaccgatcattttcgtatttaccgtattcttgcgaaaattaccgtttcttataatatggtaattaccgtatttctaaatatgtcgatatttatagggcatgtatctacttgacccacaggttaaagattgattgactcttcaatcaaatccctaacttgagtgcatggctaaaatatagttatatagtacaaccctaatttatgtaaagttaaatatatgtttttatagtttaatgtttccgtatttgttaccggtttccgatctgtaccgacatgttttcgtccgtattattctgtttccggttttccaatatttccgataccattttcatttccgattttaccgttttcgattttgtttctgagaagaatatgattacggaaatggttgaggctgttttccgatcgtttctgaccgttttcatccctagtttggctaaatgcaccatatgacagcagatgttgtatagaggaaacgataggcgcttaaattagaatgtttcaatcccgcgtgagcctttgtgcatacagtattttagaggctttttgtaggaattctatttcttcaaccccttaataatgttgttcttcgcatcggttgtaatttggtaatgccatttttttttttgttattgaccagacatatggctaatattaagatatttctaaattctgatttggttgagttcggctacaaaccaacagttgctatcaagtcaatgtggtgtttgaaagatgaatataaagattaagtgtttttacgtaaaatgagatggtattacgtatgattaattgagttttaattattacaaacttgaaaaatatatttatttgatattttagagcaacttttatatagaaaattttcgcacgaaacacaccgtttagtagtttaaaaagcgcaaatattcaaattttcatccaacttttgttcaagaaaagaacagggcctcttttcgaaaatcagctatttacgagggatgtttctgtaatttcacacaaagaagagggtacaagctctcgctctctctcggagtctcgggaatcctctcccctccaccggcgccgccgccgncatcaccggcgctccgagccctacctccctccccttccctcccctcccaacccggctgtctcatggaccggcaagcccaggactacgcggccgcggccatggcgtacgcgcaggcgcagcagcagcaaccgcagtacggcttccaccctcaggcgccgccgccgccgccgcagtacccgcaccacccgccggcctacgccgggccgttccctcagtacgcgccctacgcgcgcggcatgccgcccccgcaggcccagcagctctactcgcacctcccgccgcaccagcagcctccccacttcgccgcgcacgccatgccgtcgccctccccgccgncgncccaccccgactacatgcacccgccgccgtttgacttcgcgccaccccccgccgcggccccgcccccttccgacccggagctccaaaaagcgcatcgancaaggtcgtcgaagtacatcgcgaagaacgggcccgagttcgaggtcgtgatccgcgacaagcagcacgacaacccggattacgccttcatcttcggcggcgagggccacgcctactacaggtacaagctctgggtctcgccgcggccgccggtggcgccgtaccctcccgggtcgatgcacatgatgccgccgccgctgggtccgatgatgcgtgggccgccgatgcaccagccgggttacccaccgttctacgaccagcaccagcatttcggtgctcacggccatggggagtatgatgccgcgccgcagcaatccttcaagggcctctccgggccgcttccggtggatgtcgcagctgagctgcacgacgtgcttaccaatctcaatggcaccaaggagtcgatcaagggtgccaagacatggttcatgcaaaggtcgccgttcgcgccggctttggctgaagctctgaaggatagagtgtttgctttagaggattcggagaggcagctccacattatcttcctggttaacgatattcttttcgaaaggtatagcttcgatcggcatctgcttttggtatagaattgctatcctctgctgatgtgaaatgaaggcacgctgtctgatctgattgactgaataaatcacatgatacgatgaagaaagcaagaaaacattcctgctgcaaagatatctatttgcctaatatttagcaactcctttcatggtactagttaggacttaggactacttgtttaatcctttgtccaacatggagatgaatgtctttaggtgtttgttggtccttcaaaaactttgcgatgaactgaggtttattcctagtagatctgttatgtcatatgttcttttcctgaaagtcaattctgttttagcttgtgcttatatccatttgtcaggagggtccataatcagatcttagcttctacataatgtaaattaacattagaataatttgattcatcaagatgttagcaatagcaaaatcagctcattgcagacaacaatgttgaagctagcatctgaggataaaattcaaatgcaatgcatgttttatcaataatagcatgaatgcttgatgatgatatttctgctatatgttgtcaatgtttgatgataggtcatatggatcagtagatcgctttggtttgtatcactcattgtactgttttattgataccttttgtgcatttgatctggagaagctgattgtggcatgaaatctttattaattaaattaatatgtcacgactacatgacctttaatcgtttgtttttacatattcctggtcctttgctgaccatgttcgatctgctgcagcttacaaagacgaactaattctcgggaccttgacaatgaggctttggcttttaaatttgtgctgggatcaatgcttgcaaggatatataacaatccacagagcaaagatgataaccagattcgcctcgagaaaatcctgcagttctggggttcaaaggaagtttatgaccaggaaaccattgctaaccttgaaagagacatgaaaggtggggtagcatatcctttgccaccacggcatgtctcaccggatccctcaacattttcaggtgtgtcctctctctttttccatctttcctattattttatgtctgtacatgttgtctacattgaccagcacatttttctcatgtgagttcataaagttttaaggtgttagttttggcataaggattttgtttgtagttttgtgctattgtccttacttcttttgattggataactttttttttctcgaatactgatcagattactctcatgattgttatgtttatatgttaatgcctaaaaaataactttgtaagttggtatgtttgaagtatgtcggcagttcgctaaatttcaccatgcaacagttatctctacttaaatacctttgaagttcactcttattaatatgttcatataactagaaaaatcaactattagcttcttgtctgtttgttatttcctaattaaaccattgtacagattgagtccttttattttcttaatttaattattgtagaaatagatttgttgtggcatcatttctttgcaatactactaacttttatatgtatacaatggaccttttgctttttggaggtaaacctaaatacgcggttggatgttatttcaggatcagtgcatcagccctcaaaatggtcctcagatccacaagaggaaatggcaacccatcctctttctgttccaccccaacctgtgccttctgcacaatttccattaaatcaacttccagctggtgtttaccctcctgtaggtcaaactgcttttccaggatctttgccagtgcaaacccccactgtgctgcctcaaactgctgctacaccagctatcacaaatgatccaaatccacctccttatccactattcccccctggtctgattccaggaatggtgcgaaagatgcagatcgggagtggagtgccatactctcccctgagtccacttgacatccccacaatcattccaccatccactattccggagtccgagatccttgagcgtgtatcgaagttctttaaggagattggagaggtaaacccatcagaagggccaatgaagcaaagcgagcccgatgattacgataactatgagagggacattcctgctcgcaagggtggtgcatgtattcctcccccacccaacttgcttgtaaaccttgagacagggatgcgtgcagatggttcggttgatagtaaaccggggtcaactggccgattgggccttggagcgtctgccgatccaaatgagatcggccagtatgatgatgtctactcttcatatcgcaaacagaggagcagtacataccactcttccatcagtgctcgctcattagcaccaaagtgaacggcagaagcatcatatgaaccctttcctcatctgtgtaggactgtacttaaatgaacagaattggcttatcaaatgattgtacgatgcaactatgtattgtcaccagtagcaaatgatgtttcttccagtatcttcttgtaagaggggttttgatcgagctgattttgttggcgtttttagttcagatttggagttgatattctttccaagcttccagtcctaaaatgtggcttcagtcactgggacaggattgctgctcagtaaaaatatgttttctcatgtacaaaacttgtatccttgtgagtttagtcatgtgaaattaacatcattagatttttcaccaaaagatattttcataccgtacttattaatttccacgcgcacattcaaatacatatcagttgtcaaagctgaacatcccaagtcaatctgtactttttttttgtggcacccatgttcagacattgcacgtacaggtgtatgctcatgcgaatatcaggagctgtattattatctcttggagataagcgaaactcttcagcgtagttcagattttcagaattctgatctattgcgaacagatgtatcagctccagacttcaccatgcctgtgtcgtagcaacgcatatattcaaatgagaacccatttgaatttattgttcaggactgcagagtcccatatcttcagtacagttatgataattacaggctgaattattacctctggacaacgacatacttctccttttttaggtgaactctgcggtttatctgaaaaaaaggatcaccttgttctcagaaattcataattactactcgagttatattatctgtttgaggcaacaagcaagcaaaaccagagatagagcttcatactggttggactcgctaaaattgttcagcctaatcctgaattcaaattattattacgaacagaagtattaaaacagagataagacttcatactggttgaagcttcagacttcatgtgccgtaacgatggctctctttccacgtatgtaatttgagatcgtcaggattgcagactgtatttacaatcgccaaatgaaaacagagataagaaaacatcaatccaattatccaaagttggatatatgctacctgcctaattagtagaagagtaataagttcgtttgacatatgcttacctgcttaatcacgtacgaaaatcggtccaaagttcaatctggttacatgaaaattcaaactaaaatctgctttacgtacgagaaattcatcctgagtccaatcttattacacgaacatttcaaactccaaatctctacattctaacgctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaagccaaatctattctgaacttttgaagatctgtgatgtccggaagaaaagattcaaacagataaacgggactctccagaatctataaaataaatgatcgacaaacgctttgctttggtaggcttctcattaacccaaacattctggaagaccaatgctggaggaaaacatagaaaaaaaactctctgttcccataaaagaaatagtactccggtttatctaaaaatatgaagaattctgtgttttcaatatcaatctaaattcagaatagctagaagctgtgtgatctggaagacaagcgaacccagagatagaacttcacactgattggactcatcaaaattcttgtgtttggtttaaatctctggtttattacaaacagaagtatcagctccagacttcatcacgcaattgccgtaactatgcatatatgatatatccaaatgacgagacggcatttatttgttcaggactgcagagtcccgtatcttcagtatagttctgataattacaaattgaagttttaactctggacaacgacatacttttcttttttgaggtaaaacaaaggaatactctgcggtttatctgaaaaaaaagagttatatgtcctcaatatcaccagaaattaagaattattactactacgagcttatattatctcttcgaggcaatcaaaacaaaagagacagcttcacactggttggactcgcaaaaattgttcagccagcgtaatccagaattcagataagtatcaggacgaagtattagcttcagactccatgtgccgtaacaatggcgttctcctctcctcctgtgtgtatgaaaacaactgcaaacttacaaattctgtcaacttatatctgaaaatttgaaaaatttcacccatgtagtttgagatcgtcaggattgcaggctgtatcatgatgttctctattgcatccttaacgttaaacgaaagcacagatgagaaaacatcatacactttgcacccgtaataagttcattagatatctcttaatcacgtacgaaaatcagtcgagagttcaatctcgttacatgaacgttcaaactaaaatctgcttttacgtacaagaaattaatccagagtccaatcttattacacgaacattcaaactccaaatctctacattctaacgctataaattgcgagcgatcccacgttgctctgcacaacaatcagccaaagccgcaacaccaatctcaccacccaccaccgatctctcgccgacgagacagaatggcgccgtcgtccaagctcgccgccctcttcttcgccttcgccgtcgtggcggcggcggcgctggcaccggccgcagaagcgagggtccaagggttcaaccatgaagcggcgtccgagcctgccattgccgcagccggggagtccaaagctgccaccggaggaggagcgccgacattgccgggattacccggcttgccgttcccgctcttcccgttcctcacgctcccgttcccgctgatccccatcggcggctcttctggcggcggcggcgccgctccgccttcggctggctctggcttccggttcccgttcccgctcccgctgccgttccctgcgcccgcctcgccgggcggcgctccgccgtcgtctgggtccggcttcccggcgttcccgttcccgttccccagctcgccggtctcgccaccgtctcaagcatcacccgcctcgccggcggcaccggcgccgccatcgccgccgcagccaaaggagtgcttgacgccgctgttgtcgatgatgtcgtgcgcggactacctgacgaacagcagcgcgcagacgccgccgggcacctgctgcgaggggttcaagtcgctggtgagcacggcgcccatctgcctgtgccacggcatcaatggcgacctgagcaagttcctcccgctccccgtcgacatgatgaagatgatgacgctccccaacacctgcggcgccacggtcccacttcagacgttctccatgtgcaacagtaagttcttgctaatcaaattacaccctaattaaaccctatcgtaaagcatgtttattatttctaatgcattgtttgtttgaagataacataatccatcgtaaaaacatgttttgtttttatgcattgtttctttgattgaagagattagtataaaccatcatgaaacatgtttattttttcatgcattgcttgtttgatgaagagattaattaatctaatctggtgttttgtttgatttgacagcgccctcggtgcctccattgatgcctcagagcccatctgctgctgctccagcgcctggtagtcccccatcgtcgtaaatattcaggtaaattcgtatttgaaaccctctgaaatttaatctgttaaaatttatgattctttttctcatctaacatcttctgattttgtctatttgtttctggcaggtgtgtcaccgtagcctgtcgtctgcttcagccgtagtcttctttagtctcaggagttttaagatatacacaaggtttagggtattaggatgtgattaagtcatactagtagatatttagcgctattaagtagcgtacatgtattttttttgtccgtgaaataaataaagtttactgtttatttgaagttgtccctccatgatgcaatacggatttgtcatttgcgtgtcaaactctcatcgtacgctaattaactgatgatccatctcgcgagtatgattattcttcgaaaaaaaaaatcattgggctgtatttggcgactagccaggtgggctcccagcctcccatcggtccattttcatactgggccctgcacatgattttaattggaacatgtacaaatccacatttttagttcaatgaataataccggtatgacatttgcaatttaaaagaaattccttcgcttctgtcttagtggaaccaatacagtacagtattcataatattacttcgtgcttatatatttggatcggaggagtattgaacatattttttaggataaaagtggcaaaccgtaaagtttcgtgtagaaaccttctatattaaagttagttgttataaatataagattaatctatttttcaaatttgtgataatgcgtggaactcttaataacaccacctatatcgttaagcaggcccacgaactaagcatccttcttaggctacgaagtacgaaatttaaccagcagagcaaattgttgtttatagtccaaattccgtctaagacgccagagaagaattgacgaattcaatttgggcaaagatgctggtaaaacttaacaatgttttagagcaagataccagtacatagtacaaatcaacatacagatttgccacaatttactttagtacaattttacttattgacaaacacattccattctccgtggtccatttgctctgattgcagaatgctccaatatgaaatccctgccgattcttcacttctgaccatgcacagttgggacggcaaaatatactcagaaacaatatcaaagcaagcaagcaataaaacatactcagaaaaaaaacttttgaactcttatttttctatagtatcggattggaaaggcctcagaccgtcctagttcatgagcaatatcaacatagctctggcaacaacgatgtgtgccagttctgaaaccatcatgtcatcaaaggcatcagatccaatccaacaattcgcattcaactcacaaaagattaatctgcacgaacagccatagaatttaaaaggagatataggttcatcaaaactgtgtcagattaaagtattctcagcacccttatgaaggaatcagacagggataactgtattttcacttgtgatttcatcatccacatctgaaaaaaaagcacaaagaatttaacaaaaatcacaaagcaaataaccttaaacaaaatcatatcaattgaggaatctatcagatcttcctattcaatatgaaagaaatgtcatggaacgccacaatccgcagattggacgctttcctttcagagtttcgcatcatttagatccccaaaagacaaaattcacataaacgaaaaaaatactatgtaaatatatgtggcgtttccaggattagactggcaccaagaacgccaacaatcaggatatgaccacacatcagaagaatatcatctggcgtccgagccattataccgtgaagaactgaataatcctccggaattggtaatggacgcatctaatcaagagatctaaaacctaatcgaaggataaacaacagcctaataatctaaaagcaacagtatgttttgtgagatctggaagctcagacagccaagggtttggtcttcaactaccacaaagtagcagtatcagaaactctagtccaaataaaaattgctcatcaccgctaccaagatctcaaatcagctgccgcaaacagaaatataaaacaatctaaatctaattcagaatggtcgtagcgatggatagaatgaggagctcagacagccaagggtttggtcttcaaatactacaaaagtagtatcagaaactctagtccacaaaaaattgctcatcaccgctccaacatctatttgtctaccagcgaaacgaaaatacaatagaaatcaaaccaaattcgagagcaatcagacgaaaacgagatcaaaacgggaagagattacggaggaaacaggcgacgggcggagaggagatgggcgctatgcgtcgacggcttggcggctctcgcagggatttatagaggaggtaagcgtttctagggtttcttctcccgtgcggctagtagatgggcccgtttaggcccacataaaataagatggaatttgcagcccggcccactagcttccgtgccggatcgtggcctttctgcgtgcaaggtttaatttgacaggttgcacctaaagttcattttatattcctcacatattcgtaccacagtaccaagatataacgcatactcctcaacatgaagtactcgctaatttcatctgatccaagctcatgtgacgtgccattatccaaaacgtcaagaatacattcaatataaagtataggaagtactcacctcatgtgaagtactcccatgctcgcttcctcaacatgcatcaacatgaggtatatacagtaccggagggagtatgggaggaaggagtacttcaagaacacattaaggctgtgtttagatcagcacaaagtttaaattttggttgaaattggagatgatgtgactgaaaagttgtgtgtgtatgacatgttgctctgatggaaaatgactaaagtttggattcagactttggatctaaacacaacctaaatgcatacttcctccggtaccatagctttttgacgttttggataatgacacggtctccaaaatataactttgactttatttttctattataatatatataataaacaaatgcatgtttacttttcttattgtactttgaaagataaatctatatgtgttgttttaattactttaaattaaatatttttatagttattgataatcaaagttacgaagtttgacattaactttgtccacaacattaagaataatggaaccgaaggaagtgagagatagagagaagagaagaaaattatactagtagttaataaccatgtaactcttctactggtacatgttaacataagctcacagttgagaccttattagttggggaatttttttgggtttggttatcacatcggatatacggacacacatttgaagtattaaacatagtctaataacaaaacaaattatagattccgccagaaaacaacgagacaaatttattaaggctaattaattcatcattagcaaatgtttactgtagcatcacattgtcagatcatggcgcaattagacttaaaagattcgtctcacaatttacacgcaatcggtgtaattggtttttttcctacatttaatattcaatacatgtgtccaaattaacattttatctgatagcgtgaaaatttttattttgggaactaaacatggcctgactctactattaaacttgatctaaaggcctgttagagccgccaaaagggataggaagggagtaacaactgccggaagtttataattttccatatcatagtctacgtatatacacacagaaaacaacaattaatttttttagctttgtatatatagttactccagcaatattagacgattaataaggaagtaaggccagtttgcgtgctattttttccgtataaaaatgctatatatgtggaaaaaaattgataatataccttcctttggaatgatttgcatttatatatatgcataagaagaattagcacaaatatacccgtacagcacgatgggaatgcgggagtgctacgtaaccgccagccgggttgttcacgcatgttgaacgagcggcaccactgcggtccctgcggcaccgcgtcggtgccgtggtctgggagagcgggaacgtggtggcgaggcggtgccgcggctgtgtcctgcgggaccgtcgcgtccccgcagattggtgatgcgggatggcgcatgctcctccaatacatgcatgcttacgtgcatatgctttgcacgagccagccaatggaatgccggctcacaggatgctacactacgcacgtaatctaacttactgctaatgcatgcatgccactaatcccgcgcaaccaatccgcggaactgcgtcggttccgcacaactgtatcgcggcaccgctagactgacacggtcccgcgtcttcaagctgcgccgccggtgcggtggcgcgttcccgttcagcgggaaaagtatattttcacaacaacgttagaaacatgtatatatgtgtaaaactacgaaaaataatgcatatttcaaaatataattcatatatgtgagcttcgatcagcatcaaaggaaacatatattctttcttaaaacataccttccatatagaaaaacatatatatatatatatatatatatatatatatatatatatatatatatattatatgcagatctaaagactcgaatcatacgacgaccaactattaattgttcattgtcgagatggccacaatccttttcgtcggcgttctcctgatgagctgctgcttcgtgcttatttcctctgcatctggcaatggaacgatcaggccgatcttttcgatgaaccaagcggtatgttacactacacattgctgattgaattgcttttaatttggtatggttgcatgaagtatcggtcgatctattctcaaattaatttcaatctacaaaatcatatatatgtactcttgggattggttcatcagagaaaatgtggtgcaattggaggaacagcgcgctgcaaagagatcgttgacggatacattattgaagacggcagtatctttcaggtgagttcttttattgtaacgaacccgcgtaagtttgcatgcagttgtagtttagatacaatcacattgatcagaacgttataacatgatcccacgtacgtataatctatctctatttatttttttatgttaatgtggttttttttttgctttggtcttctctttaattaataatgtaatacagtatataataatgaatagattgacataagaactccgtactaatgttgtttggcatactgtaatatttttgggaatttttttttgtgcctctaaatctttgccctatgctcatatctttttcatacccctgagtttgtcatctctcttatgtgttttgatctactttatgtctattctattagctggccgttagattttttccaatgaccatactacctcttcctcgtacataaaaagctaatttgaaaagcataagtgcaagaacaattttagattaaaaacaaatcaaggagataaatatattaccccaactttaaattttaaaatgaattttaattaaatttgatgaaaattttaatggtatttgaccttctctctccatggacacatgtcttccaatttggttgaagttctttaaaaaaatatccttttggtttccaggtagaggagaaataggaaaaccaaatgatttttttatgcaattttcctaatttaaattttattaaatttgattgtaattcttttagaaaagtttaaagtttgatttgtcaaacaattctatccattcaattaattgtaatcgaatcttttgccttcgtagttatatttttataagagtaaagtacatcaccggtctctaaacttgtatcgttgtgtcatcccggtccctaaactcgcaaatcgaccgttcaggtcctcaaacttgttcgactatgtcatcccggtccctaaacttgtagatcactcgtataggtcctccaatttgttcagttgtgtcaccccagtccctaaacttggatttgaatatcatctgggtcaaataggacggtctaaagactttatatttaaaaataattcataactttttcatgtgaactctaatgaagataaactttatatcaaacttgtagccctcgacgcgatctataactttgtagttgatgttttttttattttaagtcattttttgtcccaaaatgtaattttaaaattaaaattacaaaatctataaacatgcaacaatattttgggaccctaaacagttttaattcaaaaaattttcaactacaaagttgtaggtcgcgtcgagggctacaattttgatataaagtttgtctttattagagttcacatgaaaaagttatgaattattttttggtataaagtttttagaccgtcctgtttagggaccggggtgacacaactgaacaagttggaggacctaaacgagtgatctgcaagtttagggaccgggatgatacagtcgaacaagtttaaggacctgaatgatcgatttgcgagtttagggaccgggatgacacagcggtacaagtttagggaccggtgatggactttactatttttataacaagcgttcccatatagaaagagagagtaatatagtcatttcagaaaatctaacaccaaaaactcaagggtatataagggagatgataaaagtcaacaacaaaaaaagataggctttattattcataggcgaaaaagattgttctcatcatttttacttgtatttatgtacctaatctgttgttttttctttcagtcagctgggtatataacaaaaacatatgaggcacactatggatttatagcaacaatggacgtttacggcttccctcttagcccgggccaaattgtcagttatggttcagcttggatcataactgataatgttgatgatccagtatcgaatttagaagtcattcagatcggttggagggtagattttttggtttatgtcctatatttttttcttaactaggaaagcattagtttctagttaatcgtcttaatatcctcacaggtcgagccaggtgataaacgcctgttttcgacctctattgcaattgagtgatttttctacacatccagcatttcatattctgtttactaatactcttgcagccactaaaaaatatcatttatctcttcaaaaaagacatcgggtcctagctttccgttaacagatccctctcacgtggacaaaacctgccctggttttcaacccaggatcggcgcatacatacgtcctaacgattctatccctggtatttcccaaccaaatggaaccaaggaatacatcacactcaaaataaccaaggttttgttttttcaccaatcccaaaaaatcaatatcgtatatcaatggataatactcctatgtgagaacaaaaaaggtttaatctatttttctctttttgataatgatgtacaggatataacttaagcgaattggatggtgcattatgggtttaacagggatcctgatctcattggtcgcattcccatgtcgtactacagtacactatctaactcagcaactaacatctggtttggaggcatggtggctacaaatgctacatttcaaccgactcctccgcttccgatgggcagcggttacatgccagctgacaacggtaacatggcagcgtccatgaagaacattcaactcatcgatgagcaagggcgagcctggtcagcaggaaatggtttagttggcttctccaccaagaaggatgactacacctttactcctattgttggcgatcagtttttctacgggggccccttccagctcacaagctcgggaaccatgttgcgcgctaatgtcgtttaccctcttctactagtgttgtttttttattatcttttctcatagctacctttggcataggttgaaaaataatttagattatgcctattgaaaaaaaatcactatgtatatttaaatatttcctctgttttatattatagtcatatgattttttttcttagtcaagcttctttaaatttgaccaagtttatgaaaaaaaaatcagcaacctctcctccacgttgccccgtcgtgccggtcaaaacctggcggtacacggtgggtgttgcggggcactaggttgtgtctgagccgccaatggtcgcctccgcctccccgctgtcccgcgaagcgggccaatgtccagtggcacgaggtgagggcgtgggctacgagcagagctgattgaattttatggtggtgttctcggtccgtttagtcctgcatgactggattttgtattgagttttgcccgattgaatttcttattatcgatatttaattttatgatttttccatcgtacgcggctggtatatagagcgataatggacaaaaaatcattcataacccttagtaaagcaaaatcggactccaacctaaagcgggggcaacatcatgcttacgtaagcgaatgatggatagtagaaacactactaatgtttaacaaggtatatatctatatctataatctataactaatataaagattcatatttttcctttcgtcatagtaattttgggtccgtcaatcagaaaagcggcaccctccatatacacgcgcaattacatccgtacgacggccaaagcctactcgtgtacgccggacagataaaaaaaaatcaaagatcgattaacaaaccaatcgaacaatcattgtaagtattacaactacaccgaccgataatcctaacaataatctaatctcatagaaccacttcccaaaatcagactttcatagttcgacacaaccaaatccaaatcggatgcacaacaccataaggcaaacacaataaccaaagattcacccaaataaaatcaacaaagggatccatgggagaactccaatccaccccaacaaaattagcattgcaacctaaagcaattgacaaatcccttcttacatatccatcttgacctctttcttcagcttcttcaggtccggcactagatcgatggcgactagcctggatagaagatgaacagcgctggaccacttgatgttgtggtcacaccgttgccgcctgcgcttgcaccttcctccattgccacttacaaccaccagatccggagaagttgaggtcgttgccagccttcacgctgccctccaccggtccaccccaacgccagcctccgccttgctagatccaccatcaccatggccactgctggtctgctgccgccttcttgtccccttcgccgtggtcgttgcgaaccggacgctcggggcgggaggatgagagggaatgctcgaggcggaggatgagaggtggaggaaaggagaggtagaggtagcgaaccggacgctactgcttgcctccttgctcggagtcagaggattcgagattgggatgaggagaagtgggtttggtggcggcttgggtcggtggggagtggggactggggagcggacggggattagggattaaagaataaagaccgtgggccactagatggcctccggttttttcttttccgagcttcgtatagttgatttttcttgtactcatcactgctgccggcacgattcgtctcttgcagcaggcacgcatcactgctgccaatctgccatggtgccaccacatcatttataattgtgaattggaaataagcagatactgtagtattatatatttgacaatatatttttttatgaatctataactaatataaatattcgtatttttcctttcatcacatctaattttcatcatgttcgtatgcaatccgattcggttagcaatagccatggaaaaaaattgcaaaaaaaaaaaaaaatcggtggccgccgacgccatcaccgccaccggagggaaaagagaggcagcaaagggagccgccgctgccggatccacccgcggtggccgccaccgccgacggatccacccgcggatgaagccgacgccgtcatcgccgtcaatgccgtcgttgagagggcgtcatcaccgtcaaggccaacgaggagagggagagggggagggacggccgtcgctgccgtctccgtcgcaccccgccgtcgctgcgccgtgccggtgagacgggaaggagagcgggagacggagcgcgaacgccaacgccgtcgtcgccgccgttgggagggcgccgtctccgccgcaccctgtcgtcgccgcgccatgccggcgagaagggagggagaagggaagggaagcagcatcggtggtgggagagacggcgccggtggtgggggaggcggccagcttgggggagggggagaagcgggagatggggagagggagcggcaccgccggaggggaggggaggggaagcggcgccggtggggagagagggagggggagaggaggcgttgggcgcagggtggtggccggctcagctgggggaagggggagggggagggttagggtcatcaatttggaattgatctgagccgtccatcaaaatgaacggctcagatcgatcgagggtttgggccgcacgccggccggtggactagcaagtgagaggaggagtatgggggtattaagtagacttttgcgcttgcaggctaaagaagaaaatgggctgaaaagggcccatagagaaaaatgatttttattttgacttttatttaaataaatgctgaaatgatatttgtattatcaaaattaccaaaattaccaattaagctatgtaaattccaagaaaatttcaaagagtgtaattaatatagaaaatttaataaaaattaaatccaaacataatattttatttctcacacttactttacttgaacattaatttaattatatacctaccaacataaaaataccctaatattccagaaaatgtgtatttcatttaattagaatttaatatgttttaatttaatttaatcttttttttcattccgttgcaacgcacgggcacttttgctaaaatttcaaagtgtataattaatattgtagaaaatttaaatttcattaaattagaatttaatatgttttaatttaattctcttttcttttctttccgttccaacgcatgggcacttttgctaaaccaaacaacacttttgatcaatacacacactccgtaatcacccggtgcaacgcacggacacttttgctagtaaagataaagataaataaaaaataaaaaataagggactagctataaatcactcaaaagatgtttttataaaaatcatatgaatataattacggtcaattataatagttacatcatatttacatatttacattgtaattacatgtttgggtgcatatcaaaacaaaattgatacatgtctcatttggtaatggttgcatgctctccaccatgagatcctagaaaaaatgttttgggtgagatatagcaaaatcgaaaaaataatatccctttcccgttcggcttaaagtctctctctctctccctcctcgctgtcccacggctctctttctttccccctcgtgggccacgcctcctgcactagcccatcttccttcctctctctccggcccacctccgccttgggccgcctcgcccagctagcccagggcagcccctcccgcaccgacaggtggggcccacctgtcgaaggcgtcttcctcctccagccgagtctcgttcttctccccggcggccgacgagccctaaaagccgccaccgcatgcatccatcggcctccctgatcgtttcctctcccatttgaatgcgaaaatcgattccccactcccatctcatcatttgaaccataataatcccacccgatcgggcccttaatcgcattaaatcggcggcgaaccgtaccggcgccgaagcttctcaggttgcagtttgccatcgggtttgccgtcgccggccacctccgtcttctcctcgccgtagagtcctcattagtgagcccgccatcctctcctctccttccctatgagctctccatcatccgttgtggcacaaaacgccggcgagccctggctcccatgccgccggacgccggtgccggtctccagccttacctgcttggcaccgcgtggggccgacatgacgcaataaacattgttttgtaatatataaaaaataatttaagaaatttggaacatccattttaacaaccataaaaattcaattggtaatatctttgccgtttgaattccgaattaacccatttaagtgtctgatttttcctaacaatgaaaataacctattatgagctttgctgcttgtatagtttttcttaacctagtacccctctgacggagcgtggggctcctcaccgggagaccgcgcaggcccccctttgccggttcggccgggggcgctaagtgaggttcttcgccctcgatctgaggaatgtcagcgagagaggaaatgcacaagacacgggcgacgtagacaggttcgggccgctgagaagcgtaataccctactcctgtgttctggtggatctgtgtgtgaaggaatacagagagctctggagccagagagctcgagagcgagagagagttcagactctccaatcccctccccagagttcgacctcctctctccctctttaggcctgggccttctttttttatctggttaggggtcaccacacgggcctctcgctacctcagaaaagaaacatgctttttacaatgagggctaatctacagccggaaatgacctctgacaagcagtacgcacgcctccttctccgcccgcccgctttttccggggatgcccacttcaaccttcatttactggccagcgacttccttgccatacttgcgctgaagcctggaatgaatctgaccgggactgacatacccactcctggagttggcacgccggctccggctagggacgagagccaggaagctctcatcattccgacgggacggggcgaggcgtgtgacaggccgcctgttgccacctaacccgcgatctgacaggtctgtgaccggtcatataccgcgactggtcacagaccggataagcatgcgctgcgccgcattgaatgccgcgtggcgcgctcgtctagcccgctataaatgcggttaggtgagcgccgctgtgctcacctaacccacacacgtggcgccaaaaccacagggggtcggggcgccccagccctcggggccgaaacgggagcggcccgacccctcggggagacagagggaggggtggccacgtctccttcgggcccgacccccccgagggggtcaggccacgtgggtgaccgcggctacccaagcctctagtcacgatacccccggccccatgtcaccgacaccctccgtttcatgttacaacgcttaaaatttgactaaatttataaaaaaaattagtaatatttacaacatcaaattagtttcattaaaaatatttgtcttggattaaaaatattactattttttctacaaatttgattaaacttagagcatcaaaacgacttataacctgaaacggagggaatatattttaatggcaaaatttactacaggacactcaaaaaacttgtaattggctgagagtcaccgcaaaaacaagacacagctgatggacactacaaaaaattatgtaattaggtatagaacaccgaagacaatattttataatatccgggtctgaagaggtgagaaatttttcgaaatagcaagattgcccctggctccatcttcctccacctgtgagcagggagcagccgccggcgagtttgtcctgtggagcgggtagcggcaaccgcgcgccaggagcggccgacggcgcgaaggcggacgcggtcgggccggggagggagcgcgagggcggtggcgtggagcgctagcaggaggcggctacgcgtgaggccggcgacggccattcgatgcgtacgtgttcgacatcagcaccgaaaaccatttgacgcgtacattcgattaacacccaggctcagccggaggaggagtaggagggcgtccacggcggcaggcggcgtcgccggagcgcaggtggaggcggcgctgaaccgcaagaacgtggaggcgctcccggaggacgagacggtggagggcggcccggaggacgcgtgggtgcccgaccacgagtctggcggatgaggccgccgtctccggcaccaaaaaccatgaccactgcggagcggcggcggccggcggctcgccgtcggtgcttgaccaggctgtgttcgtccgcgaggaggacatggaggacgtcgagaggccggccgtcgacatggccgctgccaatcacaagcccaaatgagcatcaacttcttgcagcaataaccaataaagccaaataatgccttctgaaatctcatgtacagctagaagtagaaaatttccagtggaaatcttgcatccttggttctatgaatcttgttatctacagtgatcaatcgatcaatcggataacctgttctttgatgaatcttgttgtgtttttatcggatggaatttgctgggattgctttgaattcgtgcacgacgccgtcgatctcgatgaggctgcagtcggggaccttgtcgatctcgttcctcctcatctgcctcctcaccttcaccacctcgccgtggcggccattcgacgcgtatgtgttcgacatcagcacgtagtcgccggcgtccgcgtcggcgtcggtggtgcgccgccacatcacccgctcggcgcgctcgacgtcgtcatgtgcgcggcatgcggcgagcagcgagccccagatgagcgcgtcggggtgtgctggcattgccgcgacgagctcctctgcctcgtctagtctcccggcgcggtcgagcatgtcgacgacgcagccgtagtgctcgatgcgaggttccggcatggcgtcgagttgctggagcccctcctcgacaagtccggcatgacagcacgccgtgaggacgccgaggagggtcacctcgttcggcgtcacgccggctcgttgcatgccggcaaatagagacagggcgtcctcaccgtggccgtgcattgcgagacccaagatcatggatgtgtaggtgtaccggcgagacccagcgaccggcggccatagcaagcctcatatcggccagcgttcaacagcctcctcgcgcacggccacctcctgctcgcgctccgcgccgccgtcgccgccgccctcgcgctccctccccgaccgcgtccgcctccacgccgtcggccgctcctggtgcgcggtcgccgctacttgctctcttgccgtggacaacctcgccggcggctgctccctgctaattttttgtgtgtgatttcaggtggaggaagatggagctaggggcaatcttgctatttcgaaaatttctcacctcttttgacctggatattataaaatattgttttcggtatgctatagccaattacacattttttgtagtgtccatcagccgtgtctcgtttttgcggaccaattatacgttttttgagtgtcctgtagcaaattttgtctattttaattttgcgtttgctgtgtagacgtcattgtttcggaagattggttgttcttcgctgctgatccagaagactttataagcaatcaagtcatatcatacattaaagcatgttgaatcctaacatagtgaaaactatattgtttcgttgttattggatcgcttttataaataataccgttactattctctctccctcatggtgccatcccccaaagatggcgtcgagcactgctgtgaccttagcagaggaggaggccaagccagagatgggaggtagtaggatgcgggcctcctcgtcggtcctggcatctagttttgctgcgagggagaaggtgacaacggggtggagaggaggctctacgcgagattcgtcagccagcgggggacggtcacttggtcagcattgaggtgagtgctttagaagggatttgcttcaaagaccgttgtcaccgttgatcgcattgcctgagctccaatctaccttcaaccgttgctgagttccctcgtctatcctgttgttgagtagaaatagagaaatagagaaggcggagagatctgacatgtgggttctattattattattattattattattattattattattattattattattattattattattattattattattattattattattattattattattattattattattattattattattaatattattattaataataataataataatcataataataatactattattaataataatattaaaccggaaagagcgcgggttggaccatgtgtttattttatgcccaaaccgccttaaaagaaggttaaaggtatttttattggtatacacagttttggtaaccccgggttacccgtcagatggggaaatttctccaatatgttcaaggagttattttatattttgttacacgccggct

SEQ ID NO: 71 - DNA, 1529 bp, Oryza sativa
  unsure (1)..(1529): unsure at all n locations
cgggntnnntttgaaatcantgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatgaatcccctaatgatttttatcaaaatcattaagttaaggtggatacacatcttgtcatatgatcaaatggtttcgcgaaaaatcaataatcagacaacaaaatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttggtgactggtctgatattcgtgagcaaaaacggcttatggtattgcgagcttcagtcgcactacacggtcgttctggtactttttatgagaaacgcgttccgctttcagagcaatgttcaaagaaagctcatgaccaatttctagcggaccttgcgagcattctacgagtaacaccacaccgctcattgtcagtgatgctggctttaaagtgccatggtataaatccgttgagaagctgggttggtactggttaagtcgagtaagaggaaaagtacaatatgcagacctagagacggaaacctggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgcatagcttgagtattagatgagcacacaaannnagcccgc

SEQ ID NO: 72 - DNA, 26991 bp, Oryza sativa
  unsure (1)..(26991): unsure at all n locations
aaaaaggggtgcgagcctncctttccaaccgggattccaaactgccccgaggaagaagccgaccatgccggattcaccgctttgcgtttccgtcttttccgtttctaaggtccgggttccggtgatacccatagggcggtttttgggcggaggaggccccgtcgccttttggtggtttntggctnacggtttccgttccgcctccggttgctgttccttggggccgcttngcaggggggcgctccgccgtcgtctgggtccggcttcccggcgttcccgttcccgttccccagctcgccggtctcgccaccgtctcaagcatcacccgcctcgccggcggcaccggcgccgccatcgccgccgcagccaaaggagtgcttgacgccgctgttgtcgatgatgtcgtgcgcggactacctgacgaacagcagcgcgcagacgccgccgggcacctgctgcgaggggttcaagtcgctggtgagcacggcgcccatctgcctgtgccacggcatcaatggcgacctgagcaagttcctcccgctccccgtcgacatgatgaagatgatgacgctccccaacacctgcggcgccacggtcccacttcagacgttctccatgtgcaacagtaagttcttgctaatcaaattacaccctaattaaaccctatcgtaaagcatgtttattatttctaatgcattgtttgtttgaagagattaatctgattaatctggtgacgtgtttgatttgacagcgccatcagtgccgccattgatgccttccgctgctccagcgcctgctagtcccccatcttcatagatcttcaggtaaattcatatttgaatttgaaactctctgaattttgtgcgatctgttaaaaatttgagatgttatactaaaatgtccttttgattttattcttggcaggtgtgtcaccttagtccgtcaccactcaccgcatgtgccggttgtcgtcgtcttaagtttagtctaaggagttttcgataaatatagtactcagagtttagggttttgagatgtgattaagtcatgatagatatttgtgcagagtctatgtaattttttgtccatggaataaataataatttagtgaattttgtccttgtgattagttgatttgacaatattactgcactgcaatggtctcatctagccagttattctacctcgaaaataattcattgggctatatttgggcctacaggctacaagctggaatgcaaactgaactgagagccaagactaagttggccttttttcatgcttggcccatatcctcctcgtggctctcaaatactccttccgtttctaaatatttaacaccgtagattttttagcacatgtttgatcgttcgtcttattcaaaaacttttgtgaaatatataaaactatatatatacatataagtatatttaacaatgaatcaaatgatagaaaaaaaataattacttaaatttttttaataagacaaatgatcaaacatatttaaaatagtcaacggcgtcaaatatttaaaacggagggagtataatacagaaaatacgggaaaaggtctacaacctgagtataatatcatgtaccactccaccaaattttaaattaaatccacatattcacgataaagggagttaaagtaaaaattgcatgccatctcgtagaaaaagaaattacgcgtgtcgaatacatgaaaaaggtagacttcacctctaaacaatagaaaacgatctcctcggacggcaacgtcgcaaccaataataaaaccaaattaaccttctagaacaaattccaaatggtatcttctttctcctacacctacttatgtgtactacgtctagtgcataaccaaatccacttacattggtactctcctgtatactccctccgtataaaaaaaaacttaatataggagaagatatgatccctcctaatataatctagataaagagtagttcaaatttattattttaagagggtcacattatcttttaaattgagttttttcttaaacggagggagtatatttgtactagtactgtcacagttcaacaaacagcatcattcagcccaacatatatatactctactcctagctgtcagccacacactcacgggtgtataccaactactaagctcatcagctcgtgagatggtatcattgacaccttgaacaattaatggattatcacttgtttttttttatttatacatctccctttttgttcgtttcttgatcagaaaagtgtgtgtctttgttagtgctgttcttttaactgttgggtggatcatgcttggatggggtctcttcagcattcatcttaacccttttgaacgtcttttccactttgttgtgctctcctactcgtaagcgtgaccttgcattcttgagatttttcccccctttacagttgtatccatcaaaaaaacaaatggtaaaagattggaatggctataagtggtgtaaagaatcgttaggttcactacttaaattacagctactaaatgattagcacaaatctctgacagtggaatatatttttgttaactgttatcatctatcaaactatattttaggggatccaatataaagctgaaagtgagaggtgtaattgacaaccaacctctgaaagagatgtagtaaagatgaaggtcgtttccaaggattcccccatgcacacaaaagggcttgccgttgccatgcaaagtaacacaaattgctgatttttttgcaggaaatgtcaatctgaagctgtgcttgtccctgcatcttttctcttgcttgcttgcccggccttgcaagtgatccccgcaggtatcttgtactagtcagaaaagggacatggtctacactctactgaatatgatatctgaatatgatatggagtgatattgttccaaaaatctacctaagtgagccttcaatgatgggagcagataagcagaaggaccaggttcagaaattagcctgtctacagcttgttaattgttaattggatcttgttaattactcaagtgtacatcctccgttcagactcatagttaatttagttctgagcacagctgcaatttgcaatgatctttacctctaagcaaaatatttgacccgggcaggttataggccatctcagtccatcagttgtcacgtctatgagctgggaagttgtgatgaacacgagctgaattagagcaggtataatagcaggctattagccagctataaacatattttaatgagataaaagatgagagagaagatgagcgagctacagatatgtagccagctgcagcacggactctaagacgcaatgtgtgtatgacaggtgggaccatatattaatagtatgataaacaactattgtatgaattgtctattagattggctatagataaattggagttaatagtgggctatactattagacttggtcttaggtgaataagacacatttacatttcgtattcgccaggccgtatccataatttcatacgtgaagacgagtgaacttgtacagtgtacaatctgtacaatgtgtggtttccgaggcagactggtttccagttttttgatggctggtcttgaaaagcaatacctccgcatttggtggttactggttcgccgttcaagagctgttgtcctccacagccaacaagaccttcctcagttcctctccattgtgatcttcgtgttacgatccatttggtgtttgtgaaatggtgaattttcagaaataaaacaactgtgctgaagctactggtgtgaacaagatcaaagcataggtgcagttttggtgggagtttgtttagggcttagttactctacgagccaaaaattccgagaatcagctgatgagtaatcattttgttagatttttttttaaaaaaaactggtttactcatcttctgatttctagtttattttctagattttgtaactaattagtcttagaatctttgtactaatctgaactgtttagactttggaagtgttggaaattctgagagaagctgggcttaatagaagctctccaacaaggtcttatccagtgttcggcaacttctcctctcaaattttactccatcgttttctatgtacacgtatcctgaataacaaaacaatgtgtttttttaaataattgtaaaagagttgctttaaaaattatattaatctgtttttaaattttgttaaagtaataattaattaaccatatgctagtaagtctagttaccctccttttccgtgcatgagacatgagttaccctccttttatgtttcattccattatcttaaaaaaaaagacacgagttaggaacatacagattcaaacttagccagtgccattcccttcttgagtttagtggttggaagatggtgttttctttttatgatttgatgtaattcagtccttttctttttcctctcttccaatggagaaatatgcatttttcctgtgtattttcaaaatacaatgccataaaactaatattcttttacatttaaaatgccgtgtcaagcagatccaaactaaacttccacttgacctccctgattgaattctgcatctggaccagagggatatgattgaactcttggtgtgcaccccaccaaatacactgtactatgagtgtagactatgcaaggaggatgtactgaatgtattaaatgaagtatgatgtcttcatgtgagttaggaaatgatcttcatgtgagtaaggaagccagtctactgttcttcacccaacatttcaaattatctcatttcatatagcaccaacatgagtacaagagggcaggattgaattgtaccccaagaattgacagaagaaaaggaaagcctaattattggaggtttcttagccatgagttcataatttaaaggaaaaattggttatatagcatagaaagttcacgtttttggttttatagtaccgaaagaaacaggttcactttaatatcactcaaagttcaccctgttcccatttttagcacttccgtcaattctcgatcgtttgtgggggtggtgatccagccacacacacgatatgacgtttctacccctcacaagtacaagtagaatgcatgtcaatgaggggtaaaaacgtcatatcgtgtgcgtagctgggtcaataacgattaagacggacggaaaaattgacggaagtgctaaaaataggaacagggtaaactttgggtgctattaaagtgaaccggtatctttaggtgctataaaaccaaaaacgtgaactttcgatgctatataaccaattttgcctaatttaaatatatctaaataattgttccttcacaacagtaggctgccaacttgtatcaagattgataacaatgagagacttggagcaaaatatttcttggcctgaattatgccttccttaatgacaagccagccggtattatggctgtatcatcattcatcaatgtaatcagcttaaagctttcactacattgagcatgcacattgctttatcatggtccatatggactaatatactgataaagatgtcttgctgattctgttctctcttgagaagaaagatgaacatgtagattctagagtggtcctgaactggatcgaaataactgaaactaactgaacctactagtttgttcatcagagaaaagtaggagcacaccatacatattggcattgcgtgtaatacatagttatctcggcactgtaatttttgctggtgacaagttattccaaaagttgtttcaattctctgaacttggaagagattcgtagctaggctgcagtataggtagccaacaaaagatgtgaaggctataggaagttgcttttgatgtgttcactttcttttccctctgtaaagccttgtttaccaaccttatctctcacaggagatagatatcatgcccgtgaagacaataatgtgatgccaaaatgtcggctaaaaaaagcgaaatctcggttgcttttaatcttagcatttattcattcaattatcagcaataacatacatgaaaactttaaaaatgtgatgctaacccaacccctctggttacagtaggaatctgaattgtcaggactcaggacaaccggtagcaatcagacttggctgtcggtgctcgacaagaatcatcaaccaagagcccaagaacatagcaatgtggtaagcaatgacatggcctttaacctaacctgaattttttcatgggcacactgatagattaggtacagacactgccattgtaacagaagagaccggagcaggaaacttcttgagctgggacagtttcaccaattagagctggagttgagtttcgtccatccttgcaacccaatcagatagatagatattcagattccaactaggcctcgcatgcatgccctacccattatgaattgtgatagatacaatgtgagccatgcatcgtctactgttatactagctttgtgtccttgttgctactgctattcagttttaaattgtaacaggtagaatatcctactgatcaccaaatctgctgcgatttgctgcttcttctccaatactgaatgtttggagtggtatactgaatgtgagacaatttgttcagtacaaaatgtacagctgtacatgatgctgcaatctgaacttctgaagtactggagggtgtagcaactactaagtactagtactagcaagtgccaaaggaaagtgcagagatggacatgttcatcacagttgttcatgcattgcacattgggtggccatttaatctgcgttcatgtggaccatccattcttctccccttttcttcacattggagtactgaatacggattatggatggagctggatcatatgctagatacagacagagaggagagctaggaagtgttgtaaagaagcttgcaggttgtgataaggcctatcttggcatgtattgccatcttgaccaatgttacaggcttacagcaccagattgttgtgaatatgaaattctgaatgtactgtcattttttcagataatatctgaaactgagtaccccatcgtttagcctcgagcttataagtataagcgcaaatttgaattttaaaacttaattttagagtagtttattttccatcattcgtatttaaatcgctaagaacatacatgatgcatataaaagttttattcataaattattttttaatcattaataagacgtttcgcttataattaataatatgtataagagggacaatggatacacaatacattcatcgtttcgcttataaaagttagaacatactagttcagagtgtaattttttttcagatgaatcagtacatggtctatttttcagagtgtaattctttgattggcagtatcgtctcagatgccattggtgacttgatcacctactagatgctaacgaagctgtccattaccaaacttgtgtgtgtatatagtattagtacgttctcctctacctaccaaactcgtctgattattttcagttgcgtaactcccctaattataatggcgcctaaaccaaaccccaagtaaatacaaatacaaacaccaaaactgaacaacacactgaacatcactgtatttctcactgtctctctctatatatagccgagtgcactgccactcagagattgtcagagaaagcagctttgagcttagctatggcaatggccgcgccgctgacgttggtggtggtggcggcggcggtggccgtcgtcttcgtcggcggcggcgtggaggggtgggtgctcaaggaggggttctacgagcagagctgcccgcgcgcggaggcgctggtgaagcactacgtggagcagcacgtncccctcgccccctccgtcgccggcacccttatncgcacccactttcacgactgcttcgtcagggtaagcgcgtatagctcgtcgatcgatcggcgtggcgcggcggcggaattctgacggcggcgacggcggccatggcgtggtggttttgaattgtaggggtgcgacgcgtcggtgttgctgaacgggacggaccgggccgaagcggaaaaagaacgcgcgccgaacctgacgctgcgggggttcgccttcatcgaccgcatcaagagcgtgtcgaaagcgagtgcccccgcgtcgtctcttgagcaaacatcctcgcgctcgccacccgcgacgccatctccgtcatcgtaagctagcacctggctcctcctcttcctcctttcccgcatttgcgatggccggcgagctggctgacggcgagcgagcagggcgggccgttctggcgggtggcgacgggccggcgcgacgggagggtgtcgatcaagcaggaggcgctggaccagatcccggcgccgaccatgaacttcaccgacctcctctcctctttccagagcaagggcctcgacctcgccgacctcatctggttgtcaggtaaactaactattcactcttccatatattaatttcagtattaatttcaccatccatttcagagttcagacttcaccatcaatagtatttccttcgttccaaaacaactataagtttccgcgcccaactttaatcgtccatcttatttaaaatttttttataattagtatttttgttattataagatgataaaacatgaataatattttactcgtaacttatgtttttaatttttttcaaaaaaaaattcaaataagacggacggtcaaagttgaacgcggaaaaccatggctgtacttaaaatgggacggagggagtaaacatttttagactttgacatagtctttgagatggtattttgatcaacaatatctataaaagtgagatgttttaaataaaaaaaagttgtaatagtttgttaatgataagtctagtaacatcaattttacatgattgatttttttttatttttttactattaatagttaaaattaaaaatgtttgacttgacactattctaaaattgcttatattttgaaaattagttgcggtcgatcaaaaccccagtttcagcttatgacagcatcgtttctgaaaagaaaagtaaaaccattcacctaagctaatgattggttaacttgacacaaacggcagccaaagatcgattttcacgttatatcctaattaagtcgattgattactagtcttcaggatacacaactcgatcaggtttggtgttttatctagcttgatgtagctagctatgtggtgtttgcaaatgcgtagtacaagccaccgacaaatagtgaattggtgatgtgatatcgtgctgcaaaatctgcaatatgcagagaacgatagttaacttttgcaaattctttgtgtgttgagtcggcaactaggacacgctctcactctcactcacatcacaccccagtaatgctgtccccaaagattcagaagatgaaagatatatagcctcaatcacaccgatttccatgtagtaacaatactaacaaacaacgatcctaataggaacactacagatgccgaatttctatccattatctaaaaaactctcgtgccacgacaatccagaattgaacagacagctacgtccaacagggagggttggatctacttaattcatagaaggccaaaacttagctgaatcttgttcacgggtatcgcatcaaatcaaagttaaaaacagtttagtaggtatagcgatctaaccaacagataacgaggcttttagttgacggctggcaagtctgttccgtgcaataaaatgcaattcataacactgcactataacaaatatatcttatagagatattttcatttttctaatactatagaggcatttttaaaatgcctttacaatgttatagagacattttgaagagtgtctcataagtgccttttggtgaattgtcgcatttttaaaatgcctttacagtgttatagagacattttgaagagtgtctcataaataccttttggtgaattgtctctacaaactaagaggtgaattgtctctacgaactaagaggacattttgaagagtatctcataagtgccttttggtgaattgtttctacgaactaagaggcattttataagatgtctctatgcaaatagaggcacgcactaaccatctcaacctcatataattatatgtaagtatgtgatttgtgttacttatatctagttacttgatatatattaatatttgaaaaaatgcctttacatcgttttaaatgccttaagaaaatgcatttacatatgagacaaattttaaagtgccgaaaatgtgtctctacgagataaacttaacaaagtatactaaaaatgtctctagagtaaaaatattttagacgattttgaaagtgcctctaaaaagtgtctctagactatagagcttcaaaacttagaggcattttaaaaattgtctctacaaaagattctttatataaggtttttgatgtagtgctgttttatttagagagtgtagcacagatattgacacactaactgaccaagatttttattaacgttagtggttaaaggtgtgcaaaaaatgccaagacaaacattcagctcttgtactgtcctgtatctgtacttgtgagttagtagcaaattagtagctagctagattctataaaaggggggaagtgatgcagcttatataagggagaaacgtgatgtaactggcctcctacttctctgagagagtgactatttactaatccttaatttgaaagatcaagaaatgagttacattgtatttattcaatgtgtaaaagctgaaataatatatacatacacgtcaagtgcagagggcatgcatatgcctactagctgttgagattatgggcatataatgatttaatttattccataaataaatcatgacattacagatgaaaactagcatgaacgcatcattagatctacacatgtaaactacgtagaaaaacatgaacagaccaaatatgcgcaacatattgaacacgtaccgaggtgacgaaaaaaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccccctgccctgccctgccaggccaggcgagccgagcgcgcgtgtgtttcccctcttctctccaccacacatgcttcaagtggctaggagggcatcctcccttttaaggaggtccccctctcctagaataagcaaggtggtactaaactccacatgcatgccatcctatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatggactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttagagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcaaccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcgacaagctaggatcataaggtgttggagaaggcttactatcaatgtagccaaagcgattcaagatcttctccacataatgagactgcaagagtgtaatcccattctcacctctaattagcttaatgtttaaaataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggtgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaagtacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaactttagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccataactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgtagaaaaacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccccctgccctgccctgccaggcgaggcgagcgagcgcgcgtgtgtttcccctcttctctccaccacacatgcttcaagtggctaggagggcatcctcccttttaaggaggtccccctctcctagaataagcaaggtggtactaaactccacatgcatgccatcctatgaggtgggcttttgtgattttccaaagaattaatcttcgagtgggctaaggcccattcattaattccaacactagctagtagtttgcgtcattgattctcaaaattttcatacaaatataccccctcctcctcacatcgatctcttcaaaatccttatattatgggatggatggagtagatagatactatgtagtaccagtgagcaatgatagttgtgatgtagacatgcatctgcatgccacagctaattacaccctcgtgttgatgtagtcacgtagatgtcagcgttaaatggatgttttgatgttttctgaagttgtagtatagtactccgtagtaggtctaacgttgcattcttaattaacactgcatacatatcacttaagatattcctagcttagctaccgtccacatacttgaggttcctagctagatgacaatactacgtgcaagccattgcaggagctgaatatcttgtagtacttgcgcatagttgcatggtccagaaaaacagatatccagtacatctctcgttttctcccattaattgcagagtactgggtatctgatcagttaatgaaatccgcaaactgctgaacaaccatctacctgtagatttcaattgaggatttggactaagataatatacaaatggtttttaggtacaaacttcagagaaactgcacttgcactggttttctatgaaattcaaccactcagttttgtcaccgaaccatttgaaatgggttatttggattattttcatataaggataaactaaatacttttagaaataaacttacttaacaaaataacaaatactatgctgagtgaagaagtatagtgctgtagaataagtagtttagaagcaatatcatagaaaaaaaagtttttcgagaaaacatttctttttagacgtggagtaaataatctaatatagtaattgaaaagcactctcttcgtttttttaatgaataacactgttcacttttaaacatatattttatcattcatctattaaaaaaattttatgtaaatgtataagatataaatcatgcttaaaatactttaagtgataaaacaactaacaacaaaataaattataattacgtaaatttttaaaaagatgaatggttaaacatgtgataaaaagttaacggtgtcatttattaaaaaacgaacgaaggtagtagatgcttttaatttacttctgaactcactaattgagttgatgggtgcaggggcgcacacgatcggcatcgcgcactgcaactcgttcagcaagcggctgtacaacttcaccgggaaaggcggccccggcgacgcggacccgtcgctggacgcggagtacgcggcgaacctgcggcggagcaagtgcgcggcgccgtcggacaacacgacgatcgtggagatggacccgggcagcttcctcaccttcgacctgggctactaccgcggcctcctcaggcgccgcggtctcttccagtccgacgccgccctcgtcaccgacgccgccgcggaggccaacatcgccagcgtggtgtccagcccgccggaggtgttcttccaggtgttcgcgaggtccatggcgaagctgggcatggtcggcgtcaagaccggctccgagggcgagatcaggaagcactgcgccctcgtcaacgacatccactactagtattatcactagctcatcgatcttcagctcctcggtgcttgataaaatttcagtagaaatatatatacatgtaacttaattcgatcgtcatcctgtttattctctctctctatgtaattttgtttccaaattgtaactgttttattttggagcaactgtaactatttctgtatgtgcccatgaatatatttcaattatagaaaataattcactttttagtcatagatatttaatgtttaggataatattcagattaattatcattaatattatattaaaataaattttaaaatgttttgatatatttacgattttacttttctactagacaaatttacgtatattgattttttaaactagaatttgagatcctactactagttaaagtttaaaaaattaactaagttttattattctaaagttaaattgctcccctctttctctctctctcttaatatctgacaccattacattttcaacgtactaatcattcatcttacttaaaataatataataaattgtcttattaaaattatataattattaattatcttgttatgaattgtacgtttaaacattgaagataatcttagcataacttatatattcttgtatttattttacataatttaaataataaaaagtaaaacgtatatttaaaattcgacgccatacaatactgaaaatcaaaggagtatttatgaccatataatcgtatttgcacgtggtcctccttgtcggcggctcggtggctgtcgccgtccacgcgctgccttctcgacagggcggtactccacccggtaggtaggcacccgtacggagctcggctaatccagctgaccattcaataattttagatatttaaatataaacttttgtagtgaggctgtgatcagttgttttggcaaaaaaaaaaaatgtatacgacacatatttaaagtattaaacgtaaactataaacaaaacaaattacagattccgcctgtaaactgcgagacaaatatattaagcctaattaatatgttattactaaatgtttactgtagcaccacattattaaattatggtgtaattaggctcaaaagatttgtctcgcaatttgcatgcaaactgtgcaattggtttttttttgtccacatttaatgttacatgcatgtgtccaaacatttgatgtgacggaaaagttggaagtttgaaggaactaaacacagcctgattctctgaaactaataacagctttcaaatggtctcctaaattcaactttaaccattacttcttaaaccaactaaaaatataatattgtgcaattattttgtaagaaaaaattgtggctttcatgcatccaatttaagcaatttactatattatggtagctaacgtttaaagtttttatcagataaacaaaacaccatatttcactttgggccacattttatcacctatatttcgctttggatcacatttcaactaatgttttattttggatcaagtaattttacctccatgatgtttggaccatcctgataacttttttatccaactatatccaatttattatataaaaatagattaaaggatgatccaaagcacatatcaatagtaaaatgtgaagcaaagtgaaatttactcaaaacgaaagttcactctgtgaagtgtcaaattatcaaatccctcctcctattcgttgtgttgtaagaccagtttaaaacaattgatgaagtggagaattaccaaattccccctaatctctgtctccccctccctcacggcctcacctcttctccctccaaattctccatccccggatccccctctcctcctcctcctccgccgctcgtcggagccggaggcgcggcggccttctcccgcgcccttcgtctcctcacacccgcggcggccggcgagaaggcccagaggcaaaggcgtgaagcggcctcctcccccggcgcggcaccctcggacgcacggcggccggtgagcaggagcaggttcggagggggcgacgcggccgggctccttccaccggccagcatcctggctcgagtcgaattttgaaggtattgattactctcgtagcctccctccctccacctctccgcgatttcatgagccagtgtagattggggttgcagatcccctggagtttgacctccaaatccaccggggtggatttcagctgatgatttctatggatggcggattaagcaagtcactttgttccccatctactcggggtggccacatcatttcaatcctatactgctttgcgacatgtcaatctgtatcttattagctttcctgggctatcagtagttgacaaccagaacttgattggagaagaaacatcttgtgtgaaatacatatgacactgggaacatcatcatatgatagttatgtattacttacttttcagaaacttggggcaccagtatttaccgcaattgattgaatactagtactcccgacggcaaatataaggaaagggtgggagtatattattagcagatcaacagcgaaaattataaaatacggcacaagcattatgccataacttaaattattcattgtcttgtcagttatgaatgtatagctcattatgtgtgggattagggaagaagagggtgacatgggcaaatggctacatctaacgcctaaaaaagaagtaatggtccagatttgcgtaggtggatttggaaccaactctaggggatctgcacctgtagattggagatccatccggactttgctggagaaaattttagagttgagcaccctttaggtctgcacctgtttctagatgttcaattcattggaaattgatgacccaactgatgggcaaacacatttgtgaattgaaaaaaagattgcatgagtactgattaggagctatgttaaaactcagcaatacagtctgaattaaggttgtttgtgtgatcattcggacacaaatgatgtgcatgatgccatgacaacctgttccttctgcaatctaatttccttctaggactagataactaaagccatagtttccatgtgaaactgttatttattgtataatgctaaatggtaagattttcgtattgataggaagcatgaaggttgatgatggtcctggcgtcaatggcagtaggtgggccaaaatgatgagcacagattcgtggaggtggtgtttaggattgatttacattgttgctgttgcgagtatatggattgctgcaagctacattgttcagtctgttgtggatgagggtgtttctccattcttgattacctacatatgcaattctctatttgttatttacatcccaatagttgaggctgcacgatactttgaggattctatcaacaacttttggacaaagttgaaaggcaaggatgttgcggacctggagcagtctgctgatctggagagcataaatcttctccatggaagtgaacaagagggcaatacagcctcaccaacaaggttgcctgaagacatattggcttcagaagcagtcttccctgtccaggccgagctgaatgtagcagatggcagcaaagggttggatgcaaaagggcgctggacacgtgctcgtgtggctagagtcagcatggtagtctgccctttctggtttctcgctcagcttacattcaacctgtctctaagatacaccactgttacagtaagtgttactaaggcctgcatttccatgccattatttaacctcgctcctgtccattggtaacatgtccttgtttctttgtacctgcagtcaaatacgatattgagcagcacgtctagcctcttcactttcttggttgcactagtatttcttggagaaacattcacgtggttgaaactaatcagtgtacttctctgcatgggaggaacgataattgttagcctagctgattcaggtagtacagcgaataccattgccacaaatcctctacttggagatgtcctttctattgtttcagctggattgtatgctgtgtatatcaccttgatacggaaaaagctgcctgatgagaaagaaggtcaaggcgaagtgagcatggctcagtttcttggattccttggactgtttaacatgttatttttctttccttttgcattgttcttgaatttcaccaagctggagccattccacaggctgacatgggagcaagttggtcttattgttggaaaaggtaggtttgcagtttacgcatgaccataatgtgagctataataatgcattgtgtttgtgtgtgtaaacctttgcgttgttttaaatataacattgtaggaagtcataacggaataacttcgtaaaagatcataaaagctcaaactatccatggactagcactaacatcaagctgttgtgttctttacaggtttgttagataatgttttgagtgactacttgtgggcaaaagcaatccttctcacaacaacaacagtagccacggctggtctcacgatccaagttccaattgctgccattgtggatacactaacaggtcatgctcctcatctattggactacatcggagctgctgctgtgttggtcggttttgctggcatcaacatacctgtaggcactccacagggttctcagcaagagcaggaaactcctatcgtcagtatggttgatgatccagtccatttaccaagtgatagaaatgctactagcatggttgatgatccagtctatttaccaagtgatagaaatgctactggtgctgttcaataaggaccggcttggctttggagtttgtcacaatgtatatttttttcgaggaaaattttcataatgtatattatcaagtaatgtataaggatgcgagatcagtacagttactgtaattgttcccccttgccatgaaaatcatagagaaggggatagacagggattgaaattagattaacatgctttccttgctcataattttgagcaactagccagttgtgttcgtttttgagttaagcatgattatgaaaacattcaagagattgaatagaacatgtgtgtactaaacattcaaaccactcgtgttcttttttcttttttttgtcgggagcttagatcacactcactttcaagagattgaataaaacatgtaccttttgagtcgggttctatctattattttgagtcgttccgcccatagggtggtgtcgtagatgcaccttggtaaatgcgatcatcttctagcaatgagccaatgagaagttgagaacgctaaccaagaagccacttgaattaggaggcaatgctaataatcctgatggtgaggagtgatgctttaggaaaacaagggaaacaaagcaacaagcattatgcttgtctttttcgcaatccctctcgctgatactcccttccaaatatccctcgctgacgggtgattctttttagtgaaacacttgcattgtgctagttctagattaaaaaaaaaaaaggttagaataactttcgctggctgtcgtccgctgccgcgccatcgtcttcccccccccccccccccatctcgtgcagccgtccgtcgccttgaagccaccggcgtcgcctcgtcggcgcgctacatgatcgagcacgcctcggcgtcggaggctgcgccgaagctttcgttgccgccgccgccgtagaggtcgtcgttgccgccgatgtcgccgccattggtcccgatgctgctgctgccgtcgagtccgccgccgccattggcgctgtgcccgccaccgccgttggcgccatagtgatggtgatgatggtgtacggtgacgtcgggtcgaccgtctccagccggcggcggacgcggacgatacagaggaagcggcggcggtggcttcttcttcttcttcaagctcttccagcactggctccggtagatgtaggcgccaccgcacgccgagaagagagacgcgatcatcgtaacgaacacttgaacccatgaccatgacttgcagttgcagacgaacacgcgacgctcatccccgccggaatggccgtcgccgccagaaccatcattgccgccgccgccgccgccagtgcatgcagggaagccagcatagcaggggagcgcgggtggagagaagtacgaaacgtctggtggagagtagaaaatgggtggaggtggcggcggcggtgagagaggtggtgggcagaagatcgcagggggagggggagcaccggagatgatataatccatctgagctacgcggtggagaggatgaagctagggcgacagagtcgcggagagagagagacagagcgcacgccggcgaagaagaagatgggagggttttgtagtcttcctccctctgctcacggtgggccaaaaaaaacccagcaaaacagggtttccttcccagaatgtgtaggttcctccctctgctcatgatgggtcaaaaaaaaccaggttttcctcttctcatagtgggtcaaaaacctagcaaaacaggttttccttcccagaatgagtaggttcctccctctgctcatggtgtcttggtgtgtccaaaacccagcagaacaggttttccttcccagattagaatgggtaggttgggctaaaattgacccacctagctctgctgcctctgcatccccaggccagcctctccaggctccactattctcttgttttgggcctgttctttcttttcttttctttttttttcaaatgcagcattaggccactggcttccatactagtgctatatatggaggggggagggaggtatatatggatggttgaatgtgacacctcttggagcatctcaactgtttattccgatcatcgagccaaaaggccagtacaggccaaggtttagatcagctgaaagagacgcttcagatcagttgaaagagacagggtctttctgatagaaaaatatatgatgacgtgccatgagcctcttaatatcttgtactagtggctaatcaaatatggttagatttggaagtggcctgcatggtagtggcacaccgggctctcctagtacttctctcggcaagagtgacattgacgctggcactacaaactcatccgctgactgctggatcatcatatgttgaccatcatcattatttctatatagcaaatcttttcgcaataccattatataattttttttcgacatgaaactatattacatcttcacatgatgaatgctgtatagtaatacatacgttattcgttataaaatgttttcttattattatctaaaaaaaggttttcttattgaaacataagcttattgctaacaatacagtaatagtattagaagtactactaccgcgtttgaacaaaatatcaaattactcctctaaactattgtgacaatttaccaactgaacggttacaccaggctacccaaactcgttaatccaaataaattatcctttgaacactcttttaggcggttttggcatgagatgacacacatggtgcaaccggcactcttatcagtataataataataataataataataataataataataataataataataataataataataataataatcacacatgatcccccaagaatcctaataataataataataataataataataataataataataataataataataataataataataataataataataataataataataatagaacccacatgtcagatctctccgccttctctatttctctatttctactcaacaacaggatagacgagggaactcagcaacggttgaaggtagattggagctcaggcaatgcgatcaacggtgacaacggtctttgaagcaaatcccttctaaagcactcacctcaatgctgaccaagtgaccgtcccccgctggctgacgaatctcgcgtagagcctcctctccaccccgttgtcaccttctccctcgcagcaaaactagatgccaggaccgacgaggaggcccgcatcctactacctcccatctctggcttggcctcctcctctgctaaggtcacagcagtgctcgacgccatctttgggggatggcaccatgagggagagagaatagtaacggtattatttataaaagcgatccaataacaacgaaacaatatagttttcactatgttaggattcaacatgctttaatgtatgatatgacttgatggcttataaagtcttctggatcagcagcgaagaacaaccaaactttcgaaacaatgacgtctaca

SEQ ID NO: 73 - DNA, 27190 bp, Oryza sativa
  unsure (1)..(27190): unsure at all n locations
agcggngngnnnttttgattgctttgatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgttgccgttggtgagaaggctgtctttcgaagagttcgaaatttcgtcggtggagttgcccttaatggcggtgacgtcgaatacagtgcttgatccgctgggcgggaagtcgcggggcgactcggctagcattggcgcgattgcgaccgacgacgggccatcaagggagccggcctggacagttcaagaggtgctggtaactgaagatgggcttgcagctgaggatgggcctacggatggagatgggcctgcagacggagatgggctgtcagctatcgtgctcccggcaactgaagatgggctcctggccactccagcgcgactgaccaggcccgttggcctgacggagtttccgttagtttacagccgccgcaggtgtccagcccaagcggtggccgttgaccagggcgctctggcagctgtcggtcgtcgggcacgcgaagagcgtgcgactgatgagaacgaggcaccaccggaggttcaagccagaatctcggccttcatttcgtcgatctccaccacaccgcctccatccatcctaggggggccgccggcctctgtcccagtcactaggactcgacgccgtgcaactatcctagaaggattcacgccatggcgaagcccgcggttggctctgcaggggaatgggacacggcggcacacgatctccaaagcccagaaggtgactatgaagaagttgggaattattgaggaggaagaagaggcaaaccaggaagcggttcaggaattcgagaagctctttgatgaaccgctgcctccgcatcatgtccaggccattgcagaactgttgcaaatcgacatggccgcaccccttcaacctctgcctgaagttcttccgggggtggaggtcgcgtctccggcctgattgctttgtttcccttttcagctaatctgaagtgtgtccagttccctatgttaggttttagtttcctagtgtggaatgtaaggggtcttaataaccctgctaagcgtgcgttggtgaaagagtctgtaatctcctctagttcctctgtcgtttgttttcaggagtccaagttgtccgctgtcaaccagtcgctaatttatgaactttgtggtctggattttgatgggttcgtgtttttgcccgctgaggagactagagggggagtaataattgcctggaagagtgctctgttccgaggggatgtggttcatattggcacttggtctgttactgttaatttgtgctggttggctgctaacagatcatggtccttaacttcagtttatgggccacaaggtgatgaagaaaagcttttgtttctggaagaattgtcagtgatccgggagatttgtttgggggagtggttaattgcgggcaatttcaaccttatcgctgcagcagaagacaagaacaactcgaggattaatagacgactgttgaatgccttccgaagcaagattaatgatttagaattgaaggaaatgtacatgtttggcagacgctatacctggagcagcgaacaagccagaccaactttggtgaagctggacagaattcttgtgacaacctcctgggaagatctctttcctgaggcgcatctgcaggctttgagctcctcaaactctgaccattgccctcttttgctgacatgtggtgagttcaaacctatctctaggaggtttcggtttgagacgttttggacaaaattagatggattcatggaagtggtgaaagaatcttgggagcgcagtgtggatagcaccgaccccttttgcattctgtatgtcaagatggcgcggttgagtaagatcttgtctaagtggggtcagaagaaaatgagtaatttcaggctacaacttcagattgcgaatgaaatcattctccgttttgatgtggcacaggaaattagaattctatctgacttggagcggcagctgcgagctgcgctcaaagggcgctgtttggctcttgcatcacttgaaagaattaggattcggcagcgtgccagggtcagaaaccttcgagagggagacgccagcactgcttacttcttcatgaaaatgaaatcacaccaaaggaaattgaagatactctggctggagcatgatggcgtcattgccaccacgcaggaggatatggaacagatggcgaagacccatttcgaatatgtgatgggggcctcacagggtgatttaaaacaaatccttttccaagaaattcatttggctagggcaaacttatctgagctggatgatgccttcacggaggaagaggtctgggctacaatcaaggccatgcagaatgagaaatcccctggtcctgacggcttcactggcctcttctatcagagatgctgggatgtaataaaaaaagaagtcctagaagctcttcataaattttgcacaggcaactcacaaaatcttgaactcttgaatacggccatcattacccttctcccgaagaaagatgcaccgacacttttgaaggatttcagaccaataagtcttattcacagctttgctaagctcgcaacaaagattttggccctcaggcttgcccctcgcatggatgagctggtggctcactcccagtctgcctttatcagaggccgttccatccatgagaatttcatttttgtgaaggggttggccacacaattccatcgaaatcacaaggcgatgcttcttttcacacttgacatctcgaaggcctttgattcagtgtcttggagctttctgctgaatatgctgcgttttagggggtttgggccgaaatggagaagctgggtggctgcccttttcttgacagctgaaactagggttgatctgaatggcgccctgggtgaatccttcaagccgcagaaaggtttacggcaaggagaccctctctctcctctcctctttgttttggtaatggacacaatgcactcaatgctctagcaaactaccaccattggcctcatcgacaaagtaaacttgaggaaccgagctccaaacatatcgatctatgctgacgacgctattatctttcttaagccgctggttcatgaggtggaagcggtaaaagctctgctgaatctgtttgggactgctactgggcttcacatcaatttctccaagagtgccgttacccccataagatgtgctgagtctcagaagacattggcgcagaacactctagcctgcagattggaagatttcccaattacttacctcgggctacctctctcgatcaggaagcctaccaaagcggaggttcaacccactcttgacaagatggctaagaaggttgcaggttggaaacccaaattactctcacctgacggtagactatgcctgatcaaatcagtgttgatggccattccggtccatttcctctctgttctacagctgcctaggtgggcgatcaaagaaatggaaaggcgccgtcgcgtattcttgtggaaggggcaggaagagattaatggagggcactgtcttgttgcttggagggatctgtgccggccaatttcaaatggcggccttggaattaaagacatcgatctttttgggaaagcattaaggatgaaatgggatttcaaaagactggagcacaaagataggccatggacaatggctggttgggggacggacagagatcttcaagacatcatcagctcaactgcagtccatatgctaggcgatggatgtgacacgaacttttggaggggaaattggcttcctggcgacgggagcatcgctagcagatggcccatcctattttcttttgtgggcagagctaatctaacaataagtcaggggttatccaataatacttgggttaggagactgcagggctccttgtcaggaagggcgttgctcgattatctagccctatgggatgaactgcagctggttcagctgcagcaaggggtggaggattctatcctttggaagttctcaaccaatgggcaattctccgttgcatcggcctatgagtttttcttccttacggcagtacgctgcccttatggggagatgatttggaaggctagggcaccagctcgggtgagattctttatgtggttgatggtgaaaagtcgctgcctcacagcggacaaccttgctaagcgcggatggccacatgatcctgcttgcccctgtgtttgacagagctagaagactgtgatcatctcctctccaaatgttccttcaccattagagtctggtctttgctgaggtcttagctcaacgtgagttttccacccccaggacgtcaaaatctatctctgccagaatggtggcagctagcgcggtgcagttttcagacgcgctacaggcgtgcttttgacaccctgttcctgctggtaagctggttaatatggaaagaacacaatgctagagtctttgatcaaaagagcaaaacagcagagcatctagtggcagacatcaaagaggaagtagcagtttggagaactgcggtggtatttgaaagttgtgaggagtagccctagcattaccgcagtttttctttctttgcttcccctccccactcctgtttccaggggtcttaacctctggaccgacagtataatgtcgtgtaaaatatgtacttattccccctttcaatcttaatgaaatttggtcggctccttcgccgacccggcaaaagatcagtggcgaagtacattgtcggaaatggcgaaaacactgatttttggacagcaaactggactgggcacggctgctttgcttggcgatggccaacgctgttttcttatgtggggcgtgctagactttcagttgctaaaccttgtgcaacaacaaatgggtccgtggtctgcagggtgcactatccaatgaagcaatgggcgaattttttcagttatgggatgaggtccacgatttctccctgctcccatcgcctgacgagatcagatggaagctgacgggcgacgggaaattctcggcggcgtcggcttatgatgttttcttcatagctgctgaggactgcccctatggcgagctactgtggagatccagggccccctcgcgtgtgcgtttcttcatgtggcttgcgttgaaggatcgatgtctcaccgccgacaatcttgcgaagcgaaattggccgcacgaccccctctgctcgctgtgtcagagagaagacgaggattgccaccacttgtttgtaacctgtccttttacggcggaggtatggcgaaagatcagaagatggtgcaatgcaaactttgcaatcccggcagacggtgacagcagacttgctgactggtggcttgcaacgcgacgccgttttcggacgagctacaaagtggacttcgacagtgccttcatgttaatttgctggcttatttggaaggaacgaaatgctagaatttttcagcatgtgtcgatgaccacggagcaagtagccgagaatataaaagaagaaatcgcggtgtggagggtagctgggatcttctcccaattcggcgagtaatcgttgttgtattgtctctttctctttcgcttgttcacgctgtttgtaatgtcgctgtaatattcctttgtttttctccccaatcttaagaaattggtcagccaatctttggctgacccggcaaaaaaaaccatggatagatcatgtaattacaaagagattactatgttcacattaacaaagaaatcacagatacaactgataattgtgaaatttatatttttgacagaaacgacggtgggcttacgccagcctgaacctttatattaatatattcgtaagcaatattacaatgtgattgaaaaagagttacagggggacaggaggaggaaacggaattaggaactggaaaaagctaagaacctacggccctattcaaccaaggcttgatggaccatcgttttgcagctccagtccagtgcagcacatcatccacgcagcaccaggcggtttgactggtttgttcgtcgacattgtttaagaccttgttgttgcgacatttccaaatgttccaagggatgcacaccaaaatcgttcaagggatcgaaggagggctggcagggagtgcaggaaggattgtcgttcagagatgctccaaggcagggaggtaggcaagagacacatcaaagccaagaaaggaccatagcgctctgactttagagcatcgaagaaacaggtgttctacacttccacgctctccggtacagggcagaaaagggtatcgaggataggcgacggtccctcttttgtgtcatcattcattggtgtagtgccgctgacgtttggtaggagcagaattcacccagacagcaggcgccaaataaattactatgttcacattgacaaataaatcagaggtacaactagtaattgaaagaggtttaaccgttttcagggatgattagaccatctgataattaccttttggatagggaatgttaaagttgtcctgaaaacaaagcaactatgtaatgttaatactaccaaacaactggaatggttttcttaataaaaattttaatgtgatgattcgttgcagattattagaaagagttaaaatgtgacattcgcacaaacgtagatactgcatttctcacattatgaaattaaactgaagtaactattgggtttctttatttgaataaaagtcatgtgggttgctttttggggggtagctataaggtttctgccaatatataatttgagagatgcatgaacataacaagatatgtatcaaagcaagacaggttgcattgaaagaggatccgaaattctgaataacctgatgttgatgtatcagcatcattgccgtcaggggcatcatcaacgttaggaaatattgcatcaatatcaggacagacatcaacaaaaggaaatactgcattaatagcagcaacatcaatactattactggcagcctctttatcttcagtcatgcatgttagtaactggtcctgttaagattatagtatagactcagtactcagtaaagggagatcagatgtataactatacataaacaagaatctctagacttaacataccgatatgaaacacattgcgagcggtgagatggctacacgataatccataagagagatttcaagaaaataacgccacaggtctcggatttcagcacaagcctcattgaactgcaacataacaaagatggctgtcagtatgagtgaatttaacaaaacaatgttgaaacaaggccatgcaaaacagaagattctcaaacctcagagcttgaaatatctgtggggacattattcagctttagcttaatcttctcaaggataaaaactccatttctgcatttttcctctcgtatttgagaaaatggcttttcttcaatattatcagctgctcgaagaaacaagtacttgaaaatatcatccatccttttgaaatgtaagacataattctcctctgaatcttgacagattgttgcattgtccgagaaatgatcaccctgatatgtatcagagatcgattctggatcaaaaacttgccgcaggttcgtccagaaacccccttcgggatgcttgctgcgcatgtgttgcaagagcgaatcaatgtctgggatcttcttgccaacacaatagggacaaatccagaacctccatgacttgtttttcttgacaaagttgagtgcatcagatatggtctttgcagcttcatggtcatcttgatagaaagtaacaaagtgtaggtgcaaatacttgagtcccaccaatcgaaagctgtcctgcttctcgcttgccagtgagcaccagtaatctctacacaccaagacaagcttctgaagcaaacgtttgagctctgtgcggatataagatttcctatcctcaggcttctctccggggatagatccaggaggcacgtcctcctccctgggatcagtaggctcctccatacggattgcccggtcacactccacttccacagaacaatacttccccatgacaaaccagagcttcgcgcggaacatggcaatctcaagcgaattgctgaactcttcaaccaaattgttcaatgcgtcgaggatgctattcagaaacggcttcttgtcaatgtttgggtcgaggccgcgcgcgaaatccaagctgatctttgcgtgggtcaagtgcgcgcgcgccgagtagccgaatcgctcgacgagcgccttcttcgcttgcttcttcgccgtggccgcgccctcgcgcttggagatgtcgagcatgtcgacgacgacggcgggaatgatcttggcggacatgtgggacatgatatggtgagagtggaagagcgcggcctccctcgctttcgccaacctgtccatggtggtgctcagggtgcggtcgaggtcgaacgcgacgttgttctccgccgggtcggtgggggagaagatggctagggcacgcatgatctcgcgatccggctcgtagtccttggcgctggcgaccttcgccatggcgaagccggtggcgatctggacgcagttgggggcgagacgcttggcctgcgcgtagaggtcgcgcgcgtagacgaggtgcatcaccgaagcctggccgtcggagccgtcgcgggcggagcgggtgaaggcgttctggtggaggccggcggcgaggtggagcacgacggcggactccgggtgcttggccgcgagctcgtccgcgcgcgcgatcgcctcgtcgtggcggccctcgcgatccagccgcatcgcctccacggcctccttgcgcagggggctcgcctcgaggaggcaccgccgctcctcctcctcgcgcgccgcctcggcctccttccgctgtttccctctgcccctgcccatctcccccccggtgcgagatcaagcgacgcgacgcgacgcgagcgagcgaggtgttggtgtgagacgccgcggcgacgcaggagatggaggcggcgacgcgcgcgcgcgcgaggtgttcgtcggaatgccgcaactgcgacggggactcgaagggtttggtggtggaaaaggcggcgcgggtgaaagctgaggggtgaggggctcttccgatttaaagagttcgaatgctgcgggagcgaatagctagggccagtttgttgaggtttctatctggactggacgaggtgataagcacggagaagttgttatacagtagcctcttttatctttatctctactacttaaattccatcgtccgtaaaaaaaacggacgaaaaaaactaaatttatccaataaaaaaaccgggcgaaaaaaagtacgaaaaaaaaccaaatatgtccgatccagaaaaaaaaggcgaaaaaaaccagcgaaaaaaaaaccaaaattatccgatccaaaaaaaatagggcgttgctcccctcaaaatgcttccttgctctgtgtactttgttcaacaggatcaagggaaacaactctccacttatttttccagtgtccttttagcactcaatgttgggcgtaatttagtgtggtttggaatctttctttaagctttggtgaaatgttggtcacggccagaaattcatataactctacccattttgttgagaaggtgctttatgctgcttggaacatttggaagcagaggaatagtttaatttttgaaaacattgttccctcttggagagttctctttaggaatgatctctcccttttagttcatagagtcaaaaattctgagagaaatacattgttacagtggttaaatttattgtaattttttcccctttattaatataaaatcttaacggtggaggcttcccctaccgtggttctttcaaaaaaaacagggcgaaagagaacgtgcgaaaaaaaagaaaaaccaaatctgcaaatctgtcctatctagaaaaaaggggcgaaaaaagaccgggccaaaaaaccaaaatagtccgatccaaaaaaaacgggcagaagaaaacgtgcgaaaaaagaaaagaaaaaccaaatctgatgcggtaaaagaaaaatcaggggaaaaatgaatttgtctgattccccaacaataattgtctggtcaaaaaaaccgggcgaaagaaaaaaaaagcgaaaaaaattaaaaaaaaagtccgacttctatccgattccctctcttatacgaaaaaaaagttcaactatagatccgattcccccttaaaaacgaaaaataaaaggcaccactccttttgagtccgatataccagccaccactcctctcagtttcaatctataccatgatatctcacacatcttagtgaaacaaaatgatgtgctggattaaagatctgtttaaaaccacttcaattgaagacaggggggtaatttgaatggttttgaaagttaagggggatagatatctgattttgaagtgaaggggtgtattttagacgaacgcaatagttcaggggggtcaaatagacttatccctttagaatttatatatatgagtttaaaaaacaaatcttcattattagaaaacacgaaggagaaatacaaggtgtaatgagggccccgaatttaatccttttcattttattattttcatatcgacattttagtgatagatcacacttcagctccaagcgaactacagttcttataattcaacgacaggaactttgctttctttttgtttcttttttcttttcttttctttttgccggattagccaaagaaagattgaccaaattttattaagagtggaggtatgtacaaaactttgctttcttataacttaccaagaatatatgaggacaacttataaagtaaggatcaataaccaatcaagcaaatagtcaaagaagcaatagcattttattataattcttcaacaatccaaaaagttagtaaaataatacttcaaagcaatagttggctagttgcaagaattctaacctatttacatttcattacattggtagctaaactcttcataacttaccaagaatatatgaggacaacttataaagtaaggatcaataaccaatcaagcaaatagtcaaagaagcaatagcattttattataattcttcaacaatccaaaaagttagtaaaataatacttcaaagcaatagttggctagttgcaagaattctaacctatttacatttcattacgttggtagctaaactcttctatgctttaaaaatgtgggatgataaaaaaagaacttagcagctgttattgatagagagggaaaatggtgagagaacccacgcacgagacatgcctcgaacaaaggctggtctaaaccctggtagcgttcttaccactaagctagcctacgttcgagtcatgtctcatacgtgagttttttttagacttacaccattttcctctgctaagttcctttgatcatcccacaatttttcatttgaaagaaaaaaaactcttcaatgctttcaacgcaaacatgcagactcaatgacttaagtactaaccacatttttatttcatatcattattccaccaaagcaaaaacaaatccagagataatcctctctagtctctacggtatctgtaacaatataccactcgatttcatttaactttacactgcacaaataaaagaacacgtcactgcagaagcagaaagcttcagatagctagcatggcgtagccgatgtatgctcccagcgacgtgacgacgacgccggccaccaccggagcagcggcggcggcgccactccggtcgttggctgcgggcgccgccggcgtcgtcgcgttcgccccatcggtccccggcggcggcggcggctgggccacgcctccaggggtagttgacggcgacggtgccatggccgctggcgccggtggcgagctcggtgttgacgtcgtcggagcaggcgccggcgccataggtgaaaccgacggcgatgggctcggcgtcgtagctaccggagacggcgccaagctcggggtggcggcggctggcgcaagcgacggtggcgacgacgccgggctcggcatcggcaccggcgcgacgggaggaggcacaacccgcggcgactgcngatgcncgtggcggcccgcccggtctgccatgacgacgacgacgagcttttcgccggcgcggcagttggcctcgttgccgctgatgaagaagaagggccccgacctgtcgaacgtgaacaccgtgttgcagtcgtggtaccttccgcagcggccgccggccaccgacgacgacgtgttgcacgcgtcgtacgccccctgatccaccaccaccaccgcgtccatctccttcgggtacacgaacactgcaccaaccaaaaaaaaaaaagaaagaaaccgtgagatcatcaccacgcttgcacggccggcgaaatcctcgccggcgatcatctcggcggcggcgcggcgacttacgcagctggtcgccgatctggaacctcatcctgccggcccacgagttgtacggctcggcgttggcgtcggggacgctccagcctctgcctcctccgactctgaactgcgtcgcgctcgccgctgcggccatgagacccaaccacgcgagccccacactgacagttgccactgctcccgccattttttcttgcacacttgatagttgataccaccacgactagtgatcgatttcactgcagtgctgtgcctgatctgatcgatcagacaaagctgggttgctgggtatttgtagtggtgatacagaaattcagaattaatgaattggagacttggtaataataagcctagtcagaggctttgtctgaatgcaatggacgtgtcactttacaaggagttagcacttgccacaggttgtcactttgattattactaattgggtatttcattggcataatatgtgttgtacaggtgatggtctgacagagtgacaagtgctcatgaaaattcacagtttaatgcttcgatttggatacgtatccaacgtcattttcagatgagggatgactcgagaagtcgagatgttaacccacacacatggcgaggcttgaggcgacgacaccatgcgttggtcggcagtagtagaaggattcagaaaagaattctctgcataggcggcgagcagctaatcttatctatgcacagagagagattcagagaagaatttgagttcatcttgtagttcagaaaggacaatcattcatgtcatagaaaaatttcagaagcctcctggatcgaatatagtaggtgtgttggaacattgtgagaggaatctctgaacaaacagcagtagtaacattcagtaaaaaaaaaaattctgagaatttgatttggtaggggctcttgcgtcctcctagaatgctcaaagatgctgtaaaaagtttcaggattggtcaagaaggcagggagcatggagccaccaaatatgacaatttttttcaggaatagacaaaagacttgcgcatccacaaaatctgacaatgtcttcagagaataattgttcagactaggtggaacatttttgtttattcaccattttcaggtccggtcaacttttcaaacttcagaaatagccaaaactcaaaaaaagcagtacaatgcatagtttgttcagtcatggacacattacacatgtccctaatctagacgcttagcatccatcacaacgctcatacgattatttcaggcgattttattctcctcctgatcgaacagcacgaagaaaacacacaccagaaaactatatgaactgtcattcaaactaggcgactcggaggccgccacgcaactcgctgaaatcaccgcacgctgtcacaaacgaggaggaccttgacctcgacaagaaggagctcgcggatgatgctcttgctgccttcttcctcctcgggttcttggggcctctcgggatgtcatggcagcaggaggcggcctcctggccggatttgtctgtgcagacttctgttgggagcgtggctcttggtggtttgtcaaaatctgcagcaattcaaagacaaaacataatgaaatgagaggaggtagggtgacatgatttgttaaagaatggtatgattcaccagaaagactgttaggccttctcggggatatgggaattctacatgaattttatgaaaatcagttcaattctgtcgagaatcgcaaagagaactcctgaggacttaacctttctcatgacttctgaaattctgtttgctaaacgggttgggcaaaagcagattgtgcagggtttacatcataacccactaaaatcatgatgaaactctttcaagagaagaaaaaaagcatgaattcagtcatccaactcagtcaagagatcggagctgcatcagtggacgaactgtagagaggcacgccacctcactcaccgacgtttggtcccctgacaacacaagatttcccacgaaagatccgacatatcactcctccagagttagtcagcaaggggcgacgctgcaagtctgaacatcgcattccaccaggatggggacagacaatggcaaaaaagggtgcaagtgctgatatgacaatcaagtctaccttgacaccaaactaggctgaagtttccaaaaccagaattaatggagaagagcagacagagcaatggtatggtatgccactactgtagaacagaaggttcaagcttgtactggagtatgtagattctgaatcaactagctagacacaagtacatgactagttatgctttcttgcatgagcaaaggtttcagacatcattagcgtcccgtcccgactgaaaacttcatgaagagcaaacactgaaaaaggagcgcataagtggacagaaggaagagatcgagggagatacttgccttgagatgcccaggatgtcttccttgactgtgcaaaggagcccatggagcctgctgacaactcttccaatcctctgaattcactcatctagtaaaattgccataaaaaatcacaaccagagaataggaaaatgtatagatcattgcaaagaagattacttggagaaaccttccagctatgagatatgagatccttacccagcttgggcatgaatcactagtgcccacgcctatgtgagacacatgcctgacgtctgtagggcacccgatttccatctcttgttgcttctgcagtgctggataaccgaaagggagcaatggtcatactggtatataaccaatggtatagaaactgtgcattgctattgtggttcagctaattcatcaaaaactgaaaatagaggtagatgcagcaaagataaacaatctgcttcgcttaccgaatatttgagagattatcttcaaacctttgaatatccccttcatctttatctccattggtgaggtgcctcagtactccaaacaaagaaagaacataagtgtcctgaaggaaatactcacgaactagtgtattactttgccatgcacatatctaagcatcagttaatcttcagaatgtggggtagcagagttcatgcatggagaccaagatcatacactgcatgaatttgtgtatgactgctgatcagaatagggagtcacttccaaggtgaatggctttattgactgtgaactagaacttgtcagcaggcagccatttttgcccctacactggtttgcagttttctcctatcgcagaagcaaccagccctgcttcctaattattggacacactacacaccagaaagagggatgagaaggaacagaatgggctgagagagtgtgagaataagagtaagctcaagactacttaaataaaggtgacaactaacaagttagctggcttttcctattccaaaagtctgctgtcatctcatttgggccatttcataagacaggtgtatatttgataacatgtgatgttttagctgttcttgatcttaatgttcaaggattactttatcgtgagcttaaatatgccatttctccctaaacattttcttgctagcgcttaatttctgcatgatctgctccagatagttgcatattaccaatgcaaaagatttgttgcatagtcactctcacatgctgctgtctttgacaagttaccataagtattctgggccagtctccaccaaatagaatggaacgaaatgttggatctatgtgatacacattttacatgcacaatagcttgatctacctgaattcctttgtgccctccagtaacatcctaaatttactcaaaatcatccaagcaagctacttgcatgagtatggactgaagaagaaaatgaagtgccggagcaagtgcacctgcctagttttcacttggcatgaaaagagaatacagccttgcttgaggtagattagatccttaaaagctgagttttgctcaaatctgtcctctattaatgcatggggtctgatggtcctatttccttttaatcatcaaacaaccaaatgtttggttataaagtatggtcttgaccttgaactgtaaaaattaaggtaataacctctatgtacttggccgtgcctaattattttgggtagaatacattggaatagagaatgttatagactcataatattgaagataaagcttgtagaaaaatgaatggcaatcattaacagttagatgaaaaataccactacctcgtcccaaaacggaccacattaaatttggaccaaagatattatctgaagcgtacacttagatataggaaaaccatataagcatttttcttaactaaaaatatttccatgctgctatcatactttatctttttatcaacttaaattaaattcagtggtcccgtagcaacctatgtttgacacctaagtgtagttgtgagcagacttaattcttttttctgtggatcataggttttgcttacctagtctggttcttactttcagttcaacatcagcaacaaattttttgggtgctagtacttctctgggctttgcctattaaatctgtactctttgagatattaaaggcgtaacagataggaaacctgcaaacactaagagttaagctggaatcgtccccagtgacaccatgcctgtactcttgttgcttactaaaaaagcagggtgtaaagccttttctctaaacaagatactaactaagaaaatagaacataaaacaatatagaacttcactgttgttatataaggacttcatggaactgcttgtcttcattagtaccttgccaggatttcaggcttcataagctgcaggtaccttgcaaatatagaagttgcatatccaaaacagatttcagaacatcattgttcctcatttgcatagtgatttggtctacgtcccttaatataatttcaaatcgaccaaaagggacacctgttatcataaaacaaaatggtccgttttatcatgaatatggaatagtcagtatataacatattgtattgatgaaagatacttttttttctcaaaaacgcaagagccatgcgtttcatttcattaaggagaagaaaaggtatgtacagcagagtgcttcacaaaggaacactctgaaaaaagaagagaaaaacacaaaaacatcgccgaggcgatgcgcaacaactcccgcaggagctaagctcctaggtggagagcgaccgggccaagagttcatgaagagctcttgccccagcagtacacaataataaactctcccttgccaaagcatccaatacggcagcagtactaggtgtggcattgttgaagatgcagtcattccggtgtttccaaatttcccaggccactaagataatcacagagttcagctctttcttagcttccttagagacacctctgaccacatgggaccaccaactagagaagattagtcatcacagcaaagctcttattctgcaatatatttttatattttcaaagtttcagaagagatatgcagtctcttgcaggctacatcagggtcgttgggatatggaagatgctccatttttatttgtgctgaaagatacacattgttaatacaggatattaacttgtaggctagtcaacagctatgctctttttgtggaactttatgcaaacaattgaaagatgcagtttcttgcaggctacaaacaaacaaacatagctaccaagttgaagatgatggcatccaaaagcaaaacaaacatctcatcttttgttttctttttttttcctgaagacgagatctaatctgaacgatcatgccttgcacctactatacccaaccactggcattgtttgcaatttaggatgtgggcaacatacttagacctatgatggattcctggaccaaatacttgcagatatggtccatgacagtcacaccacatctagctatctacatacatagtaacaaccactttactgatgtagaaactagaaagttaaaatacttgtcattaatcaccacactgtgattgacaacttgtcaagtgtactcgtagtggttggtatattaagatgctgcttaggtgagcactataatgaaggctgaagcaacagagtaaatgagtaatctcgcattagaatatgatactcttcaccaacttctcttcgctgtctttctgataccgtataactgaatattggtaagaaaaccgaagtgtggtaagcttggaggattcagaatgtacctgaagctcggctgtctctcaattcctcgcatagtatctgaactctgaagaggggaaataaattgtaaattaaccaaaaaaaactgcaattcaagacaatagaattggtgaattgtgactaatatgacatagttagtagtactcctaccaactaatagagtatcgctgacactgggttaaatcggttgccaagggcatgttcagacttcagagaattagcgcacacttggagcactgtatcactatctgcaggtggtgggataagggatatcgaggcctcttcggctgattacagcttgagcccgccgcaccgccgcgccccggaggtggccggcagcacgcggggacacggcggcgaccgtgggggcgggacggctagccggagcacggaggccatgcatggaaggaatacctaggtagacgtaggccatacgccggcgatccgatacggcgaggccgcgggaggggaaaccccgacgtgctccaggctcgccggagctccgccgcctcgccgccgaggggaggtataggagggggaggaaggcaacaagggtaataataaaattagaaatagtgcgagggttttcgcagaaaatgcagatctcttccgcgactcaatccggaccgtgcatgattaatccaacgtccggatctattgtactccgtatttaatgttgataaggcgatgaagcgatcctaaagttttacaaataagtggtctcatcttctcgcctatacttatacttaagcttatcagccaaaatttaaatttttaactttaaatttagagttgattttgaagttttctcatcgaagtttatttttcagcctttgcttttagatcgctaagaacacgtatataaaagttttattcacaaattatttttcgtttgcaaatatgttgtaaactcgggaccacatatttggatctaacatttcctaaaattttaggattcttttacataattgatagaaatcccgtctttatatttacagttggatattaatagccaaattttacaaaagcttcgaaacagctaaataaataagagaactagaagattataaaaagaaaagtttatagatactaagcttcaaacttctttgaagtcctatagctttatactcctacatgctctttcttatgtagcaacaaccctttatatcacaatttacacaaaaacttttgatattgaaatcaaactatggtcaatagtcatatgctgcttgttcactcctatcgcactaaatcggtagcgaaaattgtggcgctactattcctagtgaccttatgattttgcaggaaagttttgatttgtctcgctaccattggcggtaatcataattatttttagaaaaaaaatcatatttcagtcgctactaattatatcgattataataataatgtacaaattgatccatttttaattgcttcacaaccatctacatcggtgtccaacaaattcgtagaaccaccctcatctgcatctgcctctctcctccctcgccgtggctactttagtttcctatctgtcgaggtctaacattgttgctgacgagtgacgacaagcttaccattactacagccctctcaccttgagacaacgatccaagggtaacctcaagaaaccagctatctataggtggcaaaacggattaccccgcctgagcacgacgcgtgccccgatggcggcatggttaataggccgtgtcgtactgggccacgtggccttggtcgagaaggctacgggtcattatgtgcaaaccgctagaggtgcatgggttgttgccagcccatccatatatttaaccctataatttgaaatattaggctaggaaaaaagataaaagcagaaaaaagttaggaaaaacatagcgaaattaggagaaatgaggggaaataggagaaaatatggacgagattcgctaaaaacgaaaaagaaaggggccatgccatgccggcccaagcacggcacggctagatgggccgctccgtacctgggcctgcacgggaaggctcggcccatatggccatctatacagcggtccaaagtgtcttcatccgatcggcctctcttccctcgctgtgcctgcttcggtgcttcctctccccgtccaccggctgccggagccaatgcagacggccggctcgccgtcgccatggccctcacacctgacatagctgctaggaggcaaaccaagaggattaattttctaaccaatggaccagcgcaactgagagtctgaaacaaaaacaagatgcctgtccaatctcttgtttttgagcaatttttctatgcaaaagtaaatgatttgagaatgagtttatgtaaatatcgcacttatctgaatgatctacaatagtagagtacagggtcaggaagcagtacacttccaaagaattaagagatgttgagctagatttcaatagctatcttccaaagcaatagcacaagacatcctgtattcagatgtagcacgacaatcagacaagcagctgtgttcgagaaaccaaattcagaaaattactgaagcattgttcttccttttcctctgagtcacttgctcgctatctgaagactgaagaggaggcaaaagaagtgaagtgggataagcgcataactctgatgaaacaaaaagacctgtgactttgtgacattgttagtaggacattatgtcattaccttactgaagttacagggaagcttgttgcagtatagtaagactggagagttcattgcgttatatatatatatccttgaattcattatgctttttgtctgaacaagagaaatggccgtgaataagagcaaatatgaatgggattgttagttttcggctgaaagctcagagtgtgtaattcgttcaaaaaaaaaaagaagctcagagtgtgtctctagactgtagttctctacttatttccacaaccaaaagagctggctacaagaagcaatattgtcgaagaaatttttcatgtcatgtataaacattgtgtcaaagaatctgaatggacagacttctaaatatatactctctgatcatgactactagatcttggtattgaaacaaaataggtctactagatcaagatattgtttccgacaataatgatttgtggcaaagatcaaaagaattttgtccaaaaaaatatgtcaaaagaagaacgatctgtgcggtgtgccatttcaatactcacagtaatattccaatcgctggagactcttgccattgtctctgaacccaaataagttatgagagtaacatattctcaaaatacaaataatttgcgcaatgagattaagaaaaaaaaagacattggaggaactcgatggatacgcataggtacgggaactgaattcaatgttaggaaggaactaattctagaattttcatggaacgctcgttctagtcttctagattatcctagaacattcaattcataagaaagacttctgaaatcgaaagcagaaacatccacataattccagcttggaggctcataatagtcttgttcaatatgtatgcaccccgcaactaatggttcaattcaaccgagcctaacgaatgctgccacctgcctagtcatccaatgcacatattgttcttatcttgctcatcgttaagcatagttttaatcgccatttggccaaacattaactactattagtcctggaattagcttcaacttgcagtacaaagaagagattagttccaactaaaacacgtcacgagtggtttggcattagttgcagggtcgttttcaattgtatggccctattaaattacgacggagtcgtcggttgatcctacaagtcaatgatgaattgcgtgtttgtttacctgcaagtgtcatttaagcaattggttgctgacttaagagccaccgtaaaacatgctgtcctgatcagcttgggaaacaaaaaaataattctcagcaaacagctcctttcaccttacgcacgtagcacaattttactaacaaaatctagtagcattagcaggattagatgacaaacgacagcaacctgcaacctcatcagttacccacattccctaataaaccataatactccctccgtcccataatataagggattttgtgtttttgcttgcactctttgatcactcgtcttattcaaaaaattttgaaattattatttatttttttgtgacttgttttattatccaaagtactttaagcacaacttttcattttttatatttgcataatttttttgaataagatgagtgatcaaatagtacaagcaaaaactcaaaatcccttatattatgggacggagggagtataatacaaattgatttacaggtaaaacttttgtatatgtgtttttaatgagctattactccgtcccaagaaaaagacaaaccctagctatgaacctatgtccaggtttgtagctgggattaggtttttttgggacggaggaggtaaaagacaatgtttaaaaaaactacattgaaaatattttaaaattaagtttgaaaattcaaattttagctttgactttggtttattaaatcaaccgatggagcccttgagcaaatccaggttgtcaggttgacattctgattaaaatcatgtattgtttctctattttcgttcatgccattgattaaaatcatgtagtgttcagttactagttttttgttcatgctattcatctgattatctgaagataccttgcctagacactactgaactgaactgaacgcggcacgccaagtttcagactttcagtaccagtacatgagtacagaactagaaatcctttacttacaacgagaaaaactaacactacaagaaaccatctgattaaaaattttgatgcagttcagctgcaaatactgcaaagaatctctacaaacaaacagtcatctgaagatgagagataggaatctctctcaatctctctcttctctgcaatgcctgtctattgcaaagtcactgtgattctcaaacgaggaagacgacgacgagggaaaaccaaaaaccagcggataagaaggaaaaccgcctttgcgaaaaccacagcctctctccctcaggctcagcctcagcctctcgatttttctttgatttttttattaaagcaagaatggtccttggctcttgctggtactaccagcgtgtggccaaatcatgcagctttgatgatggaaaaaaggaaagaaaattcaggagagagagaaagagacgtggggtgtggttggaccgcaaggcacggcgccgtagccgttggcagatgcgcgtctccctccgtctccgttatcacgtcggcacgccgacgtcgctgcgcctgcgcgtgggaggccagggcagatgctacgtgccatcaggaatgtcgacctgatgattattttgttgatcatgattttcttttggctatttgattttttgaaagatatttttttccctgggaagacacctatgggacgaagatattatgtttcttatatagcaccaaacaaatttaatatatatatatatcacatcagtctctgcacaaagtgcatcctgggctgcttcaattataaagccccattcaccacatttgctagatagtcgaaaagcaccatcaatattgagcttcaggtatttttggttgtgttgtggttggattgattctaatatataccaaatcaatataattcactaccaaaatataccatagccatcacaactttattaattttggtagcttaagatggtatatataataaccaattaacaactgattctaattttactacggcccagtatgtaccaatacaaaacaacgagtatgttttcttccatcgtaatcgtacacagtacaaaaaaacctggccagcctttcttgggctggggctctctttcgaaaggtcacaaaacgtacacggcagtaacgccgcttcgctgcgtgttaacggccaccaaccccgccgtgagcaaacggcatcagctttccacctcctcgatatctccgcggcgccgtctggacccgccccctttccgttcctttctttccttctcgcgtttgcgtggtggggacggactccccaaaccgcctctccctctctcctttctttatttgtctatattctcactgggccccacccaccgcacccctgggcccactcacgagtccccccctccccacctataaataccccaccccctcctcgcctcttcctccgtcaatcgaaccccaaaatcgcagagaaaaaaaaatctcccctcgaagcgaagcgtcgaatcgccttctcaaggtatgcgattttctgatcctctccgttcctcgcgtttgatttgatttcccggcctgttcgtgattgtgagatgttgtggttagtctccgttttgcgatctgtggtagatttgaacaggtttagatggggttcgcgtggtatgctggatctgtgattatgagcgatgctgttcgtggtccaagtattgattggttcggatctagaagtagaactgtgctagggttgtgatttgttccgatctgttcaattagtaggatttagtctctgtttttctcgttgatccaagtagcagcttcaggtatattttgcttaggttgtttttgattcagtccctctagttgcatagattctactctgttcatgtttaatctaagggctgcgtcttgttgattagtgattacatagcatagctttcaggatattttacttgcttatgcctatcttatcaactgttgcacctgtaaattctagcctatgttaattaacctgccttatgtgctctcgggatagtgctagtagttattgaatcagtttgccgatggaattctagtagttcatagacctgcagattatttttgtgaactcgagcacggtgcgtctctctattttgttaggtcactgttggtgttgataggtacactgatgttattgtggtttaggtcgtgtatctaacatattggaataatttgattgactgatttctgctgtacttgcttggtattgttataatttcatgttcatagttgctgaccatgcttcggtaattgtgtgtgcagatgcagatctttgtgaagaccctcaccggcaagaccatcaccctcgaggttgagtcctcggacaccattgacaatgtcaaggccaagatccaggacaaggagggcatccccccggaccagcagcgtctcatctttgctggcaagcagcttgaggatggccgcaccctggccgactacaacatccagaaggagtccaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccggaccagcagcgtctcatcttcgccggcaagcagctggaggatggccgcaccctggctgactacaacatccagaaggagtccacccttcaccttgtgctcaggctcaggggtgggatgcagatcttcgtgaagaccctgactggcaagaccattacccttgaggttgagtcgtccgacactattgacaacgtgaaggcgaagatccaggacaaggagggcatccccccggaccagcagcgtctgatctttgctggtaagcagcttgaggatggccgcacccttgcggattacaacatccagaaggagtccacactccacctggtgctccgcctccgtggtggccagtaagtcctcagccatggagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctaccgcttgaaaaagtgctgctgccccg

SEQ ID NO: 74 - DNA, 1036 bp, Oryza sativa
  unsure (1)..(1036): unsure at all n locations
aaaaaattggttggggcaacattttttccaaaactactacttttataggtatcaatggcccttttgtttttgagggtaaccttaaaacccgttgggatgttattcagggatcagtgcatcagcctccaaatggtcctcagatcccaaaagaaaatggcaacccatcctctttttgttccaccccaacctgtgctttttgcacaattcccattaaatcaacttccagctggttgtttacccctccttgtagggtcaaaattgctttttcacaggaatcttttgcccaagttgcaaaacccccccacttgtgggtgctgcctcaaactgctgctacaccagcttatcacaaatgatccaaatccacctccttatccactattcccccctggtctgattccaggaatggtgcgaaagatgcagatcgggagtggagtgccatactctcccctgagtccacttgacatccccacaatcattccaccatccactattccggagtccgagatccttgagcgtgtatcgaagttctttaaggagattggagaggtaaacccatcagaagggccaatgaagcaaagcgagcccgatgattacgataactatgagagggacattcctgctcgcaagggtggtgcatgtattcctcccccacccaacttgcttgtaaaccttgagacagggatgcgtgcagatggttcggttgatagtaaaccggggtcaactggccgattgggccttggagcgtctgccgatccaaatgagatcggccagtatgatgatgtctactcttcatatcgcaaacagaggagcagtacataccactcttccatcagtgctcgctcattagcaccaaagtgaacggcagaagcatcatatgaaccctttcctcatctgtgtaggactgtacttaaatgaacagaattggcttatcaaatgattgtacgatgcaactatgtattgtcaccagtagcaaatgnnnnnnnnnnnnnnnnnnnnnnnnnnnnnnnnnnnnnnnnnnctagtttccaaaggcact

SEQ ID NO: 75 - DNA, 1094 bp, Oryza sativa
  unsure (1)..(1094): unsure at all n locations
aggcctttggggcctttgctaaatgtttttccgggttacccttatttgtgaatacggtatcccgctttgattaagttaaccgctgccgaaccaaaggaccagggaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcactatatatttgtatttttttcctactatatcaatagaaacatcgctgcgggttgtttcaaaaaaaaaattgctaagcttgtttcttttatgatactcctatcttactactccttaaaaaaaagaacttatcaatcattcatgggttttatatgtacatctcatctatatttctatatggaaatggaccaaattagtcaatggttgcgaataatagctcaggacaggggacagcaacaacattacaaaatcatttgtatgagcgaatgtagctgaaccattctagtagctggttaacaagccaagcatgtcattggatacaaaaaaatgttggcaactgtatagaaatttacaagactctgaaatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 76 - DNA, 1311 bp, Oryza sativa
  unsure (1)..(1311): unsure at all n locations
gcgtgcactgatgatctnnnnnnnnnnnnnnnnnnnnnnnnnnnnnnnnnnnnnnnnnnnnnnnnnnnnnnnnnnnnncttatcccaccacctgcagatagtgatacagtgctccaagtgtgcgctaattctctgaagtctgaacatggattacaacatccagaaggagtccacactccacctggtgctccgcctccgtggtggccagtaagtcctcagccatggagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttggatatngctgatggtggcttggctacggctgaaaaagtgctgctgcgccgacttggcaactgttgctcagtaatgctttgtcctctcttctagccgccactggcacttgcagctgttgctctgtatgcgttgtatctcttatctctgagatgactatattttgagctgtttgactgtgccagatgccatgctgagcttaatatctaagttttatgctagataagtttaccggggctgccgggncaggtacctaactattgaaccgtttgccgtgaagccctgtgtgttgccctatgatccctttggttgaacttcaagtttatggaatcctaatttgagccaaactatctgaccttaaaactgaagccggaaaaagataaacgatacgggcttccgaatttaaaaaggacgccaccttggttgagggttattaccaaatttgaaacaacggggaaaaataaaaaaattgttccaaaaaaactccggtttaaaaataaaatgggtctatacttaatcaaaatgaaggggtcggaaaccccccaaaaacccccgtggccaaaattgggggaaaatgttacaaaaaaaccccattccccggccccctttataatcccacaacctttttgggggcccccccttta

SEQ ID NO: 77 - DNA, 1389 bp, Oryza sativa
  unsure (1)..(1389): unsure at all n locations
agcggntttgttgatatnnnnnnnnnnnnnnnnnnnnnnnnnnnnnnnnnnnnnnnnnnnnnnnnnnnnnnnnnnnnnnnnntacgaaaaaaaagttcaactatagatccgattcccccttaaaaacgaaaaataaaaggcaccactccttttgagtccgatataccagccaccactcctctcagtttcaatctataccatgatatctcacctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgtagaaaaacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgctttccaaaaaccttattgccggcttcttccggtgcaagacgtcaaaggcagaggttccggagacctgctcttccgatcgctgtgcacgcccgcgaaccggatggagtatctacgagcgacggcgcagttcagagtaagaggcaaaccctagaatggatttcgcatatattgcgtgaagaccgcgggtcggtttatataagagaaggntcccttgatcagggggcccggacgatatctactgggcgtaancgaaccggataaagcgcgcggtactaatcggattccacccgtgttgacgcattggattttttggacgtttccaaaaaaaaacaaatttcaatttggggaaaaaaaatcttaaagagggtgcttcttccccaggggtgaggccccttttttggaaacttaacaccatagttgggcacgccccctttttttttttttgaaagaaaggaaaaaaaaccgtgttgttccttttttttcccccaaatatttaaaggggtggggggcttcttttttaaggggcccttttcaaaaaaggagggggttaaaacaaggcggctttttgggggggttgtgtatcaaaaaaataatggggggggggccctttttatcccaccggggggggggggtgggtttaaaattaaaaaaaccccccctcccaggtttttaaattttttgggggggggggggtactccttcccccgccggtgttggggtaaattttttcccccctattccttggtgttaaaaaaaaaaaaaatgggtttgttttttttaaaacccccacccca

SEQ ID NO: 78 - DNA, 909 bp, Oryza sativa
  unsure (1)..(909): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgcttacctgcttaatcacgtactaaaatcggtccaaagttcaatctggttacatgaaaattcaaactaaaatctgctttacgtacgagaaattcatcctgagtccaatcttattacacgaacatttcaaactccaaatctctacattctaacgctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 79 - DNA, 865 bp, Oryza sativa
  unsure (1)..(865): unsure at all n locations
ttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatgattttgtagattgaaactaatttgagaatagatcgcccgatacttcttgctaccataccaaattaaaagcaattcaatcagcaatgtgtagtgtaacataccgcttggttcatctaaaaaatcggactgatcgttccattggcagatgcagagaaaataagcacgaagcaccaactcatcaggagaacgccgatgaaaaggattgtggccatttcgacaatgaacaattaatagttggtcgtcgtatgattcgagtctttagatctgcatataatatatatatatatatatatatatatatatatatatatatatatatatatgtttttctatatggaaggtatgttataagaaagaatatatgtttcctttgatgctgatcgaagctcacatatatgaattatattttgaaatatccgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncg

SEQ ID NO: 80 - DNA, 737 bp, Oryza sativa
  unsure (1)..(737): unsure at all n locations
gctgtcattgatgaccattgtatgcaacnnnnnnnnnnnnnnnnnnnnnnnnnnnnnnnnnnnnnnnnnnnnnnnnnnnnntgtatctaacgtgttgcgttgtgaatgtttgtgaatctgttcgtggatcactccgacgtgatgaacctggagcgtctccgaggcttcaacatgcgtggagtctgcaactctcccttattcggaatcggctcgcccttcttcctgatgtgacgacctccctgaatcctcctgatgtatacgaccttcctgaatcgtgccagtcctatctcgcatggaatgctgtgttcgtggtgttgagatgccttcctgcaataactggatctggatgatgtgtagtatgaaaaaaatgtactcctgtctgctagcagtatcagctcatgtatcgtatgtactcttcattctctactcctgcccggaaacttattactccttgtcacagtttatagggtgttcttttacaagaaaaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 81 - DNA, 1610 bp, Oryza sativa
  unsure (1)..(1610): unsure at all n locations
atgnnnnnnnnnnnnnnnnnnnnnnnnnnnnnnnnnnnnnnnnnnnnnnnnnnnnnnnnnnnnnnnnatgcggccggtgtgaaagctcgtaagtttgccaccgatgcagagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagtgcagagcatcggtggaatgcaacgtatttaatgttaaaagttgttttacctaatagtagtatactttctgattttgttcagtcacgtggtggcccaagaaacagtgannnnnnnnnnnnnnnnnnnnnnnnnnnnnnnnnnnnnttgcaggcgaattcattgcacag

SEQ ID NO: 82 - DNA, 772 bp, Oryza sativa
  unsure (1)..(772): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaaactaccccccttacaaagaatctcgtcccgagattcggaacggctagaaagaaaagggcataggtaaactgcagtctatcttattccataactccgataattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 83 - DNA, 7927 bp, Oryza sativa
cgggtgggccccacctgtgggcgatccccgagaaagaaggcggccgcggtctacaagactgggcctcggcctggggccggcccacaaagaagaatggtaagaaagaaggggaatggaccggcggcccatccaaaaataaaaaaggaggaaaaaagggagggaaaagaaaaagaaaaaaggaataggattttccctggaattaaaaattgcactttggtgatttttaattggttaaaattatttccaaggctttgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaacccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgataccagaagagcggagtacgacacctccgtccatacagtgcttcaaatggtgccatctgcagactagcttggtaactgttgttgtacgagaactcagcatacggcaagcttttgtcccatgccccaccaaaatcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgggccactttggtgagtcggtcaatgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcatgttgaacctcacagcatagttcctctacccatgcgacgttgcagtaactcttcctgctcaaggcatctgctaccacattggccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacaggtcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctgtcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcatagcgcgcgaggcggttgaactcatgcaaatactctataactggtctgggtccttgttgcagggaacggaactctctcttctttgtgccacgattccctcgggaacctgggctttattgaaactatgacaaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaacggcatgaagccagtcgtgggcctcgattgggttggtggtgcttgagaaagtgggcggcttgacacgaagaaattctaacaatttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcgatcgttgggttctcgggcggtggggacggactgttgtcagatgcaccgttggcacgtgctccattgatcggctcttcgctgccactggcgttgttggagtcgcgtgaaccattccttgtctccatctgaggggataggtagaaatatgagaaaaggaagaaaacaggggctcagaaactaatcttgcttatgaatttaagtgcaattatcttaatcttgattaaaacactgaaaaagaggcacgaaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaatatttttcatgaactcaaataaagacactaatgcaactaaacaataaattaatgcatagactagttgcatggaaaatgatgcgcataacattgcccccaccgaatatagacacgacctaatgcataacccccaataaattcccgactgactgtcgaataaactccaactaaaatttttctaaagccctaggctgagctcattttttttttaaaaaaaaatccgatccgaatgaacgaccaagatttttcccgcaaaccaaagaggcaaaactccaaattttcccaaaacaaattccaagtgcaaaagggcatatgcatatgaaaaggggttcagagggctcttagggtttccagttggcttgtcctacggtcaaggtcggctctgataccaacttgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaagagagcaagactgagtactacccactgtactcagcaagtcataccggtagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcaatgtattttaattaactaataccattgcggtggcaccaatccaaagctatgctcatagtcaaagtctatgtaataaggtgatccccatttgtgtgctagttgaactaagcatggctaagcatttcctaaaccaacatctagtcattttgatacccaggttatcaatggcatatggtaaacaataaatggctgagtaataggacccattccacatgatattgtaaacgaatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcacggaggggtgcggcgccgacaggcggggcccaccggtcagcgaccgggagagagagaaagggggtggcggcgcgcgggcccactggtcagcggcacgggggaaaggaggggcggcggcgccacgtggcggccgaaccgacggacccgatctacccaagggtagatcgacccgatctacccaagggtagatcggacggcggcgggaccttagggccggggcgcgcgggcgcagcgcgagacggcagcaaccatggcgccggcggggcggagcccacacgggggcggcgcgcatgcagcagcggcgcaaggcggttaccgaaggcgaccgaccggcggcggagagcggcggctagaggaggagcggacgatacgccggtaatctgtgcgcacgcggatacacggtacggtgaaaaggagaatggggagggggaaacccaaacttcatcgggagactacggctgt

SEQ ID NO: 84 - DNA, 8332 bp, Oryza sativa
  unsure (1)..(8332): unsure at all n locations
gcgaggttttgatatgctcctnnnnnnnnnnnnnnnnnnnnnnnnnnnnnnnnnnnnnnnnnnaagcctcaccgacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggcgccgcttgccggcacacgacggggatgggtctccggcggcgaacctcgacggggaaggggcggccaaggtagatctcgaccccgcgaagctaacggcggcgacggcgcgagacggcgacgagcctagcggcggctagcggcggtcggagtagcaaaagcggcggcggcgggtggttgcacggcgcggaggcgatggggagctcgggagagatcggcgaaatggggaaaaagcgagagaggaggacggcgatgcttaaaaagggggagagggagccggacgtggccgggagcggcgggattcgacggccgacgtgggggagtggggaggagagagaggcgggattcggttttcgaatcccggccatctcgggcgcgggcccgaactggagggccaggggaaagggcgcgggaaactcggcgcacgcgcgggcgtggccgacgtggcccgggaaaaacgaaggcgtgggctggcgcgggtttcggcccggcggcgcgccgggatcggcggaaggtgggggaaggacccgacaggtgggccccacctgtcggcgaccccaaaaaaggaggcgggcggcggctgccaggctgggccctcggcctacggccggcccagcaaggaggagggggaggaaggaggggaatgggccggcggcccatccgaaaagaaaaaaggagggaaaaagggagggaaaagaaaaagaaaaaggaaaaggattttccctggaattaaaaattgcactttggtgatttttaattggttaaaattatttccaaggctctgaaaaatccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacacgacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacaggtggggcccacctgtcagcggctgagagagaggagagcggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaattattccttttaaacaacaatttataagttaaggatttttaaacaagaaaagctcttaacaattatacttagatcattaatgatcaaataattactgaactgttctttgtattatttaagaattgagctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaagacatgaccactctttcatgacttgattgacaaccatctgagagtctccacagacgattagtcggcgaatacctagagatattgcaatcctttgtccatgaagtagcgccttgtattccgccacgttatgggacgcagaaaaatgtatccacaatacgtagctcaatctttctccagtcggggagattaaaacaaccccagctccagtgcctgtaagcctcttcgacccatcaaaatacatagtccaatattccatcttttcctctggcatgtcttcttggcactcggtccactcggcaaggaaatcagctaaagcttgtgacttgatcgaagttcgtggcttgaacgatatgtccaaagacatcaattctaaggcccatttcgcgatccgtccgtttgcttcgcggttatgaagtatatccccgagtggaaacgatgtgactaccgtgactgggtgactttgaaagtagtgagataatttcctaacggtaattaagacaccatatagtaacttttgaacctgaggatatcttgtcttggagtcggctaaaacctcgctaacgaaataaattggacgttagactttttgaacatggccttcctcttcacgctcgacaaccaggaccgcactcacaacctgggaggtcgccaacacatataacagtagcggctcttgcggatgtggcgaggccaaaactggtggagtggtgagaagtttcttgaagtcttcaaaggctttctgtgcttcgggtccccactggaaattgtcagtcttctttagcagcttaaagaaaggcatcccccgcttgccgagtcgtgagacgaaccggctgagcgccgccatgcaaccagtcaacttttggacgtctttttgggagcttggcggtttcatgttgagaatggcgttgattttctccgggttggcctgtatgcctctttgagataccataaatccgagcaatttccctgacggtactccgaagatgcacttttccgggtttagtttcatcttgaaagcacgaatgcttgtaaaagtttcttctaaatccacaatcaggtcatccttctgcttggtcttgacgactacatcatcaacataagcttcaacattgcgaccgatctgagttgaaaaacatctttgaatcatgcgttgataggtcgctcctgcattcttcaatccaaagggcatggtgatgtagcagtaggccccaaagggcgtaataaacgaggtcttcaagcagtcggattcttttagtcggatctgatgatatcccgagtaacagtccaagaaactgagtaacttgtagccagccgttgagtcaaccacctggtcaatgtgaggtaacccaaaagggtctttgggacaagatttgttgaggtcggtataatcgacacacatgcgccattaccccgtctttttccgaaccaggactgggttagccagccagtcgagatgaaggacttccttaatgaagcctgctactaacagcttggttaattcctccttgatcgcatccttcctgtcctgtgcaaaacggcggagtcattgcttgatgggtttggcgtcttcgttaacaagtaaagagtgctcaatcacctctctggggataccaggcatatcggatggtttccacgcaaaaatatctttattattctgaagaaaggtgatgagcacgctttcctatttacaatctaactcagcacctattacaacagtcttatcaagatcggagggatctaagggaatcttttttgtcttggcatcactttcttcggtcttcgtcagcttggttgaaggcacttctccctcgcttgccgtggtcgcagccagtcggatctcttcgcgggcgagagtagtctcgtgagtttgggccatctcgcaactttctttgtcacatgtgacggcttgcttgatgtcgctccgttgtgatatgacccctcgaggaccaggcatcttcatcattatgtaggtgtagtatgggacggccatgaatttggctagagccggtcgtccaagtatagcatgatatgctgtctcgaaatcagcaacttcgaaacaaacattttctgtgcgaaaattctcccgagtgccgaaggtaactggaagagtgatctggcgagtggtatagctgacaatcctgggataacaccgtggaagggtgcattactcggctttaattccgtgcgaggaatctgcatatcgtccagggtcttagcgaaaaggatgttgagtgcgctgccaccgtcgatgagagtccgtcggagcttgacattgcgaaccactgggtctagtaccagggggtaccgccccgggtggaccactcggtcgggatgatccgagcggttgaacttaattgttatctctgaccaccgaagatattggggcgtgctaggctgaaccgcattgatctcccgctctgttagcttttgttttctcttagattcataagccaggggtccgccgaagatgtgattaagttctttgcgatgatcttgaaaaccggtcggggcatcgtcttcatcatctttcttctttgatgtgccttgatctccgtctgagggtttacgtgcgttcttaacgtattgctccgcgaactgtttgtagacgaagcaatctttggccacgtggttggagttgggatgatgcgggcattgggagttcattatcttgtcgaaggtgttgacacgagaacgttgtcgggaagatggagaggtggtcgccacaagttcttcgagcttacgcttgcgatccttgtggtttttacttccactccctcctgcggtcggcgtatccttctttggcttccaagtggtgcccgactgcttggatgtcgtgatagcatcttcggctttggcatactcattggctttttcaaacatctgtttgaccgtcttgggaggtttgcgtccgaacttgtcgactaggtcctcgtggcgaatgcctttagtaaaggcggcaatgatgacgtcgtcggtgatgtcggagatcttgttgcgttgctcagagaagcgtcgaatgtaatctcgaagagattctccagacttctgaacgatgttgtagagatcgaagtgtgtgccgggccgttcaaaagtaccttggaagttggcgatgaagtggtcgcgtagctctgcccatgatccgatcgtgtcgcggggtagcccgtgaagccatgaccaggcagaatccgctagggccacaggtagatagttcgtcatggctttgctgtcccctcctgctgcgcggattgcgagaccatagacggtgagccaagactcagggttagtggtgccgtcatattttttgattccagtcggcttaaagccggctggccaatccactcgacgtagatcgcttgtgaaggcagcaactccgtccacgttgtcgtcgtagcgatccggtgaatgatggcctcttgctgtgcggcgctggttgatggtgtcgcgaagatcgatgggacgtcttcgatgtggggagtgtggtcgttcaattcggcgctccctatatcgctcgggaggcgagcgaacggaccgttcatcatgtcccctgctcctgcgactagattcggcgccggcaatgctgaggcttggctggtgatagtcttgagatcgaagatgagggactcggctaccagtcggggtgcgggtgcttgcagagttggctgggaccgaggcagcgatcatggtcttcgtctggttcaagatgttgactacatgatcagcttggttgagtgcgtcttccttgaggagggtgtcgaggagagtgattgctgcaaccgcgttctgttggggggtgcgaaagaccgctatcccatcgacgtcttgttgcccaatgagctctctcgcttgccacccagattccaaggcgcgttgtcgtcgatcttcagcctcctttgcaatccgttcgcgatcttgttgctcacgctgtagtcgttctcgctcttgtcgctgtcgctcttcctccaatcggcgacgttcagcttcttgccgtgcgcgatcttggtccgcttctcgggcttggcgctgttcctccgtttcgttgtcagccatgaatacgccgaagaagaggggcgtgtagttatccttatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatcatcaggaagtttcatcaggattgagggataggacccgtcgtcttgatctggtcgcggaagagtagattggatctcatccgagtggtttgaagccgactcgggagagatgatcttggagtaggcctcggccgagttcggaataccgaacggcacagggacctggtctctccccgactggtttgaatccgagtcaaggagagagatcttgccgaagtcgttggtgatgaagttgaggctgccgaaccggaacgcctgcccgggaggaaaggcgaagtcgtcgatgccagaaacgaaacccatcgcacttagtcggcgagaacttgacgctacccctacctggcgcgccaactgtcgaagcaagatttcggcaataataaaagggggtggctgtcaagctaggaaaatggatgggtttggagacaagaaattttatacaggttcaggccttcttattaaagaagtaataccctactcctgtccggggatgattccgccgagtgtgttattaattgtatagactgggaaaaagaatcacctcccaagaggcacgcggaccctccttatataggggaaggagtccgctttacaaaatacagtccatatcctaacggaatatgggattatagataaaatacaatcgtaaccgactaagatcccgggtatttccttgacatacaagtttagaacctaacccgagtcttcatagagatattccatctatatttgataccgtatatccgactaaattacaaccgtcatgtagatatggggtatccataatctccacaagctggcttgtctcgagctatcttattgggtcacatgacggtgttaaattttgaaatagatctaaggaaatcatgcataagagaaaatagccaaaagaaaataaaagacacaaatccaatttttaaagacttctcaattatctatctcttaaagataaatatagagaatatccataataaaaggaatgccgagaagcaaatagaaggcataacatccagattgtaaaggcttcccaaaatatctttcccctttgcaatctatcaatcccatgctggttggttttatgccagctgattgttgccctcaacattctttagttgagcgacacgtgacgacatacaagcgtcgaaaagagagccggttaataaaccctccctataaaactggcaagcgttcagttacaacggtgaatagaaaaacaagagaagagttgttccacgtgtcgtgaccacatatcctatatttggagaaactaaaagcaataaatagaaaaactaaatgacataaacaataaactctataatcctgataaccaatttctaaatatatgtattttctgcttatactataaataaataatatgtagatctttacgctacaattataataaaacaaatattaattctggtgttggatttatacctagagttttatgtcaaatctaaacaccataatgctcaaaatcataaaagaaaaattgaaatattagtatattaactatatggtttttaaaagccatacacccaagctaattagtggacgcgccaaacggcgtcttgattttctaatctacattattggtgattagtgaannnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 85 - DNA, 1742 bp, Oryza sativa
  unsure (1)..(1742): unsure at all n locations
agcgtgnnttttgaatgcgccttnnnnnnnnnnnnnnnnnnnnnnnnnnnnnnnnnnnnnnnnaggatactcatataccccaaacactaccaagacaccaacacgaagagagtacgaacgctagtagggcgttcccagcgcgccttcatggtgttcgaactgaataatcaacaccatgttctccacacaggaaaacccgtgaagatcgatcgtgtagtcaaaactgatcgcccgttctttagcttgaaaaacctgtaaaaagcacatgcacaaatgactgggaagaggagagagagagagatagagtgtgtgtgtgtgtatgaaagctgtggaaggaatcgacagcggttgaagccaccttgacgagtgaagtcaacggggaaatggaggggctcgccggcccgatatgctgcgccgctggacatgatgactcaaagagcagccatatccacttgtccaccggaccacgctacaccgacctcattgcagagatggcatggaagtgtggaagggaggaagatgaggacggatccgtcatcgaccgcttcaatctaccacagagatgttgagcgtcgcggcgaacagcgaaggagaagagaagggtatgatgatggctgttgcaagctcaattatttgtcactcagtcaatccacaacctgctctcgggtcatcgctattgggggagtgccggggggctgcctcctccgccaccagggatcgtgcctatcgcggccacccgctcgtcaccacctcagggagcttgtcgcccgtatggaacgaggcatcgctgggagagggtagaggttgtggcgcctgggagatagaggggagaggcagcaccgccaaggagcacatcgctggtgatgggttgatggaaggtgtagggatgccgacgaagtgatgaggagaggcgtagggaaagggagaggtggaaaattttatatttgtttttgaattttaggctgttgagtgtaaaaattggaccacttcataatttgaaaacatgtgatgactgagccacttgcactataagacaaatagatttaggtttaattggatccatgccatataaatatgctgatttagataaataccactataattcgtctattatatttataaccgtgatattaaaatgttacaaaatttgggccatgcactactgtcatgttttccatccatctcagtcttcatcctcatatacacataggacccatctgtcaaattcatcaacttcatttttcctcttatcttcttcttttttttcctctcagctcctcatcgtcgtctgagagaaagtacgagaagtttccgctggcgctcatctgctcctcggataccccatacgcgtgccacatgctggtccgttcgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcngcaataacaatgaaatcaatcccgc

SEQ ID NO: 86 - DNA, 803 bp, Oryza sativa
  unsure (1)..(803): unsure at all n locations
ngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcagatccgactaaaagaatccgactgcttgaagacctcgtttattacgccctttggggcctactgctacatcaccatgccctttggattgaagaatactggagatagattgaaagaggctcaacacattaataaatcactgtctgctttgggtgatgtgatttttgctttggcgcaaaagaatgctcatgtgccatacaggaacagcaagctaacacaagttcttcaaagctctttaggtaatcaattatttagttgaaaaatcatgcatgtggagttagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 87 - DNA, 1002 bp, Oryza sativa
  unsure (1)..(1002): unsure at all n locations
ncgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgtgccgtggcgtggctcattcgtttcgtctgtcgcgtgggcagaacacggcgccggtgccgaggccgggggcgctggggaagcagggtgtggcgctgcggatatcggcggacaacgcggcgttcttggggtgcaacttcctcggcgcgcaggacacgctgtacgaccacctcggccgccattactacagagactgctacatagagggctccgtcgactttatattgggcaacgccctctctctctacgaggtacacacattgcttctttctcttggttgcatacacatttcctccatgaacattataggggtgccgaattactcaagtctagatgagcatgcgacttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 88 - DNA, 2786 bp, Oryza sativa
  unsure (1)..(2786): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnntatgccattcctttggtatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgtgggagtggagccggagcttcgctagattttattttccgctgcaattttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattacttgtgaattttcgggcgtgacaagttggtatcagagccatctcgactgtaggataagccaaatggtcaaaccttaaggacaaattttctgaaaacatgatttgtgaaaattttcctttcttccttctctagaattctgtataaatcattttatcatcctctcccctcctgctttcaacttaagtggttctgaaactagttgttgaaacttgaagacgccagtgaggtctacttatggaggtcagtcaagtggatcgatgaataagaaggtgatggtcgatctgaagtgccaagtggtcaagatggaatgaagtttggatcctaccttagaacctatgccgccaaagtgtctttgaagaatagttagtagggtagaacgtttgttgtttgcttgtgtgtaggtatggttgcatttccatcattggagtagttcattgatgagtgtgtaactatactaggttgcttgcttaatcaacttgaacaatataatggtctacacacaccagatcagtggtaacatggttaaggtcttgtctttagtgtaacccctctcctcctatcttctctaatctgcaatagatggtgaacactcgcgccagtcgaagtggaaacaataacaatgaagggaacccaactcttgctcaagttctggctcaacagactcagttaatgaacatgatgatacagcagatgcagaaccagctcaaccaagggaacaacaatgctccaccgccgcagaacaagctagctgattttcttcgtgtgaggccacctaccttttctagcactaccaacccagtggaagcaggtgattggctacacgctattgagaagaagttggaattgctccagtgtacggatcaggagaaagttgttttcgcttcacatcagttgcaaggacctgcatcagaatggtgggatcatttccggatgaacagagcagaaggacaaccaatcacttgggcggagttcacggaagcattcaagaagacacacatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaggagaagtttttggaaggcttaaaggatgagctatcagttatgttgatctctcatgactatgaggattttcaggagttggttgacaaagcaattcgacttgaagacaagaagaacaggatggataaccgtaaaaggaaaatgactgttttccaggaggcacaaggtagtagccagaggcagcgtatcaagccactccaaattggtgaacctttttccgctggccaaggacaatcgcaacagttgaatatcggtggtgagatcaaatcagagactaatgaaagcaatgaagttaacatcaagcaagctaatcagccggtgccagttcagcaggatcagtctcaggagaataacagtagtggaaggaagcagcaggtatgtttcaactgttacaagccaggccactttgcaagagagtgtccgaagccgaagcatcagcagccgcaaggtcaggtcaacaacattgtcgtcacaggagccaatgcagtgccagttgcgtcttcaagagttgtgtcttcaagtgttgcagctcagccaccagtttcaaagcagcagtagttttctttaaagccttagaataattatcggagttatggaataagatagactgcagtttacctatgcccttttctttctagccgttccgaatctcgggacgagattctttgtaaggggggtagtttgtcacatcctgattttcgtttcaggatttataaattatttaataaattattaatagaatttatattaaatgatctttaattttcaagtgaagtaaaatgtgggaaataaaaatttcttaaatctaaagcatggatggatttaatttttgttaaattctccatggttaagtcaactctctgaaattttctcggttttttttcagagctcaattcttaaataatacaaagaacagttcagtaattatttgatcattaatgatctaagtataattgttaagagcttttcttgtttaaaaatccttaacttataaattgttgtttaaaaggaataattagaaatgattttaaaagcctaaaagagaagatctaattttaattngctaaatctcaatataaaaaggggccagataaaatntcattaaatactttgcttaattctataattcctagatttttctgggatttatttgagctaangaagtattttaaataatggaatngcatttaagaaaatatttaatttgaaaacgttttaaaaa

SEQ ID NO: 89 - DNA, 34439 bp, Oryza sativa
  unsure (1)..(34439): unsure at all n locations
ccgcgnnattggagatnnnnnnnnnnnnnnnnnnnnnnnnnnnnnnnnnnnnnnnnnnnnnnnnnnnnnnnnnnnnnnnnnnnnnnnttaatattgattaattactacaactgttttactgctttcaactactgcttttaaatgctagctttatgcaaaagaacctctagcctcctttggttatatcctgcatcatacctcctctaccggtatgacttgctgagtacagtgggtagtactcagtcttgctctcttttcccccacaccagagctgaagattttcctagttggagctgttttgtcaaatttggtttcgtcgctgccgtcaaggattgtctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggattcaatgcacattcagcttagaaattctggttcgagaatttctgggcgtgacacgtcgccaccatcgggttcgccaagtcatcgctgtccccgtccaccgcttcgccgccgccgaagaccgtcggagcgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatcttaactcagtttaatgtggttcaagttgcaaaagttgtttaaaataaagatctacatattaaaattgtccataaattgaattaaatttatttaattctttttaaatgggctttaattagatttaatcttgtaaaattcttaataaattcatttgaagtcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgtcgggagtgttcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttctcgattactttattccttgataccttgggtgattataattggactagttgagctttatatatattggttcaactagatattagatatgattgcttagccatgcttagaaacattagcacactattgggataacttatgattcattattatttaatgatggtttaatggtagctcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtatagcatggttcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctgataataatttgcttagctcctggtttggagttagatctgttcagccgggtatggttgttcaggatggttgggcctgtgcagcatgggtgtgctgttcagtgttgattaaaatttctgattaattactccactgttttacttctcttaaatattttgctaaatgctgcttttgcaaatgagccaatattatgccattcctttgatatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgtgggagtggagccggagcttcgctagattttattttccgctgcaattttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattacttgtgaattttcgggcgtgacatgtctagatgataatatgaccgcttatcgacaagaggtacgcaagttggaaaataaattcgatggactcgagctcacccatgtccttcgacataacaatgaggcagccgacagactggctaattttggttcaaaacgggaagcagctccttcagatgtgtttgtcgaacacctttacgaaccgaccgtgcccagaaaagagacagtcgaagccatggatattcaaggcataagcatgatcgaagccgactggagagaaccgtttataaaatttttgagcaaacaagaactacctcaagacaaaaatgaagctgagcggatttccaggcgcagcagactttatattattcatgagactgagctgtacaagaaaagtctgtcaggaatactgcagcgctgtgtgtctttggaagaagggatatagttgttgaaggatatacattttggtatttgtggtaaccatgccgctgcacggaccattgtcggcaaagcttaccggcaaggttttttctggcctacagcggtgtccgacgctgacaagattgtgcggacatgcgaaggttgtcaattttttgccagacaaattcatttgccagcccaagagttgcaaaccatcccgttgtcctggccatttgcggtctgggggattgacatggtcggcccgtttaaaagggcagtcggcggttacacgcatctctttgtggctatcgacaaattctccaagtggattgaggctaaaccggtcatcacgatcacagcagataaagctagagatttcttcatcaacattgtgcatcggtttggggtacctaataggatcatcactgacaatggcactcaattcactggcggagcatttaaagacttttgtgaagacttcggcattaaaatttgttacgcctccgtggcacaccctatgagtaacggacaagtcgagcgcgctaacggcatgatactgcaagggatcaaagcacgagtttttgaccgactacgtccctatgctagcaagtgggtagatcagctgccgtccgtactttggtctttacgcactactcctagtgggctaccgaccagtcgccgttctttttggtttatggcgcagaagcaatgttgccgagtgaagtggaatttgaatcactacgatttcggaacttcaacgaggagggctatgaagagggccgagtagacgacatcaaccgactagaagaagcccgagaagcagttttaattcagtcgactcgatatttgcaaggattgcgccgttatcataatcggaatgttcgatcgcgagcctttttagtcggcgacctggttctgaggaaaattcaaacaacacgggatcggcataaattatctctcttatgggaagaaccgttcataattgctgaagtcactcggccaggttcttatcgactcaagcgcgaagacagtactctcatcaacaattcttggaatattgaacaccttcgtcgattttatgcttaggcatttcgcttgtatctttcctatttgactgctaacttcaagtttttccttgaagttttcagtcagggggccattatgataataatggagtgtgatttttatcaattcaatttgcttacttgatttatcattgccctgtttggtctttcgacttagccaatgaggactgaaggtttttaatagcttttgcgggttttaggctcaataaggcttgacaaaggcttttaagaaatcagaagctaagtatggaacaccaagcatagcataaattcatcagtattgtacaaattgagcttccaccatcattgatcatcaaaatcattgttatatcaatcagtatcagttttttcatcattagacttatcagacccagttggccgaaggtcgacatcttggaatctctcaactacatcagcagcaatcttgtcagccgctttctacgcatcactgatgaggtcaagagcagcttcttcgctcgtcccgtctacaaagccatcaatggcatcaatgtcaactcttggataaagggatttggtcatcgccaatgccagacttgctcccatacttccagcttctttgatgttcttgaagtaagtatctgtagcgactctcagcttgtcgaagatttcggcagcatcaagtgtactcgaaccggcgttattgaagaacatggcctggataagtggagtagcggcattagcgactttatccttggctccttcaagcttgttgatcttgtcaactaagacatcaaattgtgcttgagacttgatcttgcggtctgcgtcaacagattcacattaatgaatcagcatgtagaagataatggcttttgaggtattgattattggtaccttcaacctcctttaaagccgaatccctctgtcttgccagctctgccttgtcattttccagagtttggatctgcttctctagttgagatatcttggcagcttgcactacattaacttcggttaatcaagattacagagataacagcacaaatcagttgggcagagtttgcgcgaaccttttgatgagccactcagttcgaaattggactcctggagctcagcaatccgatccctcagatcgtgttcattcttcttggtaagttctctggcctcgtgcagttgactcctggtggcttcgagggttccaagatgaggaactagtctctctagggttgcggttttcgcctcgttcctaagatgaatcctctgcggagcagtttaatcagcgctcgagccagacggtaaacaagatggctgaggttaggcgtcaaggaacttacatttacaatgcgagtcgcttggttgagtgcctttttcagtaggcatacctcttcgtcttctttttgccggtttattacaattccttgaggttgcaagttgtcatcccaccacttgaccagaataggagggcacgaatcttcggctgtttgtatacggggaatttcttcttcatcaccgatcattggtcctaatgcatccattgacaaaggttacacgatcgatcagagttatttgggtcaacatggtttcggacaaagtgtttacctgtaatgatttctggacgaggacgagtggattcggatacttttaaaggggatccagatctccggtcattgctggcgtcttgtccacgagggttgtctgcttgggtttcgacttctggaatctcttggcttggccctgcgtccgactggtttccagtcgggggctcctgattaactccggcttcggcttcggccgactggattccagtcgggggttgatcaccggattctacattatcggttgccggttgattgtcactcagatgatcctcagcagttggctcggtttctttggaagaacttgtgtccacgttagtcgggtcagagtctttcccagacggatctatatcagatggtttcctgcaaatttgattatcagtattattgccgcaatgggtgcgcatcaatgcaaaagagatcgttatatgagttgcacctagaagacttcctgatctttggcacagggcgactggatgttttctaccttggagtagcctgctttggtagtttcttggttgtctctcggtctccaggcctcctggcggtatcatcggcttcgtcgtcacttagaaccagcttcctctttcgagaatctgactggccgattggatcagaagcacttggttgagtttcagaccgaattcttggtcctccgctcccttgcccagtttggtggcggggcgatcggcgttgagcgattgggggatccgacttcatcaaagcaaattcctgggtgtaatatccttcattgttaactgattcaacaagaaagcaagatcatgttttgagaaaggttgaagtgtatgaatacgtaccggtggaggaggattgaatgcattgaacggtacgactggcaacaagtgtaagtagctgacaacgatggcgtttgagaagatcttatacatcctttccttcatgaccttgaagtcaagagaatctggatcttcacggtttgggtcatgcttgccgtcaaattcgaaggctgtgcgagatctttctttgattggagctaaccgacacttgataaagtgccgggtgatctgttctccttgaaggccctgttctttcagctttatcatcctctccatcagttctactgcttgtgcagcttcgtctcccattggcagtgagttccaagtatcccgataaactggaggaagacaggagtactcgagaagaacaggctcggggttttgaacataaaaccaatttgcgtgccagcctttatttgaggtcttgaagggcatggagaagtatttttggcttagtgttcccctgagttggaaaccagcacccccaacgatgcatggtttactcttgtttggttggggcttgaggaagaagatgcagcggaacaaggcgaaatgaggcctaatgcccagaaaagcttcgcaggcatgaataaaattggcaatatgcactatggagtttggattcagatgatgcaagctaatcccgtagaagttcagaattccccggaaaaatcttgaggttggaagagaaaatccaccgtagaagaaatgagcaaataccacgatttcgtgtgtatcggaggtcgggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaaatggatggtctgatttagttcgagatacggctggaaagggatggggaattggagcggtggatgcagggagaaatttcgtgaagtttttgagtgtggattggagcggattgatgaaccctagtttgcccggcgtagttttgcactgtagcaggaaatggggaaaatggcgagagtctcggcggggaagacgaagagacgttttttacttcggtattattagggtatcgggagcactaatgggcctgggcctgtacagtacttcagcccaatgctataatcagcgtggtctgttgtgatctctagggacttaggcactttttgctttggcaatttgtgtttacgatggtgtggcctaatgctgttaaaatcctttttaacgcgattcaataattctttggaattattatgatgcgcataaaaaggtgcctgacagaaaggtgttataccatttttttgtaagctttattaggctgcaaaagctgtttgggttgatttgagatgactggtttattaatagtcattcttttagcatgttatatgcttattttggttatggtaagggtcacagcctaggctattggactcattaattaccatgattttctatcctgtttggtgggtcattttatgagatttttactcggattcctatcaaacatgtctatttttggacctttgagtgtttatcactcggcccttcttgtattttttgtccttgatacattcaagttgagaagcagtcggctgggtatcttactaagtaccatgcgtgcttcgctataaaaccactcggttcttgactatatgtttagtttttcaactaatcacatagtcaggggctacacctaattaggtgcatctactcgatgcaccatgttttattttcgcccttcacagtttttgatttttagtactcggcaagctggagcaagttgaattgaagcactcggactactgttttttgtttcgagaaggctattttgtcaactacgaaggtctcgggggctactgtggagattatggatatcccatatcgacatgacggttgtaatttagtcggatatacggtaccaaatatagatggaatatctctatgaatactcgggttaggttctaaacttgtatgtcaaggaaatacccgggatcttagtcggttacgattgtattttatctataatcccatattccgttaggatatggactgtattttgtaaagcggactccttcccttatataaggagggtccgtgtgcctcttggaaggcgattctttttcccagtctatacaattaataacacactcggcggaatcatccccggacaggagtagggtattacttcttgaataagaaggcctgaacctgtataaaatttcttgtctccaaacccatccactttcctagcttgacagccacccccttttattattgctgaaatcttgcttcgacacagctttagaaaatagatttacaaatactagatggaaggacctagcctatgttgtgcatgaaactggttgcccatttgaataattaatttcccatatatgatttttcatttggaggattgattgcggtacatatgcaatgaagtttatggtgctctggaacccaagagttcgggttaatttctatttgctccatacgagataaattgcaaacatgtgctagcaaatgacatgtaccttcctaagcagaatagtgaaacagaaacaaaggaactttgtttacttatgtgatccaaatattcgtagtaatatgtcgggcatttctgacccagtgccgccgccttgtccgtcgacgtgtctcaagaactacgctgaccggagtggcggagttgctgcaagttcatcgagagggaagtcttggagaagtcgaggtatatgaagaacgattccttcacctccgctgcgacgtcgtcgtcgtcgtcgtcaacgatgacacggcggcgccccaaagccttgtcgtcgctaataagcctccccgattgcccgacctgcaccatcacctcggcgaactcctaaatcctaattcgtgcagggaaggacgcggatgtggcgttcgaggtcggcggcggcggcggggtgagattcgccgcgcaccggtgcgtgctcgcggcgcggtccaaggttttcaaggcggagctcttcggcgcgatgaaagagggcgacgccgcatgcgtcgtccgcatcgacgacatggagccgcaggtgttcaggacgctgctcttcttcgtgtacaccgactcgttgccggagatgagaaaggaggaggaagaagccatatgccagcgtctgcttgtcgcagccgaagtgtacggcatggagaggctcaagctgatatgcgagagcaagttgtgcaagtacattgacgtgggcacagtggcgtccatcatggcgttggttgaccagtaccattgccatggcccatggcctcataaaggcttgcttagattttgtcagctttccagacaatctaatggcggtgttagccactgatggtttctaccacctgagtaggagctgcccgttcatcacggaggagttgattggcatgctctgaaagttacttctccctccgtttcaggttataaaacattttaactttgatcaaagtcaaactattttaagtttgattaagtttatagataaatatagtaatatttacagtactaaattagtttcatccaatcaatagttgaatacattaagtagtttgattctgaccaaagtcaaaatatcttataacctgagacagagatagcagctcgttgtacagtgttatagccgtgttatatatgtgggctccgaattggacctatcattgtgcatattgcgtgcttgattaattagtttctaccaacaatttctctatgtttgagatatggatgttgcttacatattttttaacatattcagagatgaattagagggataaaatcgtagctagtattatattttgttatattcataggcgcatgaaaccgcctgtattttatcacctttttagagtcattctttgactgctatgtgtagttgtacagatgcagggaaaaccatcgaaaacagagggagaatttgctggtgtgggtttcttgatccggctcattagcctccacggcccatttggtcgttcagagccaaacttcccttcgtccttgtgtacgcgtgatccaacgatatgcacaaacagacccagattcggacaagatcagagggcctaattaactatctgatccgatcagcatacgatgacggagtagtaaactgaaggcacctgcatttccaacacaccaaggtttgccggccatggcgtcgcgatccgcctccatcgtccaagccaacgtcacgagcgggtacaacctcctcacgatcgacggctacatggccaccacgccgatacccaccggagtgtacatgacgtcgagcgcgttcgccatcggaggccatcaatggcgcatcagttactaccccaacggcaagaactccggctgcgccgactacatctccttcgacctcatcctcgacgagaatgtcgccgcgccggtgtacgcgcagcaccggttccggttcgccggcgacgcggagaaggaggcggagcaagcgccagcgccgccgccgccgccgtcgtcgtctttgacgagcttcacgagcgggagcgcggcgaggggccgagccggttcgtcaagaggagaatcttggagaggtcgaggaggaggcatctgaagaacgattccttcatcgtccgatgcgacgtcgtcgtcaccgagttccgcccggcggaagtggcgcccggcagcgtcgatgtcgacgggccgccgtccgacctgcaccgtcacctcggcgacctcctccgcggagaaactggcgccgacgtggtgttcgaggtcggcggcgagaggttcgccgcgcaccggtgcgtgctcgacgcccggtcgtccgtcttcgacctagagctcttcggcgcaacgactgcgaaggaggtcgtcgtcggccaaagcaccggcatcgtccgcgtcgacggcatggaggcgcgggtgttcaaggcgttgctcttcttcgcgtacaccgactcgttgccggagatgatgacgacgacgaagaagaagatggaggaacaagcagccggcgacggcgacgacaggtacgacattgatgcgttcacagtggggaaggtcatcgcgctcgcggagcagcatgattgccgtgttctaaggaaacttgcctcgatttcttcatgcgtcgtcctggattttagaaggatgtactgttgggcaccggcgacggcggctccatcagctgctccttttcttttagacaagagttgtttgaaggcctcatcaaaaagtggtagctgagcagttctgcacaaatgatttgaagcaatgctgaataggatcaaggatcgaagccgttagatgatcttcttaaaggaaataagggtgtgttaacttcacatcaaaattgaaagtttgattgaaattgaaacgatgtgacggaaaaattggaagtttgtgtgtagaaaagttttgatgtgatagaaaagttaaaagtttaaagaaaaagttggaaactaaatcatgcctaagcatgaaaatacactgttcatgtacagtggtgaagccagattttaaatatgagggggtcaactcgacaagtgatcgtgatcacaaagtaaatttcaaagtaaaaaatatggacgagactacaaagcttgtgctttcataattaatacgatgtttaaccgagtgcactttccgaaattagttatgtctaattagcattcatgtatttccgagtatgcaagtatgcaacaacaaagaaaaaatagtcataatagctaagcctcaaataaacttttgtttcaaattatatactggatccacactctgatagtatcattgtattctttaattaaatctttataacaagatcttacataattatattttgataaaaataaatatatatgttgtaaattacttttttatatacgcaaattacttttgttgtaaattatttctagatttgattaatttacttctcagatatttatgatagtaaattcaataagacctaaaagtgacttatacaaatcataactacttctaaattttattcttatttttaaatcatctagcaatataggtattcccaggatgtttaattctatttttttttcaaagagctacttttaatacatgaaaagttacttatatttttcttgagagttacttcctctaccagtgtagccacttcttacatgagttacttctattttttaaagttacttttaataccatgtaaagttatttctatttttttagagttattttcctctagtaatgtacttgtaatactgtaattattttttaaagttatttttccgttactgtatagttacttctaatcgtcaaaggttacttctattctctacttccaaagcccaaataaagtggtaataaaatgaataagcctaatgtcaatcgctaactcgtgtcgaattgccttctgtgagttctgtctcaagtctcaactaactactgctctgttctttcggctaggtggaatggtagttggagcacgagccagctaccgaaccaggacacatcagctaagacaccgattccacaaaatcccccgcggccgtgatccgttcaggtattcacagcttctctcacgcgtcgtcttgctgtccagcgccggcgacgggtacagactttacagtcatggcggcggcagtgctctgctttgtcaccctcctcgccttctgtttcttgggtcagttactccgaatctctctgatcgacaacacataatatggctgtgttattcctcccatttttctaacccacctctctcgttttccgcacatacgattttcaaattgataaatggtgtgatttataaaaaactttctatataaaagttgttttaaaaaatcatattaatctattttttaaaaaaatattatttaatacttaattaatcatgcaataatacgagcttcactttgcgtgctgggaaacctgaacacggcctatgtctcagtgctataactcgctttgatcctttacattgatggaacagcgccggcggcgttgatgttggggtattaccacggctcgccggagctagtcgtcatcggctcaggttgctcgaggcttgtggagacgaactcgttctttgcgcaggacatcaaggtgaccatcctcccgtagctctgcacgagctcagtcaggacgagtgttttaatgtgtgcactcgctcttgcaggcaaggacggagggagggtcgccggagaatgggttggtgctctacgggatgccggtcgctccgcctctcggcgtcccagccgcttggtcggaggctcgccgcgccgtcgtaccagccaattctcacatggtaatgctgcgttatcatctgtgtgattctgtttgaaactctgaactcatgatcatgtcagttattttcagaattgaagattagttgctacttactatactccatgttgtgtgctgcaggaatgggtgtatttccttaacagaggatcggagatagaagtagcttacagcgtcaggagtgaaactgaatcgtctcgtccaatctgcatgatcattgcgcgaggtaagaaaggttcagatatatgaacaagtgtgtttaagtgtgattttttcatatcagtaacagagtttcactgacaccattaaaattcttgcgtgttggtgcttcactgcttcataggcaaagaaagcttcttgcaatgggctgagaatccatcagcaaatgagaccacattatcttggcacttggtgcacggtaagcatgatctcattgactaagaatcagttgcagacttgcagtaccccgggagaatccgtatactaatgctatcaggatgtgtaatcacaggaaatggaacaatcaagcagactatcaatctctcttcagagtacttcattgccttgggaaactttaacaatcaggatgtaacggtaaattaccccgtgtcaagagcgacagagcttccaaaatgtttttgtggcatcttcagccttgttacagaggtttcatctggcaggtgctactggaattcagaatcaggaccttgttctacaacaccagcgcagcagattatacatgctcaccggccagctctctttgcacttacaaactgccgtttttaggacaaaacgttgtggttctgtcatccggccccaaagaggtgacaaaaagcgtcttctctgtcatcttcagattcctctcgtatactgtacaatgctcactttagccggatgcagtactgactagtctagtgcacaatttcattcagggactgaattctgatggtcattatgtgaagctgtcatatggacctcgctggatagtgtacatcatcggattaggtaccaactcaataatcacctacaagaagaacctctcaaattaatggtaggattgactgcacactaaattattaatccctctgaattgcagttctgttggctgttgcactgctgatcatgtacgatatactgaacatgctgttcggtcccgggcctggaggaggagacgcgagagcctcgctgctgtcgtcgtcgtcggcggcggcggcgagcaaagaggaagacgacgcgagcctggggtcgtcgtacgactccgtctcgcacgacggcgacggggaagacgacgacgacgacgtagaggaaagaggcggcggcggcggcggcggcgaggggcggcacctatgcgtggtgtgctgcgacgcgcggagggactgcttcttcctcccctgcgggcactccgccacctgccacgcgtgcggcacgaggtactaaactgttttaagggtgtgtttagttcacgctaaaattaaaagtttgattaaaattgaaacgatgaaaaagttaaaagttcatgtgtatggaaaaaattagaagtttgaaactaaactcggcctaagtgagattatcgttattaacggttatcgtggttaccatgaaccgtggttatcgtccgtgataattacgataacctcagggtttgtaaaccttatcaccataaaattgcaaacgctgtggttgcagggtggcagaggaggacgggagctgcccgttgtgccggaggaaactgaagaaagtgaggaggatcttctccgtctgagctgtccgcgagctcaagcatggggtttctccgaaccagtggagtggagacgagagaaaaaaaaaggaatggacgcccaccgtggggctcgaacccacgaccacaaggttaagagccttgcgctctaccgactgagctagacgggcttggtgttcgagaaatgcacaaaaggcatacattgtactatgtcatatgacgcattgcagatgataagattattattatagacctatttatgaggagaaaatgtttgatactcgagaacgggagttttatggtataacatcacataagagtgttttaattttttttcctttttctccatgccaactccactagcattagtatcaaatgcacctagttaactttatgcaaaatttccattttaccccttcaaatatatcaagcacttcctactctgagactctgagatatggttctataggtaaaatgtattttttgtatgacgtgttaacggaatgtatctaatgggagacttaatgaagatggcagaaacagaagaaaaaacactttggtaatggtatttcgtagagttaatgttcgttgatagcagttcgtagagtcaatcacttatcaacggtaaaacgtagtatttcttgtttaaaaaggaaaatttaaaaaaccatcccaaatgtcaccctcaattcgatactcccgataagatgatttatcacaaatctccctcctcctaattcacctatgcccacccgttctcatagccgcaaaccccacatgggctcacctgaatactactccctccattctaaaatataagcatttttatagtaggacacagttattaataaagtgggtagaaatgaatgatggagggttgtgattagttgagtagtggaagtagatgggaaaagtgaatggtagagagttgtgattggttgggaagagaatgttggtggagaagttgttatattttgggacaaatcttgagagctaaaagttattatattttgggatggagggagtactagccaaggagccgtggtcaccagtaatattgggtaggctcgatggcacgattgcggcatctggcatccagcatgttgttgggcgatggtaatcacgagtctcagctcttagagatgggggtcgccggaagatgagtccatgtatatcaaaagatgtgctaagtcatataacacataaggaaagagaaaaggaaagaacttgcaacaaacaagcgacggattgccttccttcttccttgaaggttggacttactcgaattactacatttcctgattccgctaaccctgtttgtttgcatatcaggttcggcttgagcgtagacatcggatcgtattgatggatatcgcatatgtgcaagcagtgacaattgggaaaggatattgctacaaatggttttacagggatctcgaactcggattgagatcctctaacttacttccctctaacttgtgtcactgacatatggaccctctacttagtgggtccacacgtaagcgactcaaagtcagagggaaataagtcagataatcctcttccctcgaactcagtgtgatatttgaggtggtttttgtaagttcccctttaaaaagatcaaacatgatttgcccttttcttgtttataagttacggggtcattatgcatgcagaatggcaggatttgttcaatctctcaaaataaaattttaaacacaaaattacattgcaacataaacataatctacttgaagatatatgtaaaatgtgtttatatgagatagcttaaggatacagatatatttgtagtagatcattaattaaccaagggcggggatagctcagttgggagagcgtcagactgaagatctgaaggtcgcgtgttcgatccacgctcaccgcattttccttttttttttgttttaccaaggcttcactttttcttttcttttttttttttaccaaggcttagttcttcagtttttctgcttagctcttttgcatttttcttttttttttaccaaggcttcactttttctttttctttttctttttttttttaccaaggcttcagttcttcagtttttctgcttagctcttttgcataagtgtttttgtgtgttttcttttttttaccaatggttcagttcttcagtatttctgcttagctcttttgcataagtttttttttttaccaaggcttcagttcttcagtttttctgcttagctcttttgcacaagtgttcagtagtcactggtcttcaagggatcttcagtgctccagcgatatacatttggactttgcccggcgacaactcgttatttccgtgctactctttataagttcgatatcgccaccgttctcatctgaacaagttacagtaattacagaaacagcggcagtgtgttcgaaaaaaaagaaacagcggcagtgattttgttaaaacagttgcgattataattttttcagacctgatttgctatcagaatcgacaaactccaaaacttaggtccaaagggcgaccaaagcgaagctttacaccattgattccgagggtgatgcaagcatccattgatcgagagagagagaaccaaactgtctctcttccattacaccacgcagacttccatgcccagtaacatttggcttgcccaaagaatcgagcatgctcgaagtacgtcagaagctcagagcaaaataaaaataaaaaataccagtgtttcttccaaaattggaaacgtttgattccagagatgcagtaaccatgacaaaaattgaagtacaggggaaacatggagaacagaaaagggaatcctttcctggatatttgatctgtatgagcaaaggatgagtcatcagctgctcgtccttcgtcagcagaatgctctcacatctgtagagttacaacttacaagtacattgtctcctacagctacttcgcctattttcacattctggacatacaaaatacaactgagcaaccggagcgtgctctacttctgccaccttttagatgccctcagtgaagagcctcctatcaattggctcgattgaactctcgtttgatctgataatcaatatatttctcattaataaccaaggataattaattacatcatgtgcaggtatgaaactatttggacagtgcactaaaaatttgaaaaatatctttaaaaaaaactaaaagttttacaataatagcaaccacatgtgtatgaaattatttgcacggagcaacatgacctttctattcccaaaaaattaccatttgtttttgaaaaccaagacaaagttggcaagtgtcttctgatattggcatgataatttgaactcgttgagcacatatactaaaactgtgtaggcagtacagtaatagttaccaatctgttgaagtaaattagtggcttatagtacatacttggagtcttcggagcagtatcctttggttttggtctggatgttgctggttgtccattctttgtgagactgaatcgagctattcgtgatgaaattctcctactgcaatcattaggaggtaccaaattaatgcttcttcatcacaacatgaaaagataatgttgcataaagaataataagattatattacaacaaattgagtaaatgtaatgagagaacaattaatagctgcaagttagtttggtgtaagtgatatagggagatgagagtacatggaggtatctgcggttctatctgagcaggaatttgggaaaacgctggcaccggcagcacagccaacagaatagtcggttcctccagagaaaccatcttctgatgcattgtcctcaaaatctgcttcatccaagcatgttggtgtaatgtcagtgtatgaagtaggtccaccatctctgttcacctcagcataactctgaggatctgatagttggctctgttggtttgttgtgattgacaatactgatcttaggtcagagttagaattttttggcatgctagcaccatttatatcgactgcaaaacttggcgatttgactttgtctttcatgagttggagctgctcaatttccgtatcttttcgtacaatagtgtctttcaaagatgcaacctggacaaaatatgtgaagtgacttttcaagttgggaggacaaaatatttatagtaaaaagaaggaattgtcattataacagaaacatgtctcattggcaagcacaaaccataacatgagttcaactagaaatttacaccactagcagcatatagacttgaataattacatagaacatcacaacaagtcaccattttgatttgtttatatttttttcatactagacaaaaaaaaaggttgtttgcagcaagttttctgtatctcaagcctaatattgatgataacttgtattactattgggagaacatttgttcaggatcaagcctaatattgatgataacttgtattactattgggagaacattcgttcaggaatagcttggaaattgctgttgttttactgctgattctttagaatgtttgaataaatttgtggaaaatatgaagttgagaacaatggccatgcttttgagtaaaacatcagcaacattctaaaatagagctctaagttcaattagaaattacttcagtatttgcaagaaaatttgttgcatgaacatcaaatttacacataaggattccccttcttcctagaactaaatagttcagcaattatgtaaaacaaaagcaaagaaatttcagttaatgatgagtcagacagaacataaaaagcaagaacctgttccagcagctcttttatatcctttccctctttattacttcttgcagcacctaactcaactccagaaaccctttcagcaaactttagagtgcttatagtctctgaatatgactcaacatcaggatttatttgaacaaacattagtgtctttgcttgtccacctgcaagagattattttataagattatagttacaaaaaccataaatctaactccacatgcatgatttttcaactaaataattgattacctaaagagctttgaagaacttgtgttagcttgctgttcctgtatggcacatgagcattcttttgcgccaaagcaaaaatcacatcacccaaagcagacagtgatttattaatgtgttgagcctctttcaatctatctccagttgcttcagaccgctcaaccctttcactccctgcaagatcaataagatgtaggcatcctctagaagtggatccattcttcacatccaaccctcgaacatgtacagtcagaatactgcatagaataatgtgtttcaaaataaaatcatattgagagcaaaaaagatatagtttaacttcagttatcagtcactcaacctatgagaccgactgctcctttcattaagagctgttgaaccaacagctctatttgcctgtccaatttccatcaagtctaaaacatctgatgttgatttaactgggtgtaagctcgcatctgggacgacaagtccattaggttgagaggtgctccatatgccaagtgtttttttatgttaaagagaacacaaccattctcttacaaactaaaaacataggtaccagaaatataattagaaatgacaatttaagtatgaaaaaggatatcgtttctgtgcaatatcatttgacagaagatcccgcacttgttcattgtatatctcaaccatctgaactcccacctcataagagaaagcatttctcctacttagtgagatatcaaataaatcatttaaagccctgtaattgacaccccaatcttgttttgatgtgctgggtccactctaagaacaaaattattggaatagaacataagtgatcaaaagttagtagcagtgcatcatgctgaaccagtacaataccaataaaaaagatcaatataagttaacaacaatgctgagccagtaaaatatcggtaaaagttagtaccattgtgtaagtttttcctgaaccagtttgaccataagcaaaaatacaaacattgaatccatcaagaactgatcgaatcagcggttgaatgtccgagaaaacctcagctgtaaattgaaagataagtattagaatttatttgcacacagataagcttataccagatttccattgtaaaaaaatataccttgagaagaaaatggactaaaaaccttgttaaacttgaacatccgatgtccatcctttccttgtttaaatggatttgagatcaaaagctcaccattttcaccaatgtaatcaacagtggttgattttttatcttgaccaggaagaaatggtcttacacgacaatacacccttatattacctaaaagaggcagatattgaaatggacatcaataggtgcattctgaagctataaaaaatttgagcagtaaaaaaccttttagttcttgcacttcattgaacaacttttgattttcagcaagaactttgtggtagttttcagcagcatcaaccaaacactttaaaccagagcctgcaaaagtttaagcaacacaatgttaaaatatacaagtaaatgtttactttatagattatacaacacataccaaaattggacatctcatctctcaactccatttcaagggcatgcatctcattttttatagaccatgatgatatccttaaaccctgtcattttcaagcaataacccataaataagatgaaaaacaaaaggaagtaagagcaagttaaagataaacaaaccttgacatatagttgttgactattcatgtatttctgaaaaatgccctccttcttattccacaactgtgattttaacagggaagcagcctcaacttcttcaattttcttgtttgattgcactaaaagagactcaacctccttaattttggtagttaaatgttcttccatttgctttgcggtcagttcgattttctgaagttgttgctcatgcatgctagtcatgacttccatctctttcttaagactagctattgtgttttcagaaatttctttttctttcattagccgagcaacatcttgctcaccaagtttccttttctcttctatttttgacttctcttcctgaatgcagaaaaaaatatataatatgttatatagttgatataacagttgccataatttctaccggtctaggcggtaacaaaattaacatcaaatatcatccttatagcaataatatatgatcaaacattatatagttaatatttcatttgtttatattattacaataatataaagatagcaaatgtactataaagatagcaaatgtaggaaatcaaatcttttcagtgtaggtctaaccttaattatctgaagccggtttatagccatctgaagaaaggaagtccacaatgtcatcagttaggggggagaacttctaaattatgtaatttattataacaatgaaaatactgaatatttacctggttttcttcatttgtcccatttactaatatttcaagtgctttgatttttgaatggtatttatcttcccttgtcttaatgatcacattttgctgcaacaagagacatctgattcatgagttgcatttattagctaaaggatatataggcttcagggaaaaaagactctcttacacttcttatgtgctctgcttgaatacaaagacgacgctcaatttcttgaactactttcctcagtaggtacactacacgctgaggtgaggtagataaatttattagatttaaaagataccaatgaaaaagagagcatgcaattcagaaacacagacatacatgtggtatttctccctttttcctttcaatgctttcgtccaaaatgccattaacgacgctaagaagggattgggttggtgcattctgtgagaaggtaattactgttaggaaaggaatagcaaacaacaagatagaacaattcaacaagcataagcaatggaaagttacatctaaactgttagaatgcatcatttctgaaatcttggcagccggaagatcagcataggatccacgttttaattggaaaatctcacgaagctttcgtcctgcagcatatatgacgagctattataaactaaaaggtagggaacagtagtgacccagatatagattatacacaatagcttgagttacaacttgcagcaagcatacacgttaacaagtttgtagtttggagcttggaagccatgttgaatttaagaaacgttaaagtaaccaccccaccatgatcaaatctagcttcatcagaaagtttgtatgtccactaagattctatgttgaacatagttgtccaatctacagcttcaaccaataaatcgttgaccccccacaacatggccaagtgcccaatcacaaatagcccatgtcattttccctttgagaatttgactatatagtacagaattctagagccaaagcgtaaacatgtagggacttcttttcaactaatatttttaaactatgcaccaaaatagtcaacaatgtgcataccattaaagatgggagttttctgctgagacttagggtctggaaggccattcctcttgtcctctccaggggatgtcttcccttgtgccacaccagggacaagaggttcaccagtttctggaactcgccattttttcctcaaaggagccttggaagtaccatcacgtaatccagaactcacactttccctcagaaccaagaggcagtccactaccccagacattgaaccctgccatggtcaagttatgagttaacataagcaatcaggaactttggaaatggtaaacattttttttaatgaaaaactgtaacatcttacatccacaaatagtgaaattggggggatttgctccaatgcttgcatgtttccgtcaattgcgagtatttaaaagcatgtcattttaactatgcggtgtcaatcctttttgcagatttgcttcctagatgacagcatccggcatagaataaatctagaactaataatctaacctccttttctagcagtcaacaatctatcacagaatttgagttattactatagtgcaattatggttaggcgatattaagaggttattcatttattcctcacagattataatgggaaaaaaaactctagaaatatagttctacttatatgtgtatgcatgactaaaacttgtcagcaacgcaataccatgagcaacaaggccaagcaccattatattgactagcacaataaggctagcacgcaaacatttaagaaaactaatctcaaccatttgcatttcagaactcatttctgcaaaccaactacatagtatgataagaccaacctcacctcctcaagatctttaacactgaagcctggcaaccccatatcagcaaccactgcgaggaacttcttcacatggcctgcatgttgatctgacgatgcataagcaccccacgactcctaaacaaacaaaaactcacatccagagagcaccaatatcaacatccacagttcaacaaaaaagccaaaattcttcaagcccaaaaggacacacctcgagaacaccaggaatgagtgcgttcacgatatggcacaagaccgtgccatcactgagcagctcccgcaactcgtcatccgatgagtccagtggcaaacagtactccgggagtaacgcattgagccattcaatcacttccgcacgccgatccgctacaatgttttttgcaccatcatgtaaagcaagtatgagaaattaaaaatcacaactcagatcggcagctcggaactgatatctcagatcaaaaatgataataataaaacttttgaaccctccggcacaaaaacgggttaacacacggttcttcttcggcaaacattttactatcgaaacagcaaaaaattcaaaatccagcggtcgccagctaacttcaaacactaaaacatagtaactgaacaatagctgggctggcgatagctagaagcctagaaccagaggaagaatatgcacgaatcactgaggtcgctgagctgaattccaactcgaaaaccactaaatcagagcgcagaaaaagcgggttcgcccatcgccgaccaccactcctcctcgccacaaatttacccccaaaatcacaaaaactcgcagcaacccaaacctcgagcagctagggctagaattcaaactcccgagagcatccggatcagcggggcgcctcacctgcctggagcccctcgaaatctccgtccacgctccccattcctcgccgcccgggccggcgcacggcggcctcggctcagatcgaggccgccgccggcgagattgggcggattcgagctcgggcggcgccgcctcggggcaatgcgggggctggttttgttgctccgccacgcgtctcgtcgccgtcgtgcgcggtgcgccgccccccggccgtgctttgtgttgtcctctgtgtttcgcttttggttttggtttggtttggtttgtcctctcgcgcaggtcgcgggtttgttgttgttcgcgtgagtttttttttttaatttcgttttcaaatttgaaacttcgcttgcgtgagttttgctctggtcgccgttaccggcaattcgaatttgttttaagaatagtttcgttttttttccaattaacgtacacaaactactacacatgtaatatcacactaatacactcatgaataaatcccctaacacagtaacacacgtttaaagatctaataatatgaacaacaagatcttaaaaaaaagtaacacacgtttaaaaagagaagccaacgataaaggtatgtttagttcacactaaaattaaaagtttattgaaattggaatggtgtgatagaaaagttgaaagtttgtgtgtaggaaagttttatgtgataaaaaagttgtaagtttgaagaaaaagtttgaaactaaacaagaccaaatttctaatattgctaacttgtatgcgcaccaagatttaaattttggtgggtaaaaaccccaaccaaattacttcgatttgctttcgatgctccccatatcaccggtggtgctttccagttagtttggattttgataatagaaaattttaacctcattgaggcttgactttgaagcattgaaaagcgtggaactattcatagacatatttttgttctttgttctttgttcctactatagtctagcataatttgaacaacgcaagaagtactccagtaaacaatttctttgttttggaatcctcaaggagccaattgggtagaacatctttatcggaaccaatagtggtacgcgtttgaatccctgggacctgattaagctccaatattcatacgacgtgcgcggcagagtgcagagtccaaactcaaacgccgaatcctgtatcaattacaaggataccctttcccatcgtgcaggcgacctgagtttttttttctttttcttttacacatgagccctaccttaagccggcacgccggagagttgacgtcgtcaaacaggttttaatcgcactcccgccaaagtggccaaactggctacctccgattgattcggtccgtgaagccgcaagccggtatcgtgaaaggattttttttaaattactttttgtactttttaatttttttattttaaaaaataaacacttctgaaacttatttacaaaatctagacattttgtctatattagaacagtgtgaccaaataacactgtcacaccgttcaaatcttgaaaataagtcttggaaatatttagttttaaaattaaaaaattaaaaagttcaaaaagataaaaaaagatctatgaaagccggcggcgaaatgctactccactttttcccatcgtgctggtgctcactgctcagcgagagcttgacaggaaatatttctgaattcccatcatggaatgaaccatattggttgtgtgaaagtaggaactactacttgcatatttcggccggttttaggtcccaactttttcttcaaaattctaacttttctatcacatcaaaactttcctacatacataaactttcaacttttttctttgaactttcaaatttaggctatgtttagttcagcgcaaagtttggattttagttgaaattggagatgatgtgactggaaagttgtgtgtgtatgacagattgatgtgatgaaaaatgactgaagtttggatccaaactttggatctaaacacagccttagtcaaactttcaattttaacgtggaactaaacacacccttaggttgtggttttcaaattttccgtcgtcagagtttgctccggtgtcagtaacactgtaacagagctgtaaaaggagccaaacacaaaatgtacatcttgagtggttgcaacttaaccgccaagattagaacatagctcatgcttttgcatataggagtacttatcttagtagtagttagctcagtcatgtccatcacatagatatcagatacacccctgtcattccagttagttcagtaatacctatcacactatcagggctatcagtcctgattaccttcataaacttttgtcggccgatcacactatctccagcatagcaatggtcaccgacacagccggacagtttcatctgtggttatagctgtatataaacccatcgcaatctggacaacagcatggacaaaataagggcaaagagagcaatctcatgatgatgtagtaatcttgatcggttttatttttgtcataaacaagcagacatgcatgtcacaactcataagtcgtagcacgtctatatacgggttttcaccgtagtggcatactagaacaacggcaggctgctcttgtgtaccagcctagtcgcatccacggcagcagcagcccgagaccaattcaatagccggctgcttatagcttacttgcccgcaggcctagtcgcggtcccagcaggaccagcttgtcgcaacagctgcacaaagccacgttgtgtttattatgagataggtggagaaatgaatggtttattagccataggtgtgttcagtttgttgcagaaagaaaacttaccaaactttggcattaccctttttttttttggtgaaatactccctccgtttctaaatgtttgacaccgttgactttttagcacatgtttgaccattcgttttattcaaatttttttatgaaatatgtaaaactatatgtatacatgaaagtatatttaacgatgaatcaaatgataggaaaagatttaataattacttaatttttttaataagacgaatggtcaaatatgtttgaaatagtcaacggcgtcaaatatttagaaatggagggagtatatagtaacattaggtggtatttggtttaaggccttacaaaattttattttggtaaggttatgttggtaatgctatgttgtcttgctagaatttggcaagcttgaaaatggtaacgaggtgaacacaaccttagtaacaaacatatattgccattaatgaaagctgggtacgaagtggctggtgaagattacctggaagtaggactcccacttctgcctgaggacggcatgctccctcttcactttctggaaggatctcgtgcaactgcataacaatagtagtagagatctatcatcatacgaaataagccaatgaattgaacaaaaaaagatagacggcaagggctaattccagttcactagcaggaggaactttcacccatcagaatatgcatgtgtaactaggtactaacactcataacagtgagggctgacaggtgacacttctacatgcctcgactgagccatgccaagtttgacaaggtggcagactggcacttagccatttactttgttggtttttccgtaatgatcaggccgattggatgctctggttgccacagccactgcagctgcggcagttgaaaccagctgcagccggcagccatttacaactgccacagccgctgtggctgcaagcctgcaagcacagacgagcacacccagtaacagccatgggcatgggaaaatcacaatgctcaagccatgaacttttaccatgccataccacatgtcataaaagtggagagagagagagagagatacccttcggcgttttcttctccacagaaattcctgaatgaagtgcattcattcttcaccctggaggcaccaatgctgtgacaaaccatatcatgtcaagcattgataaagtacacaaaagattatcacatatgtataactaagcaaattgccagcttcttttatcatgtcaaataatgaaataaggagtgagcatgtactcatgatctaccagctgtgcacctgcaaggctgcaccaatcaaagcaatatgggtctctgtaaatatctctgtttaacatattccctgaccgttcactagaatttcacaagatattaagcaggccattatttgaaggtcttttctttgttgtgtgtgcgtgtggtgggagttcaggtacatcaggcttctggaagttctccttcagcttgtgttcgaaactgtcatatttgcttccattgagaaaaggataaacttaatataaaaacctgagaactatgccagttaggaaagttaagctactttcttgaagactgaagggagaaaaactaaggccatatagtttttatagggtaatgttagttagctttttatagattcttgacactctaaattagatttagtgataaaattattatcacatacatagtctttttgaaagatacaattgtgtgcagttaaaaacttaagatttcaaattaagtttacctacagcatatgctcaaaatatagaaaatctaatcatgttcattttcacccaacaaaccgaccttgcgatgtgtggctctccttctccaagcaatgtttttctaaacaaagttaggtggtttgttggaaaaaggcaggattattttttcctagacaaatgggtaattgcactaggcatacactttcctaaaaaggcaataaaattcaaacaccctgtaaaagtccatcagtgccagttccgtcaaatgacaacatggagatctcacaagaaactgagctgaggcttacctagaacagctgcctttcaattgctgcatgtgtgtgtcccatctggcgaagtctttcggatgcttctcactgtgtgatgttagatattagtaaccaacaataatgctgctgaatgtgaaaagataatcaagacaggtctagtttatgaaattgtcaccacttacatagcttgctcaaaattcaacattaccctggttgaatccttaaaaaacaaggaaacaacctcctctgcaaaatttggatttgcttcatcctgcaaatcctcaacctgacaaaattgctcatccaagtaaccctgtcaatacaaaacgatttgttaaaccagcacacttaacacatgttaaactaagataaagaccagaaaagagagttccgaaatggtgaaaggcgttgattttaaagcatttctttgctaactggggtggggataagtacgaaatggaatgaactctacagaaatatcgataacccacttatattaatataatgtgcttcaatctgattctccttagctttgttttcattatctgtgtgcaatagtgtcaatccatggtatggcaattaaaatggcatgactgtaaggtgatgtccatcaaaacactgtattctatgtcttgctgaatgataaatagcagaagaagatatagcaaaaggactgatggatatatttgcagagtctcagatatgcctcaactataatgcttgaaatttgagatgaacagagcacaagcctgatcgaagaggctctttttcaaggaagctgcttgacgtcgcaaattaccgtactccattcacaagtattgaacagtcaggaaaaaaatgaggcgaagtgaagcctttaaagtaggagtcaatcccaaaaatgaatacacaggttgccgatcacctaagttacagaaagtagaacatgaggttcatttatatagcccaggagcctgttactattccttcaccaacataagtgaagatattttaaagttcgtatacaagtgagttatcccagggtgtgcaatatctatccacattttagacagtgacttgaatagctgcagattctggagatactttataggatactattttgtatatttggtgttcagaaatcaaaattgctcatctataactaagtgatcatttatagaggctacagtacaaaaatattgtcagtatttcagttgacataggacccagtattataaaatccgcccattaaattttatagctaaattctactaaaaattataaaactaacaaaaggatttgtgatgaaaaatacattcacaccattttctaatggtcaactagatttttaacaaattatattgcaaattactaaagtatctttcccacatcaaccccaaccttaataatctcggttatttaataaagatccaagatgaaagtatctaacctttgtagttgcttttagttcactcagtttctcattcaatgaaaagacaaaattagtgcctctcggtatcacataattatgtagaagcatgcaagcgacaacttctgatatgtcgtaagaactctttcaagacttgatgcatcaaacttaatatctcacaggcacaaacaaataaccgtccagttgacaatttattttcaaggccataagaattcacacatgcagggcttagaacaagaataatcatttttgggaaaataaaaaaaatgaaaactatgaattacttcatctgatataatgttttagttagtaagtacctcttatattcaaataacatatgttgagtccaaatatatgaatcataataactcctaaaataagaaattttctagggtgacacattgcaggaacaatcaaatagggaaatgatactatcatttttttcacctcaaagttcaagcataatgcggtgataaaatcattgacaccgatgggaggattataataggccgaaaagattcttactttgtacacatcaaaaaaaaagttggagaaagaaagcgatttcaatagctcctttgaagttacaaacaaaattctctcaaatcagtgggccacgtggcaaactagtagcctttgcccttgcagaaaaaacaaagagtatcatttaccaaaaggtgtaaaataagttcattcaatgattggtcgaaagagtacattcaatcacatcttgataagagaatctgacgtgggttcaaacacaaggaaagtttcaaacatatcacaaaagcaaattctaatctatgcagatcaaactgccatggcagcgaatgataaatgaatggggaacagaaatagagtacatgaaagctagcagttgctacctcccctggataacgggtaatgtgtttaaataaagggacaatggcatggctcactattcatccttacagtggcatcgctctccctttagctacgggacattctcatgacgacatctttctacagaacatttcaacctcccaccagtgacctttcccccccaccccccaaacgaaaacatttcaacctcgatatgcagcaagcagtaaaacatctcccaggaccagccacacaagcagagagcaataattgtatttcctgtaaagatgttgaagatagtacaaaaactacaaatacattattcacgtattgcaattctaaacaaaaagcaacagtggagtattgagtcaggaattctgctatgaatagtttacatataatgtcacgacagcaccttagcacacagaattatcaatttacttactgttcattgaaacaataatcactgcccaggttttggttggaattttaatgaatgcttatctctgaagctattatcctgaacacaattcctctcagacgttgatttacacctgcaacatacaccatgtttattatagtgggtcaccatggtatgataagattctctaattgatgaaccataaacatggcatatatatcatgttgctaggtattcataatactcttcaacatatataacaacaaaaatcagtaacttcctagatataatattcatagtatcagcacagcacacacttaaaaactctcatttacattgtgttccaaacatgtttgttttattttctttgtatgcacacaagcttgcttttgctactataatttcaattctgaatatgaatagattatgtatgattgatagccagaaaatattccgtgatttgcaacaatgctcgatgttatccattttaacactttgtaatgacctggcatcatcagattaacagtgactgcaaacatcactacggcagaagtacacagatgatgggtgcaacccttagcccttacagccttactcagggggtgnnngnnannnnncnnnnncttttnnnnnttnnnnctttncccctttttctggggtccaacaattatatggttgaaatgttgaatggacaactttttttaaaatataaattttaggggcataccaactttttgatgaaacttgaattgatcatggtggggtgggtactttaacggtttttaaattcaacatgggtttcaagctccaaactacaaacttgttaacgtgtatgcttgctgcaagttgtaacttaagctattgtgtataatctatatctgggtcactactggtccctaccttttaggttataatagctccgcatatatgctggcagaaaaaagctttctgaagaatttccaaattaaaacggggatcctattcttaacctttcggctggccaaaatttacaaaaaggatgcatctttaacagg

SEQ ID NO: 90 - DNA, 11256 bp, Oryza sativa
  unsure (1)..(11256): unsure at all n locations
tggtatctaaagagggatacaggccaacccggagaaaatcaacgcctttctcaacatgaaaccgccaagctcccaaaaagacgtccaaaagttgactggttgcatggcggcgctcagccggtttgtctcacgactcggcaagcgggggatgcctttctttaagctgctaaagaagactgacaatttccagtggggacccgaagcacagaaagcctttgaagacttcaagaaacttctcaccactccaccagttttggcctcgccacatccgcaagagccgctactgttatatgtgttggcgacctcccaggttgtgagtgcggtcctggttgtcgagcgtgaagaggaaggccatgttcaaaaagtttaacgtacaatttatttggttagggaggttttagtgaggttcaagtnaagatatcttnnggtnncaccccctcagcaatgcatacatatcatgctgctaacgatataaaaaagctgacacaacggaatccataactacatagtagagaataagaataaatacaaggccccgtttagttcccaaattttttttcccaaaaacatcatatcgaatctttaaactcatgcatatagtattaaatatagataaaaacaagaactaattgcacagttagggaggaaatcgtgagacgaatcttttgagcctaattagtctatgattagtcataagtgctacagtaatccacatgtactaatgatggcttaattaggctcaaaagattcgtctcgcagtttccaggcgagttatgaaattagtttttccattcgcgtccgaaaaccccttcctacatccagtcaacattcgatgtgacacccaaaaattttcttttcgcgaactaaacgggtcccaagctgaggatacgctacctccttttcgatgttttgattccttgtctgatgtggtggcagccaatccattctttcctagtggcatccaaattggggacaaaggtgcaatgatgcctgcacaacacaaccacacaagtgagagttttggcaggtaccgatcaatggataagagtctcctagcagccgatttccgttcgattgaagacaaaatcagcgtggacgcggatataatcacatgacatcgtaaactccaaaacaatatctgaacagttcgcttggctaatcactagccaactgcaccagcgcgacagatgcaaaactagttcacgccaaaattggaagtttggttgaaattggaacgatgcgatggaaaagttaaaagtttatgtgtgtaggaaagtttcgatgtgatagaaaagttggaagtttaaagaaaaagtttggaactaaacaaggcctaaacagggtacaggggtggggacttgggtgtgttgtggtggttaccttccgggttccggcgcatctcgacggcggcggcggaagactgcatcacccgcggtgagcactcatcgccgacggatctcactgctttcgcgctccccaactctacactctggtggaatggtagagccaataggccatggaaaaatacgattagggagcttgcgcttccagcggaagagagagcagcgaggagatgcggcgactccggtggggaagaggctcatggcgaggccgcgacggcgaggcggctgtcggcttcgccggacgagcggcgggaccccgggagagggagatcagagagccaaaatacaaaaaaaaaaaaaaagaacggaaacgaacacaacgtggccctctttgcacggtccgatgcggatcggagcaagggcccaagaagagattagtcgaggacgaataaaaaaaagagagagagagagagagataagtcgaggacggagaaattccccaagccgccgccactaaccctagcttccgccagcacggtattaaaacccttccgctctaatttcctcgcaccattgatttttgttctgtgcgttcgtttcgatccaagtagttccccaacaatcctgctactgcggaactgccgattttgctgtcagtttattttgatcgcaaacagtaaatattagccgagcgtcgtttggcattatctttcaattccatgcttctttcaaatttgacccatcatgcatgttatcaaaatttactagagacccagaaatatgccgatgttctgtggtgacatacctatgtcctgttttttctagttagtttgcatgtcttgaaataggcttgtggaaagaacttgtgtttcgagcttcatgttagagagtggtgggatggcaccctctaataggccacttgaggtctctaattcttttgttttcccagtctgagtcagatctgtgtaagaatcttacatttctagtaatagaaattgggggttactcccttgttttaaaaaaaaaaggaaagacccaaaaaaaattcactagactaagggcatgttgggatggtagccattgccaaaattttggcgaagtgggtttgtttgatttgatgtgaatatatttggagctttttttaaaccttgccaaaatattggcattgcaattttccttgtatcaaaccaaataagtgccttgccgttaccaattttttgtgttgttgatttaggcacataagatccaaagtattcatcgtttcctgcagggtgcagatcaagttccaaatcaacctgattggtcctcaactttgagggtaacatgatgcgagacagcaagaggacgaggtccgcaccacccagagaaccactggaaatgacagaggacatgaccccaagaagcaagaggaggaaatttgtaccattcggagaaggtgcggtgctacctgaggagatgctgacggaggtgttcctacgactgcccattaaatccatccttcgtttccgggctgcctgccactccaggtatgcaatgttgtcttcccaggaattttgtcaactctacatcacaagaactgaggcaatgccaccacaacctaagcttctgtttatctcgcctacagcaaatttcaactccactgcggtgtacacgtgctcgccatcgaagcccattgatgacctactgttcacactcgatgatgtgcgtggaaactatgtggaagtggcaccttcaccatgccatggcctcaccctcctgtataatgctgttgcgccagcttactacgtcttcaatgcaactacacgggcaatcacacggttgccaccttaccaagatgtgattcatgccactgctggcgttgggtttgatgcccggacgaaggagttcaaggtggtgaggctttttcgaggaaaatcgcatgagatccattctgtaaagtgtgagatattcattcttgggggtgaggaaggggatcattggaggcctaccgctggtggagtacctttcaggttctgtagttttgctctttctgctatccgcaatgcagtggcgaacaaacttcagccagtttttgttaacggatttctccactggttgatcaacccctcgtttttactcaaagcaccaagagctgctatcatatcattttctctcactgatgaaaccttcagatggatccgatcaccaccctttgaggtatccagagtgcacttggctgagcttgatgatcagttgtgtatggtccgagaccttcgtaatggcttgcctactggtagcatgtttgaaatttggaggctgaatgactataactctggtgattggtcgcttgattaccgaattggtttgacagggaatttgccaagagatttacttgagccacgaattgtgaaagttattggttcctttggtagctacagatcaagcaagaagataatcatcgctacatctaagcacaaggtgtgtgcctatgatccagtttctagaactcttgaaaccattgtctcaatcatggtgacctgcagtgcctatcaaaacgagaaatctgatattagattcagttcatttacaaagagttttaccccagtgcataggacgaggaaagagatagggttctctactcccttgtctaaggctactaaggagatcctactccgattaccagctgaatcaatcttgaaattggaacttgtttgtaagcaatggcgtggattgataaagaatgaaggttttgttcatgcatactttgagcataagaacatggacaggaggccaaagatcatgcttgtgggtaagggctctgaaaaatcagttttcaactttattcccttgagtaaatggctccaagaggcaaatctaggcacaatgtttctggacaaaaaggtggtttgctccaagccttgccatgggttgaatctggtgagcattgagatgaaagactatctgttcaacccgtgtacaggttaccgcatgatctactagaacagagaccatcagctgtaccaggaatggtccaatttgtctagtgatcgctgcaaagactacaatccttttgtagttggcaataagaatgttggtatggggttttgccaggtgactcagagtcatgccgttgtgggaattttctattactggaaaaactacgaatctcatcagtattacttaacatgcattatatggagttgtagctcccaaggccagccactccccgatccacctctgcctgtgaatgacatgccacctgtttctctggatggtgtgctgtactggatgagtgaaccaaggttgggtcagagttatgagcgggccattgtcttttttaacattgccgctaagatttttgatgttatcccttgcccttcatgcattgcaatctgggacagcagaaatccatgtcacgcatttgtggtcgagcttcagggaatgttgtgtgctgtcctttcaaatccagttgcagataagttagatatatggaagtgggatcatggtctgtggagtatagcatatgcaatcaatttaaaattctggccagattattcccttgcgacaaatgttgtagtgcctctcgcagttgacccaatagatggaaaggttctactgaatactgggaggaagcttggtttatataatccatgtgagcaaacaatcgaaaacttgcacttgatcaggcgtcgcagcaacagaaccctggagttaacagaaatttccacattgccagatgccaagatgttcctaagaagttctctcagtggaaactattattggctccgtgcgagaagtttgctaacccttcaagtgcttcatcagggaagaatccattttactccagagaccaatctaaggagctaaatagtgtgagtcaaaaaattatgcctctggttcctatgttgtacgaggagggtttagcttactatcctacaactcctaaattgagagtattgtgcgattgaagtgttgtcatattatgggcctttttcatggctcttgttctgcctctcttatagctggagcgtaactaatatagatggccataaggcccgaggcctgaaggcccggcccatggcacggctttttggcccggcccaaagcacggcacggcctgacttggatcgggcccgtgccggccggcccgaccgccgggctgtgcctgggcctccccatcggcacgctgggctggcccggcacggtcgggccagcctggcacgatgggccggcaagccaggcccggcagacaaaatatagggactaaaaatagacataaatgtcactgtccaaagaatagggaccttaaatagacttattttagttatttacatatcacagcccaaagaagagggacgtaaaatagacttttttagctatatataagtcacagcccaataggaggaaggaaaattatacttattctgaggaaaagcacgatggcccatcgtgccttcgggccggcccgacacggtccaaggcgtgttgggccgtgagtgcggcacgtgggctggcatggcatggcccgatgcatcggtcgggccgtgctggcccgacaagcctcggcccaggcacgaccgggcctgggccgtgccgtgccgggcggcccacatggccatctatagtaactaaacggttccagctctatcaaaaggaagtgaaattagttggagtgctctcataaaatgaattattagataggtggagagttgggtttaggccgctttcgctccaaatccaacttatgaaattaaatttaagagttgaagctcatatatagtagctaagattttataatgttaaaatgccgtggtatgtcccgttaaaattgtagtcaggggtgaagctagcatcaaaacaaggggggtgcactatcattgagaatctacaaaatttcagtacaacactgtatattctaatttttttaagtgagaaattaggaatttaggggttcatgtgcatcccccccccaaacactatatagcttcgccactgattgtagttgtcatttcaagcccagcttttatagctcaaagaccttaacattatttcctactccatcactgcaagaatgtaaaggcggatgtgaaagcaacttcctactcaaatgcaagatatttcctattttcagctttctcactcgtactacgtattttaacgccccttgtttcacttacatttatacttatccgtgagatttattaataaaagaataatttatgtataaaacttctatatatctgtccttagcaattttaaaaagtaaaccatgatgaaaaattcacaaaattaactcgaaagttaagttttaaaatttaaacttcggcttgtaagaataagcgatagaatggtgctgtagattatatactcgtgtaacgatgaggtttcattgcctgagatcgagtgcatcatgtctcgagcagtcaaatattagagtttcctttagcccaagtcataactagatggattcacagttgatgagctgggaacactgggcgaacggggtgagaacggtaacggtaattcccggctgaccggcgtttgtttctgactttctaccggccgagccatatgaaaatggtaatcgaccgaaaaaaatatgaaaatggtaaaatatatggaaatggaaacggaaatggttttattgttttaccgatcgtttccgtatttaccgtattcttgtggaaattaccgtttcttataatatgataattaccgtagttctaaatatgtcgatatttatagggcatgtctctacttgacccatagtttagaggttgaatgactcttcaatcaaattcctaacttgagtgcatggctaaaatggagttaatttatgatttatatagtatagcttgaatttatttgtacatatatcatacttatgtaaagttttctatagtttaatgttttcatatttgttaccggtttccgatttgtaccgacatgtttccgtccgtattattccgttttcggttttccgatatttccaatatcgttttcatttccgactttaccgttttcgatatcatttctgagaaaaaaatgattatggaaatggttgaggtgttttcagatctttcatatcgtttccgaccgttttaatccctacgcgaacctaatactcctcctagtagtcaagaaagtcactgacaaaagctccctacagaaataaagaacttctgtaattaaatttctttctatagaaatatctgaagactttatctaggaattttagatagagatttttactataaatttagaaatcttttttaacgaaactttctatagtgaatcctttcacaggagttaaaaatagagtaaaaacctctaatgaacattttgaagaaatttctattaaagcctctgatgaaaataattctctaccttaagtagaacaaacaaattgcatttttaagtttcaatcagctaaaagtacttcgtctatctcaaaatataagaatttttagtaagtttagaacaatttagggtgtgtttgtgtttggtttgagggatcatgaatgggagacggtgatccaacttttaagcaacaatcaaaaacataccatgccccttattgaacaggcatggcagatggcatcactcttgatcggtttaattgtcggcccatcttgactggtgggctaatctatctataccttaatagttacacgctcgcgcatatatacatatatatacatatatacatatatacatacatatacatatacatatatatatgtatatacatatacatacatatacatatacatatatatatgtatatacatatacatacatatatatatatatacatatacatatatatatatacatatatacatatatatatatacatatatatgtatatatatatattgagggaatggttagttcatatctaataattggatggttacaaccaaatacttctacatagaatgccaaaaaaaaagtacttctacataataaaatttaaacgctagacatcctaaaatattttgaaacatagtgagtaatattaaaaacaaactggtaggaaatcattagctcactgaaacaagccatcgatcaaaacctcgcctcctagtcctacacccatggtctcttgatcgaggtgttcattttttttcctcaatcgcctcctacaaaacacgccggtgttgcacacccgccaatggtgtggaacgctgcttagagcagatacaatagcagactattaactaattataaacatattttaatgaaataaaagataagagagaagagcaatgggctacagatatatagtcagttgcagcacggactctaagacgcaatgtggatatgatgggtgagaccatatattaatagtatagtaagtaactattttatgaattaggtattaggtttggttatagatgaattggaggtagtagtgaactgtactattaaactttctcttatgtattgggctgtgtgggtcaagtacgcctcgctttgcgtcgtcgagactcgacaagacgagaagcgtctacagaaagctgggcctcgacccggcccagaaaggaaggaaggggaaaccaacccaaatctcgcttgcgcgtcaggccggcgtctccgtgattctccccgtcccgcggcgcaccggcaccggcaccggcaccggcggcgagatggcggactgggacggggtcccggcgagggagcggcggcagatggaggagatcctgcagctcgatatggaggagctcaacgtggagatggtcaacgacgacggctcctcctccgaggaggcgaacggcggcgacgacggcgccgacgccttcctcaggtcgggcgacgcccctccctcgtttcgccatttttttaccctctctgatgcgacctagggttctctaagtagaaactgggtcgcagcgtacttggttacctgctaggggtggtggtactgtgcatttctactaggattgaaatacgtcaacctaagaattcaattcaaccgatagcatttcctgtccgagagagtgaggatgggaggcgttagcttatgatttgatgtttgtttccctgatctcgcatgtggaggattggtgatttcagctcgggtagactagagagcgtagggatttgagggaagggggttactaggggaagccacgatccttgtcagtgtgtacccttgagccttgaccaaagtttcactttgggcatattgatttactctctgattttttcaatttattggtgggtgtgctgtgtgccacgatatatctgtagctcatggccagatacctggaaaatttttgtttgttagtcttaactatggttttgagagatttcacattgttcatttcctaattcctgattatcagagataccgacagggaaggagtggctagcacttctggacaattcacattcaacacatctctagcctcgttgcacacctatcttggtggtaaatgtcctcgctatccttgctatatgatgtttgatgctgatagaaaagaaagtgtaataagactctttatgtgtcactcagaggttgatgatacacggggtcgagtttctctcttagatggtggcacaatcctcagcttgccaatgctatatcttcaaggtaggtcttgtatgtttgtattttatttcgttaatccgcaatcttgattatcatgccagcgttgaagacacactaattagtgatcacaatttttttttcatgccatcatttctccatattattttgtctgcatgccagcccttctaagttacattcttttcttttgaactcacttgacataacctggtctattaacgtatccactgttattgttaatgttaaaaagagcttgagcaatactactatctatttatatagacttattatttcagaggaattgcacataccatttttagtcactatttcctttatattgcagttatacagccatgtgaatatacggagtactttgtagtgagtttaggacctgaggtttcttttgataattgataatttcttaatgcatatgactagagaagtggcatccaataatctaaaaggctacaagcatccctaaacagtgttgttatgtcgacatttttctgttccagtcctgcgggttcatgatacaattggatattaactccatgggcagtgaaatatattcttaattttaaatctggaacataagaacaggcacaaatccttacctgtctctctcctgactaatgcataacagtgatagtgtaaatgcgacaggatttttctggtaggttatcaagcatcaaatttattataatatgaatttgtttcaggtgttgtcctatttcctggagctaccctgcctctcagactaattcagggtagatttgtagcagctgttgagaaagctttgaggcaggtcgatgctccatgcacaattggtgtggtaggtgccagtctgttgaaattaactaattttatttgttgaattcctttccaatgacgcagtttaattttcaggttctcatgtacaagcgacacagtactcgacattatgctaatgcttcagttggaacaacagccgaggtgttgtacattttctctgctgtgcttcaagttagaatttgtttatcagttagtcattttcaccgattcttcatgtggtttggttgttttctgtgctgccaattgagcttttccgtagccagttccatcatccttgggtgatttgttattatttctacaggacacataagttaccctctcgtcacattttgtaattaagatgatctgcttaataaataaaaacatgagggagttaatttatatcattcaagaatcaggacccagtcttagcagttagcatttaatatttcttgtaaatgggacaattgaatcattcatttagaatagactgatatccaatatttcagaatttccttcacttggtcacaatatctctatcaaact

SEQ ID NO: 91 - DNA, 18619 bp, Oryza sativa
  unsure (1)..(18619): unsure at all n locations
ccgtgcnattgatttctnnnnnnnnnnnnnnnnnnnnnnnnnnnnnnnnnnnnnnnnnnnntaacagtttacggcagcatacctcctcaccagttatcagtttggatgtctctccaatcaaacaacgggatcatgtggattcagaattggattgtggtacaccatcacctaaaagcactgcaagcaatcattcagcgattgattcaaggatgtgccattcagattcacgatccagcagttcaatgagatcttctaatgaagatgggattttcatgcatgagcagttttacagccaggagctacatcctttaaaaggaagtgcagcagttcagtcaggcgagaataccaacatgggtgaggaggatttttgtttaacatcgctcagatccttgtcaagtgcaggaacaagagatactaaggagcagcgtcagtacattcttccaaagcaacattttcaggcaccattatcattttggcctcggtgggcttatcaaatgtacgattcatatgcacttgctcgtagggctgcaggtaaagtgctcccatattcatcaaactgagccttacaatgcattcttgtcattcatggattcttagcccaacgattgtaaattcttatgttttatagataccactccactagtgtttcccatcaaaaaagaacttcttattggatgattgatcgttttgagtgttattgagcatctcgctctgtatgtttattttaaccaaaatacactattgtcatttgctgcagacctctggagacagataatcacacacccaagcatggatgattacgtgagaaaaccagatcttctgtcattttccattggaagcaaacttcctgtatcagaatctgtgagacaaaagctactggagattgatggaatctcgtatcgtcttcgaagggagattcagcttctcaaggcctttaatctcataaaatgtagatgctgcaaggtaactatctaccatgtttggaattgctaatttatcgagcttctgattggaagtaatggacttattgttggccatttcgttactactttaaaagaaggtgaattgtttatggtggtgttgtatgttaatcatatgagtctgtcacccgacagctcaccattgcaattttttggacaaccccttaatttttcttgaattgcacagtagttaaatatctaactgaatacacatacacagacacacagtatatgagttggtctataatcaaggagtttaagcactgtcaagttctccctgtagcgaagttataattctgttaattggtatcaaccacaagtatttagctagttttccatataaaatggataactattctaggtcatctgtatcgtagcaatttcatttaccatgtcatggcctgctaaattatctgtatgtacatcccattttcatttttcagcagggtatgacatggtacagtttgtcgttgtagaatgctgcagctgcagcattggaagaattagcactaacataaaatcaaactacttgatagttcatattgatttgctgattaggctcatttggctgctaggaaaacaatgctccatgtaacctggttttcgttgatcataaacattatttggaaatggcgtgtagttacatcaaagaatttcaatacaaagtttatcactctgtgttgacatgatttgaactatggcagtctctcatagcaaagcgtagcgacatggtagtgatgtctactgatggtcctcttggtgcgtatgtcaatcctcacggttttgtccatgaaacaatcacagttagcagggcaactgggcttgctcttgatggcaatccttcaacggttcacagctggtttccagggtaaatctacagtttctccttgttctttgtaatcttcatgtccatcatacaccctttaactgtaaaaaactaagttcatgcatgattttcttcttgtaaccaactttgtttctgctgctatgcagatactcgtggacgattgcatcatgtacggactgtgagtccaacataggctggttgttcaaagcaaccaagaagaatctgcgaccgagatccttctgggggatccgtagctcccaaattgcagatgatgcacaagaactagatcaggacgaatgatgctccgtgtacagtagtaaactttgtgtgcccctccctttttcttatgaagttatggaaaacactttattctctggtccataggcctagttctccgtacctgagtagtggtcgttgtgacgatcgctatagaataaccacttcctcctgtgtgtattacacaaccattgccttatgctaaagttccgtcacagaattttctgaaatgtagtgttactagaaatccatagtacaagatgaatgatgatatgatcagatgtttcaagcaatggtttgacatgtcttatgagcacatagaagttggtgcttgataccttcacttgaggcaaatactcgtgctgtagtggtaattggtaaactggtactggtagtgagctagcactggcagtgccatgtttttgctatctgtactgaaattggggccaattgcacctgacgagcagcaactcaatatgggcatatggcatcctttttttccctgcgtattgtccttttgtttcagccacagtagcaattggccggtattccattgccacctttgatgagagggagggagagagagacctcacgggtggcagcaaaggcaaaggagcagcaagaagccgacagagaaagtaaggccatggtagaatgacaggtgaggaatcgatcagacgggaggaaaacaacaccgaaaaggaatgcacttctctgcttttgtatatgcatgcacctctacctacccattcgcgatgcaccaatgaaatacgttgccaaataccttaaaatactagtctattgttcaggtgatagtaatattgacactagtagttctctaatctctagttgctagtcttgtttatgttctattttttcttgttgcaatagtagcacatgatcgtagtaatgctgtatgattgatgattggatggcatggaactatgaacggatcaaacttatctcgataatatggtaataacaaggagatgtagacatgtactccagcattgtagtcagacagccgaatcacgaagctagtgtggaaccatgacagaagaaggcactactcagaataaatccagtcacgggtttaaaaaaaaaacagagagagaggagaatcatcatcacaaagctaatgcaacaacagcacaagcgtacttccgcatgagaccaagcaaggaaaaaagaaattccaaactgtccccaagaaaattcctgccccaggagagcacagcgccggcctgtacaggtcatcgttcccaataagacagggggaagctgagaggcaaagagcaccaccaacaacgcgtgcactgaattgcattgcacatgggacatggcaaacaccggcgcgtcgccacccgcgcatgcacgcacgggcgcgggcgcggccacgggcacatcctctcctgcgactcgtgagccgtgtcattccatcgcggcttcctgctcgatccgctccctgccatgcccgtgaccgtgatctccataaattcccccaccctgtgcgcgatgcgtctatcccccacgataattagtaggcctgccacctcttgccgcgagcaagacgaccacaccaccaaccaccatccatggcggtgtccgtgtcgtggtcgtgggcgccgcggttcttggcctgcgtcgcggtggcggtgttgcttgttacgtcgggtttgggcggtgcggccgccggcggcggcgggcgacgccatgggcacacgaaggggttgcggccggggaaggcggcggcgaaaccgtactatccggtgaacgcgacggcggtggaggcgatcgagcggcagttcacgcggtgggtgcgggccatggtcgggcgacgccacagcacgttccagcgcgcgctctaccgcgggcttgctgcccacgcgcaccctcgtcgtcgacaagaaccccgccgccggcaacttcacgtccatccaggccgctgtcgactcgatcccgctcatcaacctcgcccgcgtcgtcatcaaggtcaatgccggcacatacacgtacgtcactcacgtggctacttaatttggtctctgtaattttcttccacacccccaccgtatccagagcgttcgtccgaatgcctacaccgatctccccgtgcaccgtgcagtgagaaggtgaccatctcgccgctccgcgcgttcgtgaccatcgagggcgccggcgcggacaagacggtggtgcagtggggcgacacggccgacacggtcggcccgctcgggcgccccttcggcaccttcgcctccgccacgttcgccgtcaacgcgcagttcttcgtcgccaagaacatcaccttcaaggtgagcaccactactacactacaaatgcggcatcatttgtgccgtggcgtggctcattcgtttcgtctgtcgcgtgggcagaacacggcgccggtgccgaggccgggggcgctgggaaagcagggtgtggcgctgcggatatcggcggacaacgcggcgttcttggggtgcaacttcctcggcgcgcaggacacgctgtacgaccacctcggccgccattactacagagactgctacatcgagggctccgtcgacttcatattcggcaacgccctctctctctacgaggtacacacattgcttctttctcttggttgcatacacatttcctccatgaacattatagcagggaattgcatgcaacccgggtgattaggttgaaggtttgttgctaaccaagatagataatttaattagcgcctgaaatcgagtcaaacaggaaatctatgctcaatcctgtgtgtcagtgtccagtgctacagcccaaatgcacaacagatacaccgtgtcagtaaacactggcccgcagctttctgacagggcactggcctactgtggcacctactacaatgcaccacactggagtcacacagaagaaagaattctactatcgaccactgttaaaactcacagggttacagtagaggcaaaccactattatcggccacattagccccccgatcttgtgactggccctactacagctacacgaaccagatggtgccaatgcgttgtgcatgcccgtgtggcacttcgtttaatgcgaaatccaacgcaaatggaatgttgatgagcccactagtaatagcatagtgagtaatcagcctttcggtttttaagaggagtgtggtaaaacctgcatcgcttgtcgttggcgccggcacggttgccggatggggttttctggagcccggcaggttctctggtccccctggccccaggcgccgtgaccgctacggcccgtgacgcccatagctggacgtctcgtgccgtgcgtatggccccaaaccgtagcgtatgtgtatagccaccagtctcctctgcaaatcctgctcactttggtcgtacactttaaaatctggtactagtccaacactactaccagtagtaaccgacttttttttttggtcagaaatcaaaaattgacctttgggacgatagggtcgtccaagctccaagggaaacatattatctgctgtaccgtgctctaactttaagtgattgatatgtgtactatcccacatctaatatgtccacatgtcaatgacccattcacccatatcaaaggatagttctgtagagaatactcatccgtcgtgcaagtgcgcaacgcacctagcatggttcgaatgctagactttgtaatagtattcaccgtatttcagacattcagtaatactccacacaccacactagtggttattctaacgtgtgttacagtgtgtgatcgtaaagaatactagggtttacgcaaatatttgatcagaaatcctttgccgtgtattactttggtcatgtatgtactcagtactcacgttggtgacacgattgcagggatgtcacgtgcacgcgatcgcgcggaactacggagccctgacggctcagaaccggatgagcatcctggaggacacgggtttctcgttcgtcaactgccgcgtgacgggctccggcgccctctacctcggccgcgcctggggcaccttctcccgcgtcgtcttcgcctacacctacatggacaacatcatcatcccccgcggctggtacaactggggcgatcccacccgcgagatgtaagtagctaccactagtacagaatcgaacatcgtgaacgatcatatcactactattataatgatatgtgggtctcatcctatcataccccacccatcaatatttgtgatgatagcgtcataatggtagaggatgtgaaccccattcacccctcacatccatctcgttcttgtgttttttcgctaacgatgctggtgttttgtgtgtggttggtggcggtggcaggacggtgttctacgggcagtacaagtgcacggggccgggttcgaactacgccgggagggtggcgtggtcgagggagctcacggaccaggaggccaagccgttcatctccctcagcttcatcgacgggttggagtgggtcaagttgtagcaccacgtaggagagaaacacagctcactcgactattagttaacttgtgaagagaaaagaatagaacagaagaagtggcagataaacactctgatttgattcgattgcagatttcaactttgcagttgcattgtgagacagtcctatactgtgtccggccttcgcctcggttttgttttggactgcaaacagtataacatcaacttaggcccactggcccaggcagtagagaggtagcaatcgatgcgatctccctgctcagcctagaagcccatagagaattgaagtggggaaataggcccagaaaaaggttagagtagtgtagcagaagtgagcccaacaatcacaggtgtgttgcttccatgttccaacacgtatagccttttcgaacattattccttttttttcaaacattattctagacagacattttaatggatttctgcaaacttttagtagtagtagtattatagacccagtggccaatctctaataccgatttcatggttctaaccctggctagagattgggccacgtggcgccctgaaaatcaagtttgcctccctgcgaatttgccacgtgtctccttggctctcctcccgcattgtttgatcgagtatcgacggctaaaggctacagctcgctgtggtggtctggtggacctcgttagaaaactggaattttttttccatgaaagtgctccatccctaatccacccatcttcctcccggacgcacgcaccggcgtccccccgccgcccaccggattctccaccacctgcgcgccgcggccagcgccgcagtagaccacccgctcgtgtcctccttcaagacgctaggctcgtcttcttcaacgccgcccggccaccttgccctcccctgcgttccctgccgcaatgccgctgcctttcctcgaagccagggccgccgtcaattcgccggcaagagtcaccctctaacaggcggtggccatcgccgatacaaacttcggctagatccggtgagcccacgagagaaagaagggagggggcgctagctagcanaggaggagaggaggcggcgtgcgctggtgagaggtggcatcgcatcagatccttcgccacctgcgcgtcgcggccaatgacgccgtgatgaaccacccgctcgtgtcttccctcaaggtgctgcgccgactcgtcttctcccccgccgtcgtgcccgcgccgaggttgagggaacgtacgcaagcggctgctgtgcaggctcgatgtggagcgcggcgcgagggctgcggccaagcggcggcagcgatgtcggcgatggtcgtgcgggcctaatgtggtggcagggcagggcggacgaggaccgacgatctgggatcaacacggcggcagcggtggctggggcactaggcactggccacggccatgtgaacccaatgtggcagcaactgccgcgccgccgaaggccatgtaaatttgtgctccgcaaaggctccatgaggtgtaggctccacatatgtgaaaacgacggcggctggctctgctgcaaggtttgtgcaattcattctacaattcattctacaatgcatatcttgcagctaggaatcatgatatttcttttaaataattaccattatgtctctcaaaaaaaagtatgcagtatttattgccaataaccttgatttgaaaagggtgaaaatagtttttgttacatatagttatgagttacatatttaaacgcactttattaagtgaaaaaggattgctctgcactggacgcgtttcagattagaagttcagatttgcaagatgcggtttatgggctttcattccattctgttcaaggaacttattttcatggttgctgtcggtctgaatccataaaactcttctatgagatgtagcttactttttttttttgagtcatgtcattgtatcatgcttgctctattaaaatttccatcctcattagctaatagaaagcagatcgtccgatttgaatctgatttccatcgtcaagaaaagcggtgattcacaacctatactcatctactagctagcttaacttatcagaaaattggaaaggacctttatcaaaagctgtgatcatttcctcaacaatgtatgtctatatcttagataatctatattcatgtctttgataatctacaataaatctaactactaaacttaagtaaaacaaagttatggctacctattatctatacatatatatattccaatgcttgtgatatacatactattacaatttcatcctcgatctttaaattctaacttgattaggcactatgtcatactttggcagagttgtaatatcactgaactgaaactttcatatgacaaaaatggccattaatttgtatagatcagctgctgctgcagttacagtgcatctatatgtcatggtgctgtttggctggtgctttaatcagtttgttacatgctgaataaaatgtcatgatctttgtacatgctgtcaaagttgcaaattttagctacatgctgccaaaaaatttcatgatctgtgactctgtgtatgtgctgccatgatgaaattcctaagctgctggatttccaatttctttgttcccctactcaatttagaagaagtaagagttgtggtcaaagtgaaggagcgttctcagaataaatgtgctctactcttttttttttaatcaattagtttctctggttttgttttattcaattccaatattatggcatggcattgatagctcaggaacaacatcaatattcgactgaaactaactacaatatacttgctaaagtgcatatctgcagctaaaacaagcaaaaaagttttggatcttaacgaacaatcatgtaaatagcttatataactgctaaattttattcacataatgctaactaaatttaagttccaaatgccttgctatgttttctttttctttctttcttttttctattgcagattagtgtagcggcttcctgaccaaaggtgtaaagcatcactgctatcaaagtcatttgactgatatctgattgacgtcctcaacggttgacacatactcatcggtcaagtcctcaacgtacatggagttgaataagtttgttgcaatccattagcaaacaccaaatgcagagttagttttttggtggtacaagatggttatgcacatgagcaagagaggcagagagcaagtgaaggggcgcaagcaacgatgtatcacacaactcacactcactggtgctttgtccagcaccaaacctcagcaccagatttttgtgccaataatcacatcagcttgggagatgtcttcctgatgcggtgggcaaaggtatcgagggccatggaaccggttgatagcccgaggagcaagagggatttacaggaggtggaggacagggaacgcatcgcagacttgttctgtacatgtttattagatcattgtgacagagtgacatgttgcactatcaagtaccaatagttggttgggattggaatgatcaaaatgagttgttcatgttttagaaggctgtgtgtttctccattttagtttagatttgagaaggttctaggtttttcctttaaccttttcactctgtttctcgcccaacataactcagtttttctccttttcactctgtttaatttatcaatttctaaatagtgccacacggtccaatctccggtaaaactgtcagcttgagaaaagtgatgtggaggaaccatgaactcaatgtcttgctgcattgaactaatatgaataaaagggtaaagtttaaataatttcaggttttaaatagatactccctccgtttcacaatgtaagactttctagcattgtccacatacatatagatgttaatgaatctaaacacatacatatgtccagattcattaacatctaaatgaatgtaggtaatgctagaaagtcttactccctccgtttcacagtgtaagtcattctagcatttcttacattcatattgatattaatgaatatatatatctagattcattaacataaatatgaatatgaaaaatgctagaatgacttacattgtgaaacggaggaagtacgttgtgaaatggaggaagtaaaacatattaggtgtacttatcagagcatttcattcatttatttcataaaagctggtcaattacgcggcacggcattttctagtcatatagtataccactaggattagaagtactgcactgtagtacttactacgagttgtagtaggtattcgactcctactgtcctacattgaactgagccactgacaacatcaagattaggcagcgtatttttcaggggctgattgatgaaaactaacggatgattttctttatcatggatttgaattaaacagtagtattttatattataagtcttaactgatatagtttaaaacaggttatctaaataacgtaataagaaagttttttaaaagaaaatgtctttttttttgcggggaaaagaaaatgtctttttagaagcgtgaaatacataatctgtgctgataacgggccttgacctgttacggagagccaccgaggcgacaaaaacaatcttctacagtaccgtagaccgtatgcttctgcatcataactactcctacacagaatcagagttcggaccaatactaaactgtcaaaactcagatctactgttgatctagatccaccagcagtagcagcagcagataaaaacaaatctcaagtccatccgttccgactcacaccgtcagcaaaaacaagattgacagctgcaggtcgtgtcctcttcaatggagtccaaatcgatgtgtgcattgtcgcactgtcctagctccgcggtcgagaatagctgatggaaataaattccgcgcagcgatcctccaaatgctgcaaacgagtgacatattgtatcgagttcgaaaaagtttgaacagaattcagtggttagctgctgacatgtgcttggttaatgaaaacaatatggtcactgcacatttcagacggtccaagatgctactagtaacggttaagcaattccctcatgcatctcgggagacacgcacaagtccctttgtactttcaggtgtgccttttatcctaagagacaggattatctacatctaaatctggttctagagtcactaccagaaatgacagacaacatcaacagccaaacaggaaaaacgctgtgcacatgacttgcacatcactttagtgctcgttggaacagtgttcttattaatgtatagtactgtatagtattcatccccgtcttaggtaagctgttgtatcaggatattgttaaatggtcagtagcgctcattaactctgaagaaattctgaagactgaaaaggacgggatcatctctagaggtggccaaacgggcagcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcaggccggcacggcacggcccgcggcacggcacggcccgtttcgccggcggcccgtcaggcgcggacagggcgggcggcggtcgaatgggaaggcgccacgtggcactaacggctacttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtacctgttcatacggctgtcgttgaggaggtaccggttcaggcggcgacagcttcggaaggattttccggaaccgcgagcggaagtgtttcgacacacaccggctcgaagagatcgagaacctccgttgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtggagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgaatgaaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctacattatttaaagaatacgaaaatgatgacgttctaactgaacctgtctttcacatgaaacaaaaatatttgaaatattggaaaaatatacctatgttgtatgcttttgcttttgttttagatcctaggtgtaaattaaggggattgtctgctattttatcacttgttggagatactataggtgtagattatagttctttttatactgaggttagacgtaaattatatgaggtttttagaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttctttttttttaacattagcaaatcattacttttttaaaaaacttttatttccattttttaaataccattttttcattttttaacattagtaaatcattacttttttttaaacattttatttctatttttattttttttccttatacatttcctttgcttttttttaaaaaaaaacactgtgcactgcaggctggcggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctataatcatctcggcgtccaaatacgctcaggcaatgaatttggccactctttttccgagccaaaccagctctggacgtgttatcagacaaccaccgtttgcaaccatgtagggagggtactattttagcgtccttttgcctgatgcttcacatcaaatgcacgtcaacatttaagccatccataaagcaatgcagttgtggtacactgcaacaaacaaccacaattttgtcttcagtgcaaaggatctgccagtgccaagaaggcaggaactcgtccgtgtactctttacttcttccttcccttaacttccatgccatttcagctatcaacctatacaggtcggtatcagataccgcatcagcatttaagggggagggatttaggactgtttagattgtagccaaaataaaccttattaaattttgttattgccaaaattttagcaggatttcttatatatttactaaagtttggcagtaaattaaatgtagtcactttttgacaactttaccaaaatttgataaggttgaaaatggcatcaaggtgaacaggcctttgtttttttgtgaggtttagtccctctcaccaaaccaccccgtaaggcctgagtttagttaccaattttttcttcaagcttccaacttttccatcacatcaaaactttcctacacacacaaacttccaacttttccatcacatcgttccaatttcaattaaacttccaattttgacgtgaattaaacacaccataagccacactgtcagaaaaacaaaggaatggcatttcggaactgtatgtacttttgtttcttcctcctctttttcccttcctttggcagggattcacccgtccaatttctcataggtaagtgcagtaatttagaccgttttggtaattgagaaacccaaattaaatttacaattttataccatgaagacaaactttactctatgacacttaaaagtttatataattaactagtggacattgtaaaaacatatcatggctagagaataccctaaaaacgtgttatgtttatggaaagatattttcgatccaattaaaagagaaactcttaaaagaaaaacaagaatgtcctatggctacaagtttctaacctaacatacgagtgaagacggattatgatatatactaacaatgtacaccttagagtgatggcattttaagagttgcataatttcaaagctttcactcaagcgctaggttagaattttgtggccccaaataggtaaaaatgtcgttcgataaattaccaattatttattatccttcaattatagcacatttataggatatttatcagtaaattacataagatttagttgtcgtggaataaaatttgtcaataagaagagagagaatgtggttagagctgtagcggtagaacagattttattccctgctcttttgccatactcgagctacatattctggtggtactttgcgaagatttaccatcttagtcctaacactaatatgtaccgaaagttaattaaaacacactcctggattagcattcgggctccggttgtgagtaatcaccagagctgatcgaggtaataatctctagtgacgtcgtcgctgaactccgagtcctcgtggcggctcatctccgagctcttcaagctgatggcgctgtccggccgcgacttcctcgacccggcgcgggccaggctaggcctcggctcgccggcggcgccgtgccgctgcctcggcgcgctctggcaccgcgcacgcgccacggacgacgccgtgtccgccatgtaccgcgggctcacgacgcgccccttcgccggcgacgccgggccgtggtaccccgccgggagcgcggcggcgagccggggcgtgttgtgcgtcgtcttcggctgcgcccgcgcatcgtgctcgtgctcctcggcctggaggtggcgcgacggcggcggcttgtagcagtagaggtgcggcgaggacagcggcaccgaccccggcgtgccgtccggcggcgggtcggcggcgtagcggctcgtgatccgggaagaccggcaccggagctggcacgtgtccatctccacgatcctcgggctgcggtcgaagttgatgtcgccgccgtcggacacccgacggcggtgcaccaccggcaacgtcaatgtctttacccgccctccttgcatttgcacgacaatcctctcctacgtacaaaagatgctcaaaaatttaacttcatctgataaaatcaaggtgatccgaggaggcatcacagtgaaaaatctcacctgttcgacggatttccgcgatgaggccatcttgatggcgcgagaggaggcttggagcctcatgagcgcttgcagcctctgcagagtcgtcgctgcttgcttcctcacaaggtagccacgtaccagagcttgtatcttgacaagcgccttgagagcgcgcaatgccctcctagcctgcatttgcggtggaaaattcaaatttttacagttgcttcgaaaagcaaatcaacagaaacaatatggaagtttttgaactatatgccatgacgactaggcttgtgtccccactgtgcagttacctaagcgtttgcagcaaatcatcactaaacaaaaatatcctaaaatgtggaatttatctatagtaggaagcagattaaacaatgtgcattgtgcaatggctagctactcaacggcaagaaactatcaaacaactgctgccattaacaacagttagtaaagtgaagtcaaatctcctgtccaatataaaaccaggagaatccataccacctactccctccgtcccattttgagtttttgcttgtaacgtttgaccactcgtcttattcaaaattttttgaaattattaattattttatttgtgacttactttattatctataaacaattaggcccgtctttttcttttttttttttgccnnnnnnntttgtgtgggggtgcggntttcctcgggtctnnnggngcgtgcgtcgcaantgctcatcaacaaaccggcgggggggggngggggtaaggaaatacaaanaaaaattnaaaccanntnacagaatacgcttagaaggaaaagaagttttaacgtaaggctgtaaaagaaaagacgtt

SEQ ID NO: 92 - DNA, 1929 bp, Oryza sativa
  unsure (1)..(1929): unsure at all n locations
gcatagagagatggtagatagcttagagagtggaggaagtagggatagtttgatggtaaataggatgggagaaaataaggaaggaagntagggagtagagtaagtggnaggaaggaagaaagaaggaggaagggagggagaaaggagagaggagggaggagaaaggagagaagagggagnaggagaangnaannagnnnnnnngttacaagcaaaaactgaaaatcccttatattgtgggacggagggagtattttcaaaaagaagaatctactaaaatcccgtgaacctatccttgcattgattgctaactgaatcgtggaaaaccaaataaaatgtcatttacgaatactaggctaatgttcaaagttcaaacacatgcagcagctgcagaacaaaactcaacattttcaggggaaaaacaagacaccaaaacagtacttgggagacgtaccaggtatcctctgaaggccttctggatcatgacggccgcctccacctcccgttgctggccgcagctgcatggccggacctgcgagagctcgccggcgacgacggcggtgaccgagggcctgcggctgccgtcagcgaaactgctcctcggcttagcgaagctccacctcctcctctccatcggcggcggcgcgacgccaccattggcgcctccggcggcgctgtgctccttccgatccctgtctcctccttccttcttgccggtgagaaccttcttgaaccacctcatcgcgcggcccatggtgaatcaacctatctgcagcacgacgaatgccacgaacagaggcgtcaaaaaaaatgtgtagagagcgtggataaaaggattcaagaacagcagctagaactattactccagtgctgaaacaatggaactaataggagacgcaaagatcaactcgggagttgttgaaagttgaaaaactgtaggcgaacaggggaaagaaggctatagtataccgctatagctcaataaaacagagacgccacgatttgaaatgagatactccagagtccagatagcagagtggacaagaaaaaagcatggaagcaagaaagcttgggtgaaaaaagggtcttttttcgatggtgaagcagggaagaaacctttttacagagaggggctgctgccgagaaacatgggaccgaacagagatggaaaccgaactgaaaaggcctcaagaagcttagctgaaaaaggagaaggcaaagacgtgtaatgtagcgccaaaaacagccgagttggtgggggagatcacagtgctcccctccagctcacgaaacgtgactccctgatgcggaaaaggaccttttcatcagtgaaacccagtacccaccagcccagccagcccagccggttgaactctcccaggcgaagcagcgagccagccggcgattcagagcggaagcagccggcgacgaagtgtgagatagcgagctatcgagccagcccagccaccgcaaccgcagcgacgctcgcaggggaaaagaaaagattccccctgcttgccccctctcgcctaagagtccgagcacaaggcaacaaaaaggctaagcgagaggcaagaccaaccgaagcaaaaaaagacccaaaccccggagggttcaccaccacgcaccgcacgagacagcaaaagaaaaaaagaaaaaccgagatggcaacaagatccaaacggcgtcgctcgcgcagatgcaatcattcgcacggacgcacctcgcctccgngccgcgcgcgcgcgggggccgagagcccgagatagccgcgcaacaacaagtcacaagttgggggggggggggggggggncatcannnctttttgctattacttttttgggatttattatttaggcaagacataaaatccaggtttttgatggacataccttaaagtcttgcatttttattgccataccctgggttg

SEQ ID NO: 93 - DNA, 2220 bp, Oryza sativa
  unsure (1)..(2220): unsure at all n locations
gttaaataggggttagccttttttctttcaaaccgaaagctttcattttcgtcgccggccacggtgggcttttgccgccgcctccttgcacgtatataaggacaacaaagctcccttggacccgtgcctccatttgcgttagcctgccatagggtctagatccgcctgggggtagccgtagtcgccgccgtggttgccgtgggttcaacagcacagaacacccggttccagtcaagttcctcggttgccgtagtgtgggggggggggctcgcgtctctcgcctcccactccgcggcacggcttttggagcccgagtctggccgagaactcacgccaagatccgatccggcaaccggctaaaaacaaacgtagtacgagcagtgacgcacgcccaccccacccgcgatggtagcagctcggctaaccccttccacactccacaccagcgcaacgacggaagtgtgtgacgcggatggatgtggtagtacgctgtagcatgtactccctccctccgttcttaaaaaaaagacaaaccatgttttcgtgtccaacgtaaattaaaaagacaagtcacgtataaaatattaatcatattttatcatctaacaacaataaaaatataaattataaaaaaatttcatataagagagacagttaaaattggcaaaaaaaacccagagtttgtctcttttttttttatggagggagcacgagcgctcactgatccggtcaaataaatgtttgtgcctttgtttatcgccttgtgtagggatacggattctaggcctctggaccacagtgggaacgtccgaacgtgaattggttaaggctgtgtttagttcacgctaaaattgaaagtttagtcgaaattgtaacgatgtaataaaaaatttaaaaatttatgtgtgcaggaaagttttgatgtgataaaaaagttaaaagttcaaagaaaaattttagatctaaacacggcctaaccatcgttggcatggaagttgaaccgctcgtatactgtatacttcgactctgtaatgtgtatagtgttataactcacggcaacaagcttgagaaaatggaacaccaaatgtaaagatggcagaaaatggaacaccaaatgtaaagatggcttaattaacgggttgtgcatctgtaactccaaaggtgctaagcgttaattatcaaccatgacgggaatgcacatgccttgccttgcgttgtggtccatattcccccggttcagtagtagaagatcacaaatttatttactgttcaaaatacacagccgatggcccccgctggagacgcacgcgtgacgcaagcggcgtgcacgcaagaaattttatgggaggagagtggtacggatgctgaagggaaaaatttctcatacgaattggcacgcttctcgaggctgccgctctgcgtgacgccatcctcccgtcgtggaacacggtttcgacagggcatggccgtcctttcgacagtgcagagcatgtactcctccgtagtagcagatccgtcgaaaacgaaaacggaaaaaaaaaaagaatgagtatctgttgcactgacccgtgggtcccactccatcgtatatgcttctaatcggcgtagctacagaggtggcaaaggagtagtagggtaccaagatactggtatactatggctgtgttgagatccaaagtttggatccaaagtttggatccaaacttcagtcctttttcatcacatcaacctgtcatacacacataacttttcagtcacatcatcttcaatttcaaccaaaatccaaactttgcgtgaactaaacacagcctactagtatcccaaatgggtttatatcatgtactataatgacactgttattatagacaccaacatgtgaggcaataggagagtagaagtgtgggacccacacacctacgctagtgacattatggtagaggatactcatataccccaaacactaccaagacaccaacacgaagagagtacgaacgctagtagggcgttcccagcgcgccttcatggtgttcgaaaatagatggtgaacactcgcgccagtcgaagtggaaacaataacaatgaagggaacccaactcttgctcaagttctggctcaacagactcagttaatgaacatnnnnnnnnnnnnnnnnnnnnnnnnnnnnnnnnnnnnnnnnnnnnnnnnnnnnnnnnnnnnnngatgtattattaaagnggcgtg

SEQ ID NO: 94 - DNA, 957 bp, Oryza sativa
  unsure (1)..(957): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatagagtaaaaacctctaatgaacattttgaagaaatttctattaaagcctctgatgaaaataattctctaccttaagtagaacaaacaaattgcatttttaagtttcaatcagctaaaagtacttcgtctatctcaaaatataagaatttttagtaagtttagaacaatttagggtgtgtttgtgtttggtttgagggatcatgaatgggagacggtgatccaacttttaagcaacaatcaaaaacataccatgccccttattgaacaggcatggcagatggcatcactcttgatcggtttaattgtcggcccatcttgactggtgggctaatctatctataccttaatagttacacgctcgcgcatatatacatatatatacatatatacatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 95 - DNA, 741 bp, Oryza sativa
  unsure (1)..(741): unsure at all n locations
ccgccnaggtagactcatctagcatccaccccncgggagctgtcctgatccaagcctattgatttctaacccttggtacctggaactgcaccgatccacaagaggtcttactgaatgggagccaactagttggcggaagtcaataagccagttgatgaacagttacagaaaggatacatccgcccgagcacgtagccttggggtgcttcggatatctttgcgggcaaaaaagacaaaaccaacaggatgtgcgttgactaccgagctctcaatgggggcaccataatgaacaagtttcctttgccaaggattgattacccggttgatcaggttaaaagagctactgtgttctctaagatagacctgcgatcaggctatcacccattgaagttccgcgacgaggatatttcaaagacagcatttatcactcggtacgggttgttcgaatgcacagttatgtttttcggactcactaacgcacctgcctccttcatgaatttgatgaacaacgtgtttatggaatttctagacaagtttgtcggggatttcatcgatgacatacttatctactccaagttctaggaagaacattaacagcatctttcgctggtactttaaaagttaaaagagcaccagctatatgccaagctcagcaacgtgcgacttttggcttaaagaaaatcagtttttcggacacattgtgaatgcttattgaatagctgtggattcagcaaatgtgga

SEQ ID NO: 96 - DNA, 882 bp, Oryza sativa
  unsure (1)..(882): unsure at all n locations
gagcggtttgttgannnnnnnnnnnnnnnnnnnnnnnnnnnnnnnnnnnnnnnnnnnnnnnnnnnnnnnnttaaaaagtcttcttttggctttgggccgaaagccggcccaaaacccttctctctctttccctcggcccagccggcccagtccgccgagccgccgctctcctctctctcagccgctgacaggtgggccccacctgtcaggttcgtcttcctcgagccgccgctgccgcccgaaaccctagcgcgccgccgtcgccgtttccttccaaatccggccgctcctttccttctccggccgaattgattgaggggaaacaatctccgggatctcctctaccttttctcctttggaaacatcggctaaatcgttttggaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgtcgtcggtcgccgtcgccaccatcgggttcgccaagtcatcgccgtccccgtccaccgcttcgccgccgccgaagaccgtcggagcgccgtcgccgtcgtcgacccgaagagcttcgccgcttcctcctcgtcgccgccgccgtccgttggtcaaccgccgccgttttggtcaccggtgagttnnnnnnnnnnnnnnnnnnnnnnnnnnnnnnnnnnnnnnnnnnnnnacggtcccaatnntnnacata

SEQ ID NO: 97 - DNA, 742 bp, Oryza sativa
  unsure (1)..(742): unsure at all n locations
ccgcgttttgtatcttcctgnnnnnnnnnnnnnnnnnnnnnnnnnnnnnnnnnnnnnnncaaatggtaattttttgggaatagaaaggtcatgttgctccgtgcaaataatttcatacacatgtggttgctattattgtaaaacttttagttttttttaaagatatttttcaaatttttagtgcactgtccaaatagtttcatacctgcacatgatgtaattaattatccttggttattaatgagaaatatattgattatcagatcaaacgagagttcaatcgagccaattgataggaggctcttcactgagggcatctaaaaggtggcagaagtagagcacgctccggttgctcagttgtattttgtatgtccagaatgtgaaaataggcgaagtagctgtaggagacaatgtacttgtaagttgtaactctacagatgtgagagcattctgctgacgaaggacgagcagctgatgactcatcctttgctcatacagatcaaatatccaggaaaggattcccttttctgttctccatgtttaaacctagggttatgagattgctgaatgtaatgttcaaaagcaggggactccccaaagttcaggggtaaatcttgcctggcgattaaccggacaagagattcccgagcaaccatgggagnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 98 - DNA, 732 bp, Oryza sativa
  unsure (1)..(732): unsure at all n locations
gccgcttttgattgatacaatcnnnnnnnnnnnnnnnnnnnnnnnnnnnnnnnnnnnnnnnnnnnnnnnnnnnnnnnnnnnnnnnnttcgcttggctaatcactagccaactgcaccagcgcgacagatgcaaaactagttcacgccaaaattggaagtttggttgaaattggaacgatgcgatggaaaagttaaaagtttatgtgtgtaggaaagtttcgatgtgatagaaaagttggaagtttaaagaaaaagtttggaactaaacaaggcctaaacagggtacaggggtggggacttgggtgtgttgtggtggttaccttccgggttccggcgcatctcgacggcggcggcggaagactgcatcacccgcggtgagcactcatcgccgacggatctcactgaattcgcgctccccaactctacactctggtggaccgatttcatggttctaaccctggctagagattgggccacgtggcgccctgaaaatcaagtttgcctccctgcgaatttgccacgtgtctccttggctctcctcccgcattgtttgatcgagtatcgacggctaaaggctacagctcgctgtggtggtctggtggacctcgttagaaaactggaattttttttccatgaaagtgctccatcccttatccacccatctttcttccggacgcacgcaccgncgtccnncccgncgccaaccggattcttcaccaccttgcgcgcgng

SEQ ID NO: 99 - DNA, 1555 bp, Oryza sativa
  unsure (1)..(1555): unsure at all n locations
aaaaaacaaagaaaagtcaccacaaaacaaaacaaaaaacaccgccacacngattcacaancaaacacnactaaacatcaaaaacaaacctccccccccccncaagaaatgatgatgcanncgcannnacnancnnnnnnnannnaanaaaaaaaannaaaaaaaaaaaccaacaaaaaaaaaaaaaaaaaaaannacacnaaaaaaaaaaaaaaaaaaaaaaaaaaagagaaaaaaaaaaaaaaaaaaaaaaaaaaaaaaaaataaaaaaaaaaaaaaaaaaaacaaaaaaaaaaaaaaaaaaaaaaaaaaaaaaaaaaaaaaagaaaaaaaaaaaaaaaaaaaaaaaaaaaaaaaaaatacaaaaaaacaacaaaaaaaacaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaacaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaataaaaaaaaaaaaacaaaaaaaaaaaaaaaaaacaaaaaaaaaaaaaaaaaaaaaaaataaaaaaaaaaaaaaaaaaaaaaacaaaacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 100 - DNA, 46996 bp, Oryza sativa
  unsure (1)..(46996): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttctattaacgcaagtctctccattgctagcctttgcgcttcacctttatccttttgggaagcacaagcttctgcacgagctacgtcagccaattccgtggctcgtttagcttcccttcaggtttccttgcacgggctgtttgcttcatcaaacctcttgcactctgttagatacttctcctgaagatggtttttttcttgttccaagatcttcacttccttctcacgtgactgagcttcagttctaaaagactccaagctaacagtcagtgatctgatctcttctttcaaagccagcgaatctgactcatggttcttcaactttgcttcagtagcctgtgtttggtcattccaggaatgagagacataaatatcgcaaaggggagatgatgaaagtgagaaagctactatacctcaagccttgagatcaaatttgtggcatgaatttcggtttggttaatttttgtgtttaatcttgcgatctcctcttcctgttaagaaaacacaataaaaagtaaggtaagcaactgtgagatttaaaaccaatccaccgagattcttaagagaaaggattaccttctcagacagttggctagcaagttctgcccttaaagcgtcttccctttcttgcactttcttattagtgcgttcttgtgctacagctgctctttgcagagctgtttttgcctcacttacagcaacttcatatttccgtttccactccgatgcctcttcttgagcagactcagcctgttctcgcacagcagataatctgccctcactgatatttaccctggattccagagaagcaatttgagactttaacttactttcatctgccttttgctgtaacagattgtggtcgtatttgttcttccaatcaacagattcccgttttgcattgtcaagagcagaagacaagctcacacatcgttcctccaacttgctactcttggtctgaagttcagcaatacgtccggagtaatcccttgaaattttctgtttatcattgatagattcctcatagcgccttaggtactcagccctatgcccctcacttgcttcgagctgcttcctaagtagtgccaacttatcatcatttgaactgcatttcaatcttagggaatttctttctgcatctatatgctctatctgtcttctgaaaagataaagcacggggcccgccaaactgcagttatcatgacagataagattataataagtcaaagcaagagtaagggaaaaggtttcggccctccaaattagtccggttaacagtaggcattgtgcaagggcatcacgtcagaactaaagacattaataaaagaagcggtacataccactgctgtaaaaatgtagctagttttttccatttccctggaccataagattttgactcatactctgtaagtaggccatcaatgagctggaacaaaaaagagattcacataattacattagtatttcattcaaggcaagctaaaacatgaaaatgaaaagacaattctctacaagtgaataatcttaccctgactatgtcatccaactttgcatcaggacggttgcatgctgtccgtatctttgactccatgctctgaattctattcgaacattgcaaatcagcctctagaaaagtattccttttgtagtcctgcatgtatgcgagtactagttaaccttatagctcaaacttaagcattaaattacaccaactattaattgcaaaattgattaatggtagttaagaaagaaaaaacaaacaatagcagacatgatacaatccaagtaacagataagaagagatggagtcacctcaaaggccttcttgagagaagtttgaagaagcttctcaaattttgaacgagctaacccggcaccaacagcagaagcattgaagacactaacagcctttttcaatgcatcttcatgtgcttctctcatggcatcctgcaaacatccatgaattagtgtcttgttccaaataagctcaaataagataccccctctgtcccaaaatataagggattttggacggagcctgtccagattcattatactaagaagtgtcccatccgtccaaaatcccttatattttggggcggagggagtatctaatacaagccattcataagtgatgcctacctcttctgctggttttctccggtcaaaagaagaattgtaggtatcaattgcagaatcatatgcccttcgacattctgcttcctccacactctgcacagctaaaaactattagataaattcctcccaaacagaaaccatataacctgatgacatcaaataatacgagaaacacaggaatagtaaaacaacttgttggtaatcttcaaaactataattgctgtcatagatcagcaaaccggtacagtgctatttcattctctcttttattagttttgcagcccttctaaggctgtgttcttcccccacctttcccaactcacctccctcgtgctccgcgcgcacgcttttcaaactactaaacgtgtgttttttgcaaaaggtttatatacaaaagttgctttaaaaaaccatattaatccatttttcaagtttattttagctaatacttaataaattatgcactaatctccgctccattttgcgtgttgggagtgcgagggttcccaaccctcactcccgaactcaacctaaatatttttccaagtcatcaggtccatagaaagctgaagtccaagcacagcttgcgtgctcaaaaataattgaaacctcaatctttcacatttgatctcaaacagttacttcatggaagctattaactcagaatgctaacttcataactatcattggctacaaaaaatagctgctacaagacctctacaacagcaaactctttatacggttaagtttacatagggaaaaagattaagaagtgatagaaccaaatcatgaatttgcaactcgtttacacgatatatggaaaagatcaggttaaggcatatttctgtctctattttcagtagactcacctgccatgacgaagatatcgtaggtactgcaccagtattgatcgcatcgagaaatgattgtgtcagtccagaaaggacagggcctgtcagggtgctagctccaagttgtttaggccttgttcggtcaaagacaaattttgtcaaagcatccagaccagatctaaactctggacggaagttattcaactgcaaacaaggacacaaactaatcatccagcagaaatagaaatgaatagcataaaaataacagaaatgctttatgaacatcaaccacaaagacaaatgcaatcatgttgaaatatggagtacaactataacttcacaaagctcatcaaagctccaaagacaattgatgtcaactttttttcctccaacaaggtttttttttttttgagggaaagcattgtaggggaaggccccacagttaaattccaacaaggtatatcacagtccatgttgtgaaagcgccagtatttacaacaataaagacacgtgccattgccatgtgcacatattggccaaaaggccgatgtttctggcaggtaccatgattatgtcatcatcatttttcagagatgtgattatgctattatctatgagattatatcataactaccatcctttttttttcaaatattgaaatccaatcagcagtcaagagtccaacatgtgcagcaaagttgcacaagtatgcagctataaactttgacaaaaaaagttatgctagttgatagcagttcaaaggaagtaatgataatacataccggaagttgatcaaggcgctgaagatctttctcattattcacaggtcgcacaagtgtaatgcattctcgatccggaaaaagtgcacggatggactcccgtatcttacagatacattacaacatatgcatcagtttcttatagatatgttaaaaatgatgcatcagaaagattgttgcaccagataattttatgaataatgcactgcaagaaactcatgctgccataccgcattcttagaagatacatcccttcctccaccttgtacaggcctcaaagccagttcgaggtaatctcttggagtaatttttctgttgtcttctgtcaaatccaagtaaaagtcctataggaaacaaataatgactcagtatcaaataagtcacaggctgcgtaaacatcagaacatgcatgtgccaaagagttgatttaagaagagaaaatccacagcgtaccctcagcaaccaaacaaagacaggtgaaaagtgccctagttcagatgcagtggaccttccacctgaggccctgacacgtatatgtttggtcatttctgtcaccagtgaaaggcgatcaagtgcagcttcatctatgcctcccatctgtaagaagcaaaagaagtagagaacaccagtataattccactctatgatgtcttcccaattaacaaaattagaagaacattcagtcagctgctcagcaaattacctggttgtatatgaacatacttgataatagaacagctaaagaaaatatttgaatactgtaagtgccctgccaaagaggaaaagatagaacatgaggcgacaagtcgaaagcagaaacgcaagtatgtacgactgcagaaaattaattgaaaaaataattcacagaaaacggacgataacagacattcgtcgcaattacaattagaaaacgacatatttatctgtttaaatggaatatattacacctactgtcagcaaaatgactgatattaggtagaaaactatttctagggaaatattattttcagatttcactaggtaatcaggtccaaagaggaaaagatgcatgtaagtatcttcatcaaagataaacaccaaatgaacttcgtcagcaagacagcaactactagggatgaaatttctataagtttgcatgcgacgcacagagggtaagagtcataactcataagaacatcataatatgatcgtcccaacaaagagaagctactgaattataaaacttcttcattgaaatccaactactcacaatacaaatagcttcccagtgtcacaagtcacaacatatatcattaacaacaaaaggcagccaacaaaaagttaaagctagaaacataccgtttggtcataagcatcaattccttcagtatccaacaatacaaggttgtattcagtcccatcaagaccagttctcttcaaaggtgcactccacatccaaagtcccttggtacaaggacgatgtgttggcgcaacttgaaaaccactgcttcggcctagaagctacaaaagcaggtaaaattttatcatctaatggtgatacaaattaaaaaaaacataacctaatttgacatttgattcactggttgctcatacacacactaatccaatcaagacatcacaccaattttacaattgaaatataagaaatcactctaatgccaagcagaaatcccaaaagttggtagataacaatatttgaggcgctgttttgctttttatgtcctcacgagaatcccacatattgtataggcacactgcacacaactaactttaccctttaacagttgcacgacacatcgaccaaaccaaccgtattgctaaaatgctgcagggctaacacagtgagcactaatcagagcaccaatccaatgaaatcgagaacaaaaggctccaattccaccagtcaacaaaccctagaggaacgttcatcgaaaggacaactaaaattgaactactctcgagataacacggctgatcaaacattcaaacactacaaacaaaaccaaaaaaaaaaaaccctagccgcaggttgccgattgcaaaaccgaacggaagttcctcaaatctgtacacatggggggggggggggcaagccgcaagcgcacgcatacctggttaagcacgaagctcttgccctggcgcgcgcggccgcagacggaaacgacgccgacggggcccttgacgagctgcagcgccgccaccgcctccgggtccatcacgaacttccccttctcgtcgcagtacaccagccgcagcggccgccccggtccacccccaccctcgccgccgttcctgacgggtgcgtcgccgcccgcatcccccgcgctggggctcccgcgaaggccgagcatctgtagcatcgcgccccccgcgcgccgccggcaagggcacgccgccgccgctcgcctcgctccgttggtttcaaaatgggaagagggaagaaatcgaaaccgaagtggtcgagggttacgctacgcgagcgttggtttgggttgggttcgagtcgagtcggttcctcctcctgccgcgctggaagcgacgcggcggtttcacgattcggatgctttttcccctttggagctggacgtgcggcttggtcggtgcatttttggactttggtccacagttggtcggtgcagcgcacgtcacaaaaaaaaggattatttctacgtgggcctcaatggattgcacatttgtttgtgttgggccaatttggtttgcatggctgggcctattggggccttaaatattgggccttgcatctgatttcgtggcctgtgttacttatcatgtcttgaagtcttcccttcgaaaaagaagggaacatggttgtttgcaatttgtatgtaaccttattgttttgtttttcttttggcagtggtaaaaattggaattgccaaaaaaaaaaaatgtcggcagatttgctaggcatttgtttggtttgctatcaaagttatatagtgtactaaactaaataatttagcgatgctactcccttttctacaaatcaaatatagatgccaatttttcggcttttggctttgtaaaaccatcaccaaagtcaaatagattgaaattccattttttatagattattgacatggattatctactactttataggaataaattaaatatttctagtataaaattaacaaatactccatttgcgataaaataagtggtctaagcaatatactagaaaaaattgatttaatgtaattttagataggttgtcggtgatatgggcccggggtacccacactaaggggaaagggtcattttccctagccacgtggctacgtggccgggcgcgcaggtaataagtagccaaaaggcgcccataacagcctaggggcctcggggtatccagtcgcgcccctcgggcccgagaggctacgtcgccccgaggccctcactcggctgccacgtcaccgctgagtgggcggaggaaagggcgctgccagacgcattgatgggcggcgccccaaccaccatcgtctcatttaatgcggcgtggctggtcgtgcgacgtccaatcgattgacgtgcgtcaatcgcccttgaccgggctgagaccggtcgcaggcggatgggacgggcggcggcgcacccacaccccgcaggcagcgtgggggcaggtatgccccgtcccatcaactcccggagaccgatgtcagaccggtgcaagaacccacagaagtctccaaaaaattaagagggaatgaccggggatgtccctcgcgtcagacaaaggacggcgctgggacccacctgaggacgagtggccaccttacttccggtctaaggcatagttggtagctcgacccgggttgatgtgagccccctccccctcaacagctagaggtgtagaggcggtgcatattgtaaccccttgaactataaaaggaggaccatgccccccgagcaaggggacgactctggagagctcaaatcttaggagaagattagccaatcgtcgctctagggttagaggtctcttgtaatagcacaagcataaatccacacgcaggagtagggtattacgcttcccagcggcccgaacctggataatcccttgtctccctttcgatcgccatccgccacattagcgcaatccatagcgaagatacgctcttgatcatcgcgccctattcccccggccgaactcacaaagggggtctcacgtcctcccgctgcaaaggttcactcctcaacagaggtggagcaaataatttatggtaataatccaacggagtacatctctcagttctataatttaggtaagcaaagagtaacttaagaaaatcatcttaaatgagctcccgaagtggagaaaaagactgggcgtgttgagtaaagtcgtattgacatagactttgctgaatatatgtctatcgactctgcatctggacatgtaaattattctcatgtaaccattattggactattgggataaatacaaagcgagcctgtctgaatcaaagacaagtcccatctttaccagattagcaaaaggatggtttctgaaggctcatgtggccctgccagaattgcactgctgtttttttttccctctttatgtaacgccattttgcgacagaatctttcagacgtcgtctggtcgaatgggtgcccctcaaaatcacagatttgcagtggccggcatgctaattgcgtctcgattaatcatcgcttttcagacaaaaaactgaaggtcgtactgataaatatggctgcatcaccatcagcagtaaaaactaaagagacatggcacccaaactgctccagcacgttgcacttagtacacattttgcagcactaagccggcagcaaaagaagagatttttacagtaaacacatgattcctgaacaagcagagacatgatgccatgagctggattattattgtttttgcaaagagttacactagtgttagattagttgcttctccttataagccgggaaagcgaatgggtgtggtaggccaaacacaaagaaagtgagagcaaagatgctacaagtaccagacaaaaggttgagctgaaaaaagaaaataaaaaggccccaacccaagctgacatttccatggcgttcagcgtacaggctacagcctacaggttccctatctgattgcctaccccctgctaagtgctcaacttgagcacttatcttgctcctcacttcaccaactcagcttgcagattgattaatcaaaagtagtattaggcttcgttcgttactgggcgatctaggggattgagagagaaaagtatctcattttccacgcgcacgcttcccaaactactaaatggtacgttttaaaaaaaaatctatagaaaagttgctttaaaaaatcatattaatccatttttgaagtttaaaatagttaatactcaattaatcatgtgctaatggttcacctcgttttgcgtatcttcccaatctccccagtcctcttctcctcaaacacacccttagagcctagtagatcgcatttgcttcatttttcgtagacagctagcccagtacagtacccctgttaggaaacgatagacaaacaaacgatgaataacaatagatcaatcacagaaaacacgagatttttacgtgaaaaaccctctcaaaacaggagagaaaaaaccacgagctccaaccagcaaaataccttcactatatctggggtgagattacgcacggcggtttacaaaaggtatatatatatatggtggaatctagaagggataacgatccgtttcgcgggggctccgccctcgcacccccggcccaagcctcccggccacgggcttccgctccactacggcagaagctggcgtttattaagtggagatgaatttagatcacaactcaacgcacccccaaactcatagcgtgccggtacgtgtagtcatgttgtgttcaggagcagtgtattggattcagaacttttttggccctgtgaagccaagctagcgttaacaaagtgaggccaaacagatactccacgagcaaaggagtaactttactcaggcagcatgagcatgccagtcagtcaacaaagctcccaaaaagaaccacgaattctgaagcgttcgtcaggtgaatggatccgacgagatcatcagaagcaagaaaacgaaacgcccaggtttttccatcacgggctcctccaaccttccaatcggagagcacaatcacgagccgtccttccatccccacccccatcctgacacgcttacatgtgtgcagcatgaagtggtcactcgtcatgatcgccctgacggccgccggccattcgcgccgccggccagtgctactgctatagtcgtagctccagcgagtggagcgagtggagtcgtacctccatccgcgcgcgcacgttttttaaacagctaaacggtacgtctttttttataaaaaatttatatacgaaagttgtttaaaaaaattatattgatatattttttttaaaaaaagataatcttaattaatcacacgctaatatacaacaccgtttttcgtgcgcagaagatttgttcccgactgcccacaacgaacacagccataatatgtacccctccgtaaaaaaaagactaattctacttacgaatctgtatacatgtgtctagatttgtagttcggattttttttttacggagtagtactactctcctactccaatcaatcaatgagaaggcgcggcgccccccggctggaacgggcgaattcctgcgacctctttcgagcagcggcagcggcagcggcacggcgtagccaccataccgtggtcctggttgccagcagcggttgcgagactctagccggtagatgcagtattgcagcagtaaccagcagtgtcattctcatgaaacctacccctctctctctctctctctctctctcactactactgcgtgtagctaggtagaccatcgatctcgcgcatgcgaattcgcgaagcgagaatgggctttctgcgtgactgtgcacgccccggcatatccggggggttatgggtgctttggagtctgtaggtttgggtgctaaatctgggttagttgggaactgtctggtcttagcttgacaggacacggctattgcttgttcgcccattggcatatttggctggtagcagtagtactactgctattgctttgatctctcatcactttagtttgctgcactgtccaaatgaatgctagctcctctatctagagagagttgccttcgattgtttctttacagaataaagttgtttatatatcgtaaacaagtgaatgccttttttgtcttgtgtttaccaaagctaaagcgacatgcaaaccttttttttttctgcagcggctggagagtaaagtttggcaacagttaatttctatggcctatattaaggtagtgtttagttggtgtgataggatgggatgggatgggacgaaacccatttttagaggtgtttggttgaggggcgagtgggatgggttggtctctagagaagaatattcctcccagatccgagacaaacccatccgacaaaatcggccggacgagctcgtcccacttggacggagcacacagcgtctcctcggcgaccgccggcgctcgtccgcgcctgcgcccaccggcttcttcgtgaccgccgacggtcgtggctcagcgtctcctcggcgaccgccggctctcgtccgcgcccgctgcctcctctgtgaccgccggcgctccgccacgaccgcttgccaccacctctacgaccgccgactcttttccacgaccccctgcctcaacaccggtcgccgccacgagcgagatgctcggcgccatcccaccgctcattgcgatgctcgacgagagcggctgcagtgatgtcgacgcagcgggctcgagtggcggcgaagcttgaaggtaggggggcggcggcggcggatccagaggagggggactcggcggtggcgaaacttggaggtagggagagcagaggcggcggatctagcgcaggggatctcccgatccagccgcggcgacgacggtgggctagcgggttgggtgctccggcggtggtggccgtcctgctgctgccgctgtgcttgatccggttgttccacgcgtggatgcaggtggcgcagtcgacggtcgttgacggtgatggcaaacaacgtccatcccatttctccctcatcccttcaaccaaacaaaaaattaggattgtcccatcctacaaaccaaacatgtgagtgtaatcatcccaaccccaaaatcagggatggtttcatcccatcccatctagttccgaaaccaaacacatgctaagattggtgtagagaaaattaaacctttcgcttgatgaaggttggatcacgtataaaagaggaatttccatgaagcaaaatagcactatttgatttgattcatgatgctccttttagtactactaacatatatctatgttatattcgtatgcatcatcaataagttgatgtgtactaccaccttttgttacaagttaatcctgtctatttgtaggcaatagccaattactagctcgtatagcctcgtaatcatggtttgccacaaactagaagcgaactaattaattcaatcttacttctaattagatggcagcatctatatctcttgcaaagatatgcaagattcatctagagctcttttgttttcctttcttaatttgtcgcaatcccaaaaagatatatcactactaatggtgcagacagcatgcatccatatatcacattcgctagtttgcacagctggtttggatatttcatcgtccatatattcgttgaatcattgaacaccttacatgttactagatgcatacctttggaccctccaaaacaagagaaacatgttggcaataggatggtccgtttggacgactgaaaatcagtgtgtggttgcagcttgtgcatcatctctagcggcctagcttcgtctgtaccctgtgtagtatagtagtatcactttctcttttatagatggacatggagagagatttatggccatgattttggtttggtttgctcgctatcaagccaactgccaacctgaaagcagaacagtagaagtacgcgcaatcctttagcagcaattggtacgtagtaggacccatcttcactgtgcccatttgcagagcgtccccggaaacacaaattaatccggtgtttttattagggatcaatgcatcttgtactagcatttgtctgttccttgtgtaatcttaccaggcaaaaaagtatcgctacaggaagtgttttaaaaggtgtctcactggtacagtataaatccaccggttaatcctgcttttagctcgccgctcaacatcatagtactatgaaatccccatccctctttcttccaaaaaatggagaaaaaatatccatccttcacatgaatagtgatgacaaatccactgtatgcgtaaacttttcagtttatggattatgacgatcatactttgtcctagcctcctactacttccttcaccagtgtatcttatagtacaaatttttaaacgagcttataattttcttatatttccttcattcatttatgttgttgaataatcatcataaacttagttttattcatcacaagaatggatcgcctttccaggaattttccggtatagtaaaaaactgttacttcatcaaaaaatagagtcaccgataactggttttgacatgccatattactacagatctaaacatcaggtcaagtcaggttcataatataaaaatgtgtctaattcaatcatacaatactatattaattttaaaatgaacgaaatacttcgtagcaattatgttatactagtaaaaccgacaactaggatcacacgtaccagatcgacaagtggtagcttgccaggaaacgatctctcggcacaagtgtaccactagacaaacttaagacgttttagctagccagccacccggcgatcaacacgtacgcagacacaggttacttatggaacctttaaacccgagcgctgtatcgagtcaatcggaatcggatgtacgacgctgccgaccgagggcccggggccgctggctacgcgatggagagagagagagagacagatcattgccttcatgccgatcggtgggacacggcaaggcggcaaacgacgatatcgaccggtgcactgcatggccgggacgacgcgcgtcgagaaatcgcgatacgatcgaccagcgtgcagcgcagcagcagcagctggctccaatcgatcggcaatcacagccacgccgcggtgccgggtgcgtgctccggtggacgcccaccacgtgaggccgtcgcccgcaccgcgtacgtacttctcctcggcctcgcacgagctaagccccgcgccggtcggtctccggctttctggaacgggagagccctgcacgactccacccttatttactcatccctttagctttggacattgtacagaccacacgaggagtgtactcctcaccctgcagaaaaacacgttcgcctacagttttagatcgtcaagcaatgccctgaaaggctggacggcgaggatccaatgaacagggacggtttgatcaaaagctctcccgtacctgaacggccgggccccttcttgatgatattgatgatatactatagggctagcttgcacacagctagtagtagactctaaccatcggccgtacagacatggggggaggagggagtacactactcctgcagcgcgcatgtggcgcgtcaacgatttgtctcccatggggatcgacggccccggcgcgtgcgcgggacggtacgggacgcgggcacggaacaacaacgatttgcccccaatcatgcggcgaatcatcacaggcccgggccgcctcgcgccccgcatcactcggtgtcacgtatcaaaacccacgatttcgcgcgtggcgcaggcgggaggtaccgttgggctagtcgattccacggctccacagtccgctcggtgaagcgcgcgccgtgcgtgcagcatccggtaaaacatttggcggagtttgctagaaatatggcgtcatatgctatggtggattttttttcagccacttacacagtagttacaccttatttacaccccacttacatatataattagtatgtaattttcgaatttacatatataattttagtacttacatatgtaattttgagacttacattgtaaatacactaaaattacatatgtactttaggaacttacaatataaatacatgtcgactattttttgataaaaaatatggcgccataaacatagctacaccctttgagcgtagaaaaaagacataagaatcaaaatagagaagtagatataaaatgattctaataggctgaatcttatgttataaatacttcaaaatccatatgatttaagacaatccataggaattttataggattttggtttagttatttatttgtttagtactaggagtagtaggatttaacccgctatttgaaaggccatttatgatttctttttcaaatcgaattgaaatatttcaaaattgctatataattcctatatgaaatgcaagattgaagaaatagataaataggaaaaatacaagattttgatagcaatgtacatgcaacacaaaggattatagaacacacgaataatcgtttgattaagtagcagggaaaatgcaagaatcgggcaagagatacatatattcaaaggaacttttttaagagagttagagtttttgctgatttttcttcgtaatctctatagatcgtatgtcccataggatttttaaagagtggtgggattcgatatatcctttgtctccatggccttcttataatattactttataaactcaaaatacttcaaaatttatttatttatcaacaaattaaccaagagggactaaaacgtcattctaaatatacatgtaggaacattttccatatgatttgaacccccgaaattcctttgttcaaaggaaacctcgagttgcaagttttctggtatgggtgtatgatttgaactcttaactcttgccatgctcacacttaattactttgtgactagtgttgtgcttgtttattataacgggattgggataattacagactgatggttttatatgtttttttctatctattatttctagtggtttgattttctcgtgaagatattagttacagtggtttttcaaaaaaaaattatatggaaaactacgtctcgagagaggataacgactttggttctaaagctgtacttcctccgttcaaaagaataaatgtaagattagatgttcgtcgacgagggatacccatgcaccgtattctgagagtattgtggtacgttgatacaaaaatctgcacgatacgatatcaagtacacaagagatggagattatactgatcgagacctattgtaaggtaatagtcctaatccaatttatgttggattatgaagaaaaccacatagtacaatagagaacaacataatcttgagattaccgacgagatccctgtcaataactactcgatgaccaagtctttcggattgctcctattgttatgggtcttgcactaagattcgatgatctgtacccctaggggactgtatttataccgtgaatcactttagtctccgagtagaactcggagacaatagaccctatacggtacgacaacatcctcatcttttataaataggactctgacacattctattcgtagatattatttccttaaaaactcaccgattttcttaactcaaaagtgtcctttccgtatacttgagggtatactccaaaaatagaatgtactcctccgtatgcttagcagatgtgacttaatctaatacaataaatctgaacaactttctattttattcatatggttaggggtgggcatttggtctgaccggaaatttcagtatcggtcttcggtcttttggttatttcggtctttgaaaagtgaagaccgaatttcaacgcaaaaatatcaggatcgacaaattcggtctcggtcttgaccgaaattcaacaacattttcatatatgcaaataaataatggaaattttcaacctaaaaatcacaaaaaagaaatcgtaagcatgcagtatgagcaaagactcttattaggttgcatgcctaaaagaagtagggatgtgaaaagtacagtttaatcctattgaacttagtggattataggttgtatttagatttttttttgttaattcggtcatttcggtctattcagttaaccgaggagacgaaccgaattaacccaataaaattctatcattcactgcctaggaccgaatttctcggtctcggtcttttcgtttcggtattttttttttgtccacccctacatacatacggtgagagtagtggagatattttaaatcggtgttgcacatattttacgtgagctcctggtacacatcacacctcatcgaacggaagtgcttttctcaacgataactgctggtagctacaggtaacatactagggtggtgtttagaaaggagggaataaactcacaaaagcataagtcgacaaggattttctacacataggtgccatgacacccatcatttacatgtgtcacaaatagttatagaaaaaattgaaaaaatttaataacatcgtttgtgattatacaaatctatacacaaacatgcaagactaaatttgatctacaaatagagaaataaaaataataaaatcagacagtgaatagtacccgtacagtgcggataaaatttgttatttttgtttcttcatatatcgatcgaatttagacttacatgtttgtatagtgtcatatattatcatggtctatctgatcaaattttatgatatttttatataactgtttaaattacatgcatatactttccgacttacgcttttgtgagtttattcgctccttcccaaacaccacctaacaactccaactacaccctccgtcctaaaaaaaaagttcaatcctaactacgaacctggatatatgtgtgtgtccaggttcatagccagagtttgggttttttttgtcagactagtacgttgataggatgattttttttttctttgaacaagctctcaacgataacggcttttctcgcttaaagtttgggcacctgcccagcttgatcaatgtgacattttatagaccaatcagaataacaagagaggatggaggtacacgattgacggtggactgagtctgtcacgtcttgtcgccattaatcagtttttgagagccttggcctgcactgaaaaccatgtgtaaacctacggttacttttatggatgtccccgctcgttccctagtcttgtcacattacgtgtctgtccgtactcctctctagttagtcaaaatcatccaaacaaattaaacaacctggcgaacaagtttaaaagtgttgggttgtaattcaaatttaggctgtatctaaacttcagtccttttccatcacatcaacatgtcatacacacacaatttttcgatcacatcatcttcaatttcaaccaaaattcaaactttgcgttgaactaaagacatccttatttgtactccgtacacatttaacgatcaacttcggacggagtgaagcgaaggcctatcgccggaggtttgaaccggactgaagcgttattcttttagggtttcactttcatatatactccctccgtcccagaaaatgccgattcctggatgcccgaggcaactttagcgatagctgttgaagaccaaaatacccttgcacaaagtacaacattcaattcatctttcaaataaaaaaagcaacaataggcaaagagattccctcgatccctccgtaactacctgcatcccagcacagcgtaccacacgcagcaagtaggagtaccaaaaacatgaagaaccaagaacaaagaaaaagagaaatactagaacatctctccaattgagaaaagaaattctctgaattcacctgtacgaactgctagtactagcaatagcaccgtaagaactagtactactagaaataggaggaacatagcaagaacccaaagcttagaaaaaacgaaatgtggcgttgtttgctggctcgtgcatggagaactgtatcagatccaccgcacatgatagaagaccccgtcgctgacaccgtggccgctcgtcgcctccgccgccgatgacgcccatctccccgtcgcttccgccttctccaacaacacaacaacataccccctcgccttcatcgtcgatccgagccgcatccgctccgctcacaacgctccgtccctgcatccttgtggccgtagcctggtggacgcagagaaggaggagaggtgggagaagcaggaacgaaggggagcggcatggaatagggagggaggtgcgggagagaggggccaagcagggagggagactggagggggaaatcagtagtgcctcgcttccggagacgaacagaatcgatggggattttagatctgtgcgaactcgcgagagaggagcgagagagacggagaaaagaagaaagcccgtgagggaggggataaggttcaagcggtgggaacgtggggagagagatgccgtgggcccatccgagatgacattcttgtttttttgcgcaggagtcgagtttttgtgggacaaactcccccctccagaattcgactttttctgggacggagggagtacttctcgtaaacagtcgttcggtgttataaccaccccaaaatagtaaaaaatatttattgaccggtatccattaaatcttactatgattgatctaatctattattgtttatcgattatttgcctatcattttctaacaacaaaaagaaggagctttattgctcaaattactcccgttggccaggggcacgtagctggtgaagcgtcgcgcacgtacgcgatgcacccggcgacgagaggccgagacgtggacgcagaaagcggaggggggtcaaagaaacaaaaacggtgggtttgcagcagcaggtgggaggagcggaaaggcggaaagccgaggaggaggcgacagcgggggccccgcggctcagagtgcatacaaagcttgcccccgggcgacacgggcccccgagcgcgagagggaggcaggggcaggcaggcgacgcgtcctttaatcgaaagcaaccaacacaaggcaacagggggaagcagcgcaagcaacagcgataacaaacgccatttcctcctctcatctcatcacatttctcgggaaactattctaatcccgtaagaaaatattccctcgtttacttaaaaatcatctaaacggttatgaaaaattctgaaaaatttgacaacattcatacaataaatatatacaactccacaaaatcttaaatccaaactcaactcacatgtcgagatataaaaaagacaaattcagcgtataaatagtagcgtactgtttatatctaaatttgtcctttttgtttctcgatgtgttgatcgaatttgaacttgaattttggtggactagtaggtatcattatacactatattgtcaatttttttttagaatttttcataattatttgcatcgaatttggaagaaaaaggtatacgaggggatataggggttagaatccactcccacatttctctctctcttacttcctccgtcccaaaatatagttatttctagcacagtactttatttcaaaatgaagctatttttctatctaccttcacctctcaaccaatcacaaccattctttttcacctactttctcttttcaaccaattacagaccttatttaattattctcatctaatttcttaatacatgtgccaaccttaaaaatacttatattttagcacggagtaattatctgtgatcggctccggaaaagcagagcggcttctcgcccgggccgtcttgtcctccttgatgtctcgctacagcttcgataggagtatcacccacccattattactactgctaggatagaccactagtagtactcgttgctagcctcccagcacaagccaacaagttcttttgactgttgaagtacgcactgtactcacagtagagtaccactctgatcagctgtccgctgggccccacctaccacgccggatgccggggaaccaaaccaaccatctcacattctactactagtagcagtacaagtacgagtaaaaacggtgcttgtagtgtgtagcacatgaggtgtttagttcacatcaaaattaaaagtttagttgaaattgaaacgatgtaacggaaaagttaaaagtttgtgtgtagaaaagttttgatgtgattgaaaagttagaagtttgaagaaaaaatttataactaaggttgtgtttagttcctgaaattaggtagaagtttaaagttgagagtttatgtgtgtagaaaattttgaatataatgtgatgtgatggaaagttagaagttgagagaagtttggtgtgtaactaaacagggcctaaactcggccacagttacgggagtggagcgaggcgagtcgtgtcgaccgttggtatagcgctcgtgattcttggtgggacgacgacgatgagcgagcgagagagcgggcgggcgcacgggtccccatgggcaaatgcagtgccggcgccgcatgtggagaggagcctctggtggcgctgtccttcctgcgtgcggcagcagcagctgcttcctgcaaacggcagcctctgcggctctgacccacgcccgataaaagcgaggggaaagttgacgtgtgacgtttcactaccttggctcacttgcctacacgccccccttctttttccgcccattcaaccctccccctctacgagtagtatgccgtcaatataaagtttattgccaaaattttgatattctagaccgttgtggtattatcaaaattttgacatgatttattatatatttactgtagtttagcgataaactaaatggatatatatattttacaactctaccagaaactagtatggtttgaaatgacattaatctgaacaagcccagaaacttttcactctgtcacatcgaacatttaacacatgtatggagtattaaatataggctaaaaataacaaattgcacagattgcgactaatttacaacacgaatcttttgagcgtaagtgctccatgatttgacaattgagtgctacagtaaacatttgctaatgatggattaactaggcttaataaatttatctcgcggttttctgacgtataatatttcaaatgtgtatccgtatatccgatgtgacaaccaaacctaaatttttttcctaactaaacaagacctaagagcaagtttaatactatatccaactagtagcttcaaattatctataattaacttaatagctaatttatacaatagttacctataaacatatactattatactattaatacatgatcccacttgtcatatataaattacgtcttaaagtctgtgttacagttggctacaaatctgtagccacctactcttctatcttagtttttatctttttaaaatatgtttatagcttgtgttatagtctgctatggtaactgctctaattgtactcttcattactactccactgttgacgaaaaaatcgaacacactggcctgggagatctgcttagctcctgtgcagatccaaaccttgatgagatgcgggcgtgccagtcagtttgattctgcaaccgatatgatatgcaaatagtagatcaaaacagctgatcggctgacaagccgatggagtagttccaaccgatagccgataccagccgataccgatagggtttaagcaatcggctatatgtccaatgtaaataatgatataaaagcaatcggctgatgatgatgtaatataatgcagtataaaccaatcggcaaataatgatatgataaataagcatcgatccgaaggttaaagcacacatcgcctggaggtccgatgtcacaaaatccccaatattagattaaacagtgaaacctttgttgtcatcggctaaatccaacttatatgtatatgcaatccttatgagccgatgtaacatccagataactcaccggctgaaaccccgatgaaacccttattttggcaatcaagaagcaggttagatattatggttctaagcatgacttagtagatcaaacttaactgatgcagcactaagtatgaaaagaaacataatatctagacaatcaagccgttgactgagttttcagggtggtagatgtctaagctaatctaatctagcaacgcgatttagtcgataccggcagaaaccctaaaatgagaagcaaccgataaagctaaattgatatgttatgactagattaacagagacatatgataaatagttaggcaaatatatcatccaaaccagagcaatccaagaggtcgaatgtactgatgcagtcttgaacgacgctgacgtagacgatacaattgcctggaccggcggaacattggacttatatcttcgccctagatcgaagacgatgcagccccgcgtcgggtgccaagttccgccgaaacgtaaaaacaaaagtagaaataaaagggtggcgatgcgccaaattgtattgatcgtgaggatagattacatagaccccgggtgtacatatttatacacatgggttgatacaagtccttgtcggacaagaaagagagcttcctaaggataaaaggaaaagataaagtccttataggacactaaacacactttcctaaagatacaaggaaactaacaaactattcctaattaatagataacttaccatgccgtattctctttaaactcggtctcttctggataagcttcctttagtagatcaatttccttaaccgaatatagcaagaatccgataaatgacgacttgacaactctcatcggctaatctcaggacttcgaagccgatactgactctaaaccgatgactactccggtcttaccaaatttcactattaacatccactgatcaactattaacgcatgtgaagtgtacagtacggggtaggttaggttagtgaccggcgtaccattgtaccaagtaccaacggattcgattcggcaacaacagcacgagatcttttccatctcttgcacagcaaaatttatccgtgtttcaacatgttttctgtacgcggccttatctcctctcgtgcgttggagtagatgatcgagggggacacgcagctgtagtcctacagagtacagacctgtggctgtgagcgtggagatgagagctgctaccagtagtagtagtagtccatgggtggatgtgtgtgcatgggtatatctggcgtggtgactgtgagctgcttttggttcttttctttccgcactggcctctctctcggagctgtggcagcgacagcaccatcaaatttggcagcagcagcacggagcacagctgcatcaacagtcttgttgccaagcatggggagccatcaattttttgttcctactctaagggccggcctttttgcaccacacaccctgatacgcccctgttttctggaccaatacccgctcctcactaatctactcccacagtacatgattatagtagctcacctcattatgtttctagtgatataaccaatgcactcatgttcaacttcaagtcatacccttgatatagtgcttgttagatttaataccctactaaaatattggtagtgtcgaaacctacgtaaattttggcaccacctaattttttagtagggtagagttgtatttggttggaggccaatttagaaccaaactttaagtagaatatagaaaaatatcaaattggacattggaaatgccaatgatttggcttcaaaccaaaaccttcattaacactgttcaaactacccaaatattggtagggcacgttttggtgctaatcgaaaacagcccatagatacttgtatttacggctaattattatttcaattgtagacgacgtatccctcgacaacaaagtgtccatgataattttaacctagttttctcgagatgcctatagaaatataatacgtgtgtatttataggacgagtatagtatatgcgtgttgtgtcgtgatcatctgcgtttgtatagtacttttaaaaaaggttagtaaatggagtactccacactgtaacggtctcatcagagcccagccacagccagcatcgtggagtacacaggaacgtacatactccaattcattaactgtgtttcagttgcgtgtattcaaccgggtaagggaacaccggcgacgtatacggggggcagcatacgggcgcaataaaaacacgacaaatcgaatccccggccttaaaaccggtgtaatttgggggaccccggccggcgatgcaactctacgcatggaccaccaccaccacccccatcccgaccgcgccaataatgcgcgaggtggcgtgccaacgcaccagatattaacccccctcacgcgtcacacgtcgtcggcaaaaatccatccatcggcagcgcggggaaaaaccgagaaaaaacctcgctctccatccatcgtctccagccgtgacggcaacggggggcacggacacgggcgacgacagcgacacggcgaaatggctacaggggagatgaatgataatgagctgatcggtggcaatgtccttgacacgtttaaatttaacgtcgacagcgagtagtcgtaacggctacagatttgagaagaaacggaggttgcagaaatggcactaatcaggaattcaagcagagcaaaactaaggagtactactacagatcgatgagaaacagtgatcggtaagctcgacggtttcatttttgggaaaatattgggcacccatcttcgtggtcgaactcatgattttactatctgaagaaaaggtgcttgtacttgagatttgctgcttttgataagtttcacttttttccatttctgatttttttaaatgtggatttatcaccggtagaatcattgcgctgccccagccgtcgtgccacgtcggttgatcggaccacaccagtttgatctggccaaaacggcaaaacggtggtcaatgataagagcaggtacaatagcgggttataagctagctgcaaatatattttaaaaagataaatgaggagagagaagagtagtgggctacagatttgtagccagctatagcacggactttaagacgcgatgtgtgtatgacaggtggaaccaggtaataataatgtagtatgtaactattgtatgaataagctattaaattggttataaatgaattgaagcaaatagttggctatattattaaacttgctctaaggcaggaccttctctaattgtatgtgtagcactcctagaatttttcgtaggttggtcggcacaaatcccagtctactcacagtaatccctagtagagcaagtttaatagtatagctaattactaactttaaattatctatagtcaatttaatagccaattcatatacaatagttacctataaacatattaatatccggtcccacctatcatactcacattgtgttttagagtccgtgctgcagctggctacaaatatgtaccctactgctcttttctcttttttattttcttaaaatatgtttatagctggtttatagagtgctattccacgtgctcgtatgcagtttcccttttcttggtattgaggaaatcataacatccgaatggtcttgagtctagtgaaaacaaatatttctccctaaccaagcaatcgtacctgatattataatagcaggtacaatagcatactataagccagctataaacacgtatggagaaaataagagcaagttttatagtatagccaactgctagcttcaaatcatctataatcaacttaatagtcaattcatacaatagttacatataaacatatactacacaatcaatatctggtcccacctatcatacacacatgcgtcttgaaatccgtgctgcagctagctacaaatctatagcctgttgctcttacctctcctcttttatctacttaaaatatatttacatatggcataaagtctgctattgtacctgctctaaaagagaagagatatgagtagtgggctacagacctatagccagctgcagtagggactccaagacacaatgtgcgtgtgacaagtaggaccatatattaatagtgtactatatgtttataactaaatattgtataaattagctattaaattgactataagtaatttggagctactagttgggtatactattaatcttgctctaatacgctgtaactatactttgctatttgcatttatttaaataaagaaaacattattaatgttacacaattatattaaaacaacacaattattctaatatcattttcgacgtctacataactaaggaaaagaaaattgtgtaaaagaaacagacgcatgcctaaaacatgaagaatcaggcatgagtccgtacaactatagggtgatactaattgctttcgtatgtgtaggatttctttgagctactgacacgtgggatatactagattaattccttctctctctcgtttactgtcagccaaacgaacacataacataatcacaaagtacggcaatgtaatgatccccacctgtgtttcaagctcacctgtttttagctgtttactgccgtgtccgcgtccaccccatatttcctgacgcctctccatcaccatgtcctctcctcccacctctgcccgcagccgcagacgcagagctgtctgctctgcaccaccactgtgcgcgtctcccgcctcttgcgctctctttttcacctttcccccatttctttattcccccacgccctcatatcccctttttttacttccccgtgacaccaccagtagagtaaaaaaaatacaggtatagtagcaagtactccttgtacggttgtactacgagtagaagtagaagtattgatttcaactggcacggccagtagcagttatactgggttcacaattccagtgaaatccgatttgaatttcgcgaaatccagttttcttgaaccgggttgaaaaccagatcattccgtttttcgatcaagttaaactttggctgtgtttagtttctgaaattgggaagaaatttaagaaaaattgatagtttgaaaaaaaagttgaaaatttatgtgagtaggaaaatttttggatgtgatgtgatgtaatggaaagttaaaagtttggaggaagtttttgattggatttcacaaaattcgatgatatcggtcgtaagcggatttcgatccggtatacctagaataagcgaaacgacatatttataaatgaaaagtaatttataaataaaatttctatatacgtgttcttataaaatctaaaagtacataatgaaaaatagactttaataaaaaaattttaaaaccagctataaatttaaggttaaaaatttaaattttggctaatatatgtgggcataagcaaaaaagacgaggccccgggctcctctgcttcttttgggcaatagcttcgcgtagcttagctcggcttccccctcattcatggccattaccacgatgtgtcaccccaccccaccaccgcccgctgctccacttctcctcctcctcctcctcctctcctagtagtagcaacctacggacaccacccccacccgcttcatttatcacttgtctccccctctccctcgcctgctccgctgctcttgtgcttcgcgcctcgcctgacctcgctgtcgctgccgccagccatgaccgggatcgacctcaacaccgtcgaggaggaccaagaggaggcggcggaggaagtggcggcgaacggctcgtctccggctccggcgaaggcgggcgcggtgtgcctcgagctgtggcacgcctgcgccgggcccgtggcgccgctgccgaggaaagggggcgtcgtcgtgtacctgccgcaagggcatctcgagcacctcggcgacgcgcccgcggcggcggcggccgcggccgccgtgccgccgcacgttttctgccgcgtcgtcgacgtcaccctcctcgtgcgtcccttctcaatgctcgtatcgtacgtgttctcgtcttcacggcggcgcgaggggattgattggctttgtgttcttctctgcaggcgaacgcggcgaccgacgaggtgtacgcgcagctctcgcttgtcccggagaaggaggtgcgcgcccgcctgcgcgaagcagttggagcatttggtttgatgattccgttttttttttttgttttttgacctgagttttcttctcttctcttccggggattgaaggaggtggcgaggcgggcggaccacggcgagggcgaggacggggacggcatgaagcagcggttcgcgcggatgccgcacatgttctgcaagacgctcacggcgtccgacaccagcacgcacggcggcttctccgtgccgcgccgcgccgccgaggactgcttccctccactggtcggtgtatattggagaaagaaaaagaaaagcttccttttttgaagtaaagattttatctttttttgggggtttgtttagctgatgaaatccttcggattgggaaccttgcaggattacagccagcagcggccgtcgcaggagcttgttgccaaggatttgcacagcactgaatggaggttccgccatatttaccgaggtagagcagaaaaaaaacatggactttgagaacaagtttttttttaacctgttttgatgactgagatgctctacgcagctgtgccatgcatgcattccatcttcattaggcttctgtactgtgcatgcacttcccctggctggaagcctctgcgtcctgaatgattcaatggggattgaatattagtactggatttgtgctttagttgtttctgacgaccagcgcgtcttgttcagatagagcagtaatagcttgtgaatacacacatgcatcaaccgagctcaccgagaacttgcactttgcggttatgatcgacatctgtactttttgcatatccacctgttttatgatgctaaatcatgactgggctgacatgatatgattgtatgcaatgtgttgattctccaaacactctaatatgtgttggctaggctacattatgtttctccatagctccgacattgttagttaatcaatcatgtttaactgtattttacattttttcttctttcttaaaaacctttgtattgtaatgtctggtcccttcttgaggattgcaaaggacaaacataacaagttaagtggtccttgatttctgatagatctacatctgaatatgctacaggccagccacgtcggcaccttttaaccacaggttggagtgcatttgttaacaagaagaagcttgtttctggggatgccgtactatttttgcggtaggccactcgatcattcagataattatcacatgttgacgatcttttctaaagattcttaatcaatctgcagaggtgatgatggggagctaagactgggagttcgccgtgcagctcagcttaaaaatgggtctgcttttccagcactttacaaccagtgttctaatcttggtacacttgccaatgttgcacatgcagtggctacagaaagtgtgttcaacatatactacaatcccaggtaatgaagaacctcgagttattttgttaatgctcccgacagctgatgttctagaactttcttgctgttggctggtggcagccttaaattgtgcccattatttactgcttgtttgagctatttgttgatagtcatacattatgccagctcagcatgtgcaatcacatggttttatctggttgcatttgtagtcttgctgaaattcgaagttaggcgctgttgcaatagcttggaaagttgtatttgtaggttgtaactgttctttttaaaacaaaagattatatgaacagaatcaatagtctcgtttcatatatttatcaatgtagtcgttttgcatttgatgctttacagagctagcgcctacttctgttcttgcaacaaaacagtgtcttatttcaaagctctcttctgaaatattgacaggttaagtcagtccgaattcattgtaccctactggaagttcatgaaaagcctcagccaaccattttctgttgggctgaggttcaaaatgagatatgaaagtgaagatgctactgaaagaaggtagatggacaatagttctacacttgtactagaatggactgaactgcattctagattggtgatgcatatgtgataacttataattttacaggtacaccgggataattactggaagtggtgatacagaccctatgtggcatggttcgaaatggaaatgtttgttggtaaactaccctatctcttgtgcctcgtaatatatgtttatgggcatctgctgtgtattcaattaacattttttttgtagtgttgctgccatttcactaattaaacccttgtttttttcctagtgccgcgtggcatttgcatcatgtggccatcttgacttgtttgtttggattatattttacatataacaagaatttgatgctaatcttggttcccaaatttgctagcatggaacccattcactctattaactgatgtagcagttgagctttagtttacatattactaaaacacagtttagttgtcttgatgcattttgtttcttatccaaactcaagtcagatagtagtgatttttcatgaactcaatctggaaagtaacaggttttcagataattgagcactgcggtactattacacaatgtcagcttacatggttatgttttcagagtgacagttgcactgactagcaagtttggttgctcacaataacagtcttagatttgaagatatcagttaatcttcctggtttgttttcaaaagtggtaatcttaacttgcaatttgacttccactagtagtttttgtagctagtctagagctgtgttctacactcagcctggtttcttcagcgaaatattaggtggatgaagttatggacactgctagcttgatcttcttttgaaattttaccttccaggagtacttaggcatgtgaaagtttttagactatggctctcctgagttaaaatttcaatttttgagcacataattctgttctcatggccacaccataagtcccgtaaaagccattattgcaatcagatcctctttatgaccatatgtatatgatttatcgacctatgtctaccttggtaggtgaggtgggatgacgacgctgagttccgtcgaccaaacagggtctctccttgggagattgagctgactagttcagtgtcaggatcccatttgtccacaccccattcaaagcgattgaaaccatgtcttccccatgttaatccagaatacatggttccacgtatgtctttcttctagctattaccagttaataggatggttctgttggatgcactgtgccgatttaatttatccttttgtcaggtggaggtggttgtcctgattttgcggaatctgcccaattccacaaggtcttgcaaggtcaagaattattgggttttaaatctcatggtggtactgctgctgctacttctcagccatgtgaagcaaggcatttacagtacatcgatgagcggagttgctccagcgatgcgagtaacagtatcctaggggttccaagacttggtgatagagcaccacttggaaacccaggattttcctaccattgctcaggctttggggagtctcacagactccaaaaggtcttgcaaggtcaagaattatttcgtccctaccgaggaactttggttgatgcgtctatgggtagtaatgggtttcatcaacaagatagtcctcgtgcaccaggtgtggtgaataaatggcaggcacaacttcatggccgtgctgcttttcatggaccaccagcactggctcttccatctcaatcatcatctccgccatctgtcctaatgtttcagcaagctaattcaaagatgcccaggttggagtttgggcatggacagttggacaagcacgagaatgataggcgtgttaggtttggtccttctgaaggaattgaaagaagagagcaaagaataccactccagccttatcctacttctggagaagtgatagatggacaggttacagttgagaagtctcactcccctggtcgacatggaaaggatggtccagataacaaagctgttggcacaaatagttgcaaaatatttggcatctctttgactgagaaggttccagcaagagaagaactagatgatggcgacgccaactattcactccagtctttgaagcaagtgccaaaatccctgggcaatagttgtgctaccgtgagtgttttatgatgagtaattttcatgcactcagtaatgtaaactgctttttaactaaaagctctgcaggttcatgagcaaaggcctgttgttggcagggtgattgatatttcaactatggatatgatgatctgatttatgagctggatttgcaaaattatctggaggtgaagtaacactaggattgcttccaaccacatgttagtgatactccaaaggcataaaatcctcacctgtgacagttttacctagaaatgttatgatcattgttttgccgttgttccagattttgctgtggatctccagatggtggccgagtatcagggagatggagggactgatgattctgatatttttatcttagatgtaggcgttggagcacttatcatgtgacatagtacctagctgctcgtctgcatttgttgcctctgcaactttaactgtcagcggcatttgtcgccgctggaaccatctaagtacgtgtttataagctgtaagctatgacaagcgcattagagggtgctggtactgttagaacattaattaatgtcagtagcatgctttgatcttacgtgatgcttttcctatgttgaccggagttcagtataacatgatggtggctttgggagacctcatgttttgaaaccttggtgctgatcgctgatttgtaactataaatttagttgtatttctaccacttagcttattaatttatcatcgtttccatcaactaaataagctcttaaaattatgcgaatcaagcctatgattcatgaagatataatgcggtataagagtttgggtggagtagaagaatacctctttggttttggaccacgtttcattccatcttttcctctgattctttctgcaacataaacgccggtcttcccaaaccacggcccagtttgttctattagctagttctctggctgttgtgattatttgtgtaccaagggtccataaatcatacataagcctgcactggaaacggacaattgaaaatggctcttcagaaactttgtttctccagcactgaatatatgagatttgagagagacagatacaatattggacctttactcacatcttgccgtgggagctgcccatgtttcattggctacaagtagtgcaaataatggttagaggggaacagaatcaacagatgctaagcagggccagatgatcagactgacgtagcaaccacattccccataaaacataccaaatacaacagcaaaagtttaaatttgtccctagctacaataattatccaaaagggcagtcattttctagagcttcattcattgctgtcatcctcgtcgtcagttaaatcctctatgttttcagcgtctggagcagaaggccctgacgagcgtaattcatcgatttcaacctggaggagggaatcacaggtaacccttcctacttgtaagactcttgggcaacctggttgaacatacaatctgaaatgagcatccgtgaaaagaaaataaacaatgaggcagcgaacaaatgacctacctgcgatagggcacttcggaggtttttggtttcttatgtaatgcataattggaactttttcatatatgtgcctacaatccgcactgaacaacacaaatagccttgagttcaacgcaaaaactgaatatctgcaaatatatgttcacactgctttctacatgcaacaacttaggagaaatccatttgactgagaaaaataagcaaattaagtagtaggagtttccgatttgaattcaattatgtgaatagtaaaactgtagaaagaccttacatacaggggaatgattagtttgaatcatgcctaatagtcaaattggctgaaaggattgtactggtagaaaccgcactatttctgcccccagaaagctatacactattatactttgaacacaatgatgattattcagtgacaacagcaaacttgttctactgcatggaattttcacagaaagacaagccattgttaccgcaagatgcaaaccatatggagaaggaaacagatcctgatgatctcaacttgggcagcaaaagaaaattggagaaacataatcctaaggctttgcgacatgttatttgtgccaacaaaaacttggtctttagcaggtgaaatcagattaatgatggatattttttgggacattaagttgtgcttaaaaacaaaatgagagtatgtgttctttgaacaaccatgaaggaaactatctagcatatgtaacatatcataataaaaatttcctagagttacaaaacaaaaccatgccttaacagtttaactgcttaacacttaccaccgaactggctctgtcaattgaattacaggcttcccagttaatgggcacgtgacatttaagatgctagtttgggtactggtcataagaacatcctcctgttcatcaccaggcattggttggccagcatggtgaacattctgtagaagacaacacaattacagagagagaaaataattagaagtaatgcacaaaccttttactttctccaaacatgacctattggagataccatactaaaaattgcagtcatttcaatccatctttaatgtaacattttcagcaatagttcagcaccgagctaactcagtgaatatataggcaaaaaagtacataatccataccgttctcaacagccattagcactaagggagaattaacatttgtaaattcctctaattcctgatctaccgcatagaaaattgccaagtctctcaaaacacaaagggtccacggaacatacccaaactgcctctctgaactgccgaatgagcagatggttctctactgatgttgatgagttccccttgaccttgttaacctcagcctcgatcagcttttcgaaatccgtcatcttgacacaaattcagtgatcaataccaaaacaacaaataaccatttagccgaaattcctccaatacaattcgaataagcccctgaaaccaaaaaaataatcatcgcggctaccagagtccgcacctgattagatggctggtacgccccaggcaccttccggatcgcgtcggcgtagcacgtgcaatcttcgcacgaagcaaccagttccagcgccgccgcctcaagctgcttcacctgcaaaagaggataacgatggtggttatgggtttagggtttccgcggcacaacgccgcgtgaggttaatgtggggggagaggccgcgtgccttgtcggacttgttctccctctcgtaatcgacggcgatggacttcatttcgccgatcgccttgcgaatctcctgtgggttttggggggggattcgatgagattgctagggttttgggggtttagcggagagcgggcagccgagtggggattcttaccgcgataagggtttccgcctccgacgactccctctcggcggcgttagtgagcttgttgaccaccgacgacatctccggcgaccggcggcgatctccgccgcgcccgctttcccgcgatttggttttggttttggttttcgagggaaagagaaagccgtcaggtggatgggtactggaggatttgagcctttatatcttgtggatttgtagcccatgaaatattttgctgggctagagggcccggccagtcaactagcccagctaatggtagaaatactttgagcccaagttagctttctctctttcttttttttgcagggaggctcaagttaaccttcagaaattactttgggagttttttggtagcaccacatcttggattaaatcgtcttttaacaaacagtacaaacgcagatcatagaacgtgcgtacgctcacccttatgaacacgcgcacaacctacctctatgagcatctcctaaagactgaaccggtatatcttgaaatcgacgaagtcatcacgagcgtctcgccatcgatagatacgtcgtctaccactgaaataataattaaccgtaaatcgttgtgatcttcaattcacttacaaactactagtgagcgaaatcatgtgaagttggcattggcaagaagttatatcaactgcaccgtaaaaattatcgaattttggccagtaggaaaatgtttgatccttggcactaatcaaactgtagtagcaacaggattccgcacctataactctgttgcaattcgagatgacaaaaacatcgacaaatctgatggtcaattcaagcaatcctcaatccagtggggcaaacctagccaaaccgagatgctctcttgtataacaagctcagaatatttgatggtaatttaacccagtttgaagtttgaacgagttctagtagatttgtggggctacacttggtgacttggagtaaatttcataaggtgataccgatttcaatttgaaccaggcattagcaaggcaatacgcagcaattcatcatgtgccataataaaattcagcagttctgcctgcctgacctaaagccttggatctgaacgttctgaactgacatgtcattcatgtggccacctgcgactgcatcttgcctgcaggctggacaagcatatggatcccaaccttcctatgcagcaagcgggcgtccatggctaggaattcagagccctccagcatgtggacgaaccacttgtcgatgtagatgtaatcagtatactccaattgcatggcaagcattgaagaacagacagaagccatgggggcgatgaaaattgctgccgcttcacgcattcgaaaaataaacccacggatattgacttcaggtcatacaagatgctcatacttagttcagtatacataatttattagtttacagtgtaactgataagagaaaagaaaaagaaattagtgtgatcaattaacatttctcagtgaagtttgaactgtcgagaaaagaaatcaattgattctagaactttcttgcaaagatcctcttaatttaatcagaacggcaattctgtatttagtgcaacttgtcatatgaaattctgaatgccagccagcaaagagcccaaattgagtggggtccggtcaactaacctaacctacagaacatcaaatgaaactgcaacgaattttttaattaattgtaaacaataccggcctaattacccacgtaaatttcactgcaaatcacgctaccgtttctgtattctgaaggcaacggctactctcagtctcagctcttgtcgtatgctattgcaatctgcaacaagtcgcataatcaacggctgcttctgactgaatccaattcttttactcgtgtaggttcagacttcagaaagcagaatttcatcagcgcagagatgcgtgatcatcgtcgccctgatgctgccacgacgaatccttaggagaaaaaccgcagtgatcgattcgagttagtttacgcaggtcaaggagagatcttacaatcttagaagaaatgaagcccacatgatgatactctcagagactaaagaatggaagattggatttgtgcacagtggtcacccatgtacagtacagaatcccattaacccagtagaacatcgcgttgattttgtggctgcattggagcaccaaaccatcctacaaacacaagtgtttttcttaatagtactactactgtgcctttgaatttttttagtgattttccagttcataaggagatactggtatgtactatatttttcgtgtaaaaatttgatacctctcggtattttcggactaggagatactaaattttacattacctctcaatacctccggtactaagagataccaaattttagagaccttttacagtgtttgcaaggtacttagagatattgagaggtgaaacaatgtgaaccattgattaagaggattaaaagaggggcaagtatggaataaaattttcataactaatagcaatggagtaatcaactactaaacgatgagcattttgagtgaatcgaatacctggatccaatcaccagtattgttaggtagaaaacaaagtaaatctttcgaacaatttaatgcatcgatcgatctgcagttctacatcggaaaaaaaaaagagatcgacgcctcctttcttcgaccctttggcttagttcttgttctagggtttgaattggtccactagaagaggacaaagggagaaatatcagcatagttgagggttcaagatggaccaattgacggctaggcgcaatcgcatcagataagatctactctgctcctatactatttacacaattgattcgttatttacatagttaataaattccttcgtataaggaactaaaatgagatctcctatgtttttcttctagggtttgaataggcgaacatgtaaggagacatggttgagagagagaagctctaatatcttgttggttaatctgacatagcatgttcagatggatgcaatcattaggtatattttctctacagtttatgttttccatgaatgtaaaacttaaatcggcgtaacccttgagttatattttaatgttcttgggaacaaaatataaatctcaaaataactatgcaaataatgtaatggagaattaatgggaagagttctaccatgttcttgggatcaaaatgtaaatctatagaaaaccacgtaaatgagaactttaatactagtaccacacaaacaacttaactggtaccgacacggtaccgatctgaatttgcggacaactctttcctttcctctctactagcaaatttatctttttacttggtacctgagtgcctatgccaatactcaaataccatagtacattttattatggagtgttggatctttactctttttgaatgcaaacaccataaaaggttagtatctcttaaatactataaaatttctttttgttttttgtttttttggaaaatagaatttgccatgcgacaaactttaacatagttttgcatcttgcgcgttacacatcggaaatactagcatggcactaagtacagaggccggagatgtattactcatttttccatcatcttagtgcatttcattttaagaaaagctgtgtgctgctgtgaactagaaagctgaagaaccattatcgaaaaaagaaagctgaagaacacccctagcacctggctttattctgaagtgcgcatgggctcaatagcacacactcatatgatcatatcgtccaaatttcaattcgctggagagattctctccgtcgcaaatgggcaatataataaaaatcacaagaattattcccgtagctggaacggttggctcaaacgaactcctgtctttctcttcagtgtccagctctccatgatgatgagcgagtacatatacatacagttgtatgctgttcctgaaaattacctgctcaatcaatcatggcgcatcatctcgtcgtcgtgctcgctgcgaagcgtacgaacggatgctgacaaggaccaaccattagagtgaccatccccgttttgtgtcggtagatgatgctagctgccgttggagctggaagtttgtctgaaatctagaattgagctcatctcagaattgtgctagttgtcgatttcgaatcgtgcaagcctgaatgtctgaaactctgaaatgcatggctcctgaaacctctgcagttaaccgttgctctgcagacagatgactgacaattagcagtagataaaaacgcatttgctgcttatcctacagtaacacactgatttgcaagttgatgtgttttctgatggatcatgtgagctgcgaaccgttgatctgtgcaaaaaaccgcagactttcctgtgcgagctctgtccaattgccgaccgagcgaattcagtgagctgcatgcgtggcgtgcgtgcagttgaatttgcccaggaaagctcatcgaattcgctcccatgggggcagagaagcatcccatgtgcgatacatctgaaaaaaattgagttcaaaactcgagtggtttgatctgtcatgctaactaagccgatctgcatcttgaaatctgctgcaccttggaggagaaaacaaataccaaaaacagtactgaaaatttgcgattgattcccttcctgatctatgctcctgaccactactatcatctcgtctcgtcagtcaaatcatcatttggtcaacactaatgacagactgttcatccatccacgtcggctcgcacatgccgacagctacaaatgcagctcgatcttgggatataaataacggcatctcgtttgccgttgatctgtcttagctaactacttcacactagtgagaacagagctgagctgagagcaatggcgatggtggcgaggaggttcttggtggcggcggcggctgtgtgcctggcgctggcggcggtgccggcggcgatggggcaggcggcggcgccggcgccgaagggggcggcggcggcggcgctgaacgtgacggcgatcctggagaagggcgggtcgtacacgacgttcatccggctgatgaagagcacgcagcaggacacgcagctgaacagccagctgaacggcacgtccaccggcttcaccgtgttcgcccccaccgacggcgcgttcagcagcctcaagcccggcacgctcaactccctgtcggcgcaggaccaggtgtcgctggtgcaggcgcacatcgtccccaagttctactccatggacgccttcgacacggggagcaacccggtgcgcacccaggcgtccggcggcgacggtccctacacgctcaacatcaccgccacctccaccaaccaggtcaacgtctccaccggcgtcgtcgacaccacgctcggcaccgcgctgcgcgccgaccagccgctcgccgtttactccgtcgacaaggtgctcctcccgtacgcgctgttcggccccaagccgccgccgtccccgccgccggcgcccagcaagaagccggccaagggggacaccagcgcgtccgcggaggcgcccgctggctccgccgaccaccctgccggcgccgcccccgccgccgccagggccgccgggtggggcgtggctgccttgctggccgccgcttgcctcttgtaagatgagaaattcgtgtcggtgcatatgagatcagaggctactactggctgagtgcatgatgcatttcaagagtagttcttgctgcaacttaaactactcctcttcctctccttattcttctctctctccttgtgattgaacaaatttatccagtggttttgaagagtggatgacgaaatgcagtcgaaatgtttttctgtacattttcgtaaaaaatctacgtagatcttcgatctgtaatattttaccagagtaggtgactagatcgaacaagcatttttagcggtccaagcttaccaataaaaatggcatgttgcatttgggccaaaatgggctgcatttggacctgatcatccttaaccagcccaagattatcatgggcccattgggccaaacgaatttagcaaggcctcaaggctctcaactctatcaatctagtgcaaactgggccaagctggatatatgtatcactacggccctgtttagaggagtttttagttgctgcagctttttttagaatctcctaaaacagtctagcttttgattcaggttctaagaagctgtagttgtagaatcaagaaaatgaactagaaaccagaagctgggcttttctaaattctcagaaactggttatcaacttctttgaatcttaaactcctctaaacaggtcctatgtctggctcgtttatttcgtgatttttttgcatggaatgcgattaagaaaagacaaacggatttggtgccaagcacaagcatgttccggtgagcagtcaatttctcgatctctcgctgttcctggtctggaaattgaagcttccccttggctagctagctggaaattcaatttggtttttagttcaagtggcgacgtatgggtgctcgcctgtccatccgacaacaatgcaaattattttattctcgcatctctcgcgccatcaagatctatctatctagcatcagatgttttacgtgcttaaaaagtgaaggaaaacgcatctagcttagctggtgataccttcttaaacactcgtcgtgttccttaaaaaatcatttgtagaacgcctcatctaccaatggaccaatggagcaccggagtcggagaagaagctaaaaatactcaccaaattaatcgacgcggccggatggatggatggatggatggatcgggtgtcgcttccgagccgctgcgccgtcgcagtcgccaatatctcttccttctttctgatcgtctgcatgctggtgattgaccgggttcacgtatgtatctacaagattcggcaataaggccaagaaaagtatagtacttctgctgcaactgcgtgaatgcccgggtgtgtacaaggaggtagaggttctgataaacagctggtgccaaatggcaactacttcccccattctaaaatacactccctgtgttttataatgaaagattttctagcatacccatatttatatagatgttaatgaatctatacgtatatgaatatgagtaatgctagaaagtcttacattgtgaaacggaggaagtaagtgttttttttaacttcgacacaatttttagatgttattttcactaacaatatcttttaaagtaagatgttttaaataaaaagagttattgatctttttatatttttaccattaatagtcaaaataaaaaatggttaacttacactatttctaaaaatatttacattttagaacatatagagtagctagtaagaattatatagttcttactagctagctagctacttatatagttctttcaacttgtcttacatagttctttcatggattctaggatgattttataggagaagttacaaaccagaagctatcttaaacaggattaagtttgctttaatgtggaacagattctggtgatcagatattaaactgctagctagctgcatactgtcttatttgtatgagaactccattgatcaacggcacagtgacagtatacactacacccatcatgttctcatcggttgaaccgctactgatacatataaaaaaaatcagcacagttgcattgattatttgatttgattaattatgtatggttcaactctctcctggaagttgaagtggagtagtttcatattgcaagtctcgcacgtcagaaacgttgcggaggcactgtcaaacgatcaatatttcgacagggacggccagcttgcagtagaactacaactatactgtcggtggcaaacttcttccagttttgtatatatgacactgcatgattagcatacatataaaattctagtgatagattctttgctctctgatgttgaaaattgcagtgataatgtatataatcatggggccaacatgtacatatatgaactgaatgaatgcatgcatgcatgcatggtttgtggcccaacctaactggaatgcacatttcctgaatatacaagatgaacagacgacaaaatgttgagactgatcatatcattcatttgtatgtagtacaggtcacacctaataataatatcaaattgtaggcatcttgggtactttgatacagttggttttgtacatcaaagaagatattcgatcaagtttctggcagttaaaacatcgccctcgagaggtgcctccccggccgagactacttaccacggccgccaaatgcatacacactgcaaaaaaaaaaaaaaaatctcgtagtgcaggggaatgcaaactggtgtgcaatcatccagtgaaatttttgttctggtcgtgtgtgaaatttagatcgaaaggaatcaaagagtttttagcacaaagagacatccgctacgagcctatatattcgcaaaattaaggaggcaaccacatggatgttggcatggaaaaaatggcctactttatggacgtatttttttattttgtcctgtatataactgtattcaataaaatataacaagtcatgtgtgaaatttagaatgcaaggaatcaaagagtttttagcacaaagagacatccactacgagcttatatattcgcaaatttacgaggaggcaaccacatggatgttggcatgaacaaaaatggctttactttgtcctgtatttcactgtattcaatgaaatagaagaatctccaatctctgtcgtattgatttttttaagagaaaagggtatttttttacctggcctttttaaattaagaacttagcttttaaataatccaatctaaaattcgcttctataaagatttgaattcaagatcttggagtgctactcagggtactgtaaccactatgctacatgccatgtaaccactatgctacatgccatagtattgatatctagtgaagaatgtgaaataaacctgcaaatgtgcaatggaatgaaaatgttgtagcatttgctggcttcacttgggttcaggtagctcgcaaatcacatctaagctcacgcaataaactaaaaaaagaaaaagagaagagaagaaaagaaaagttggctatgattatgaaatgagcctcgctgcctttgctgttccaggcccacgtccagctcaccacctcaccttgatcgctcactcacactcgctcacacacacactctccctcgccaccaaccacactataagtctattaaacacgcactgctcccagctctcagatcgccgcctccaccaccgttcgtccgattcctcgccaccacacccacccacccaccaatggcgtcctcccgcctcctcctcctcgccgcgctgctcgccacggcggcggtgctggcggcgtcgcagaagccgaaggccgccacgccgacgaaggccacgccggcgtcgcccggccccgcggcggcggcggccgacggccccgcgccgacgaacgtgacggcagtgctggagaagtccggcaagtacaccaccttcctccggctcctccacgagagccgggtggacacccagatcaacagccagctgatggacagctacaacgggctgaccatgttcgcgcccacggacgccgcgttcgcggcgctcaagccgggcacgctcaactcgctgtcgtcgcaggaccagatccagctgatgctctactgcgtgctcccgcggttctacagcctcgccatgctcaccaccctcggcggccccgtgaacacgcaggcgtccggcgccgacggcccgtacaagtacaagatcaagccgtcgaacaacaacgtcaacatctccaccggcgtcaactgggcgctgctctccaccgtcgtcagcaaggacttccccctcgccgtctactccgtcgacaaggtgccgctcccctacgagctgttcggccccaagccgcccacgcccgcgccggcgccggcgcccgcgccgtccaagtccaagaccaagaagcacaagaagtccgccgggatcgccgagccgcccgtcgccgacgacgcctccgccgacgacaccaccaagaaggccgccgcgcccgccaccgccgtctccaggtgggtcgtcgccgccgccggtgtcttggccggcgccattctcgccgccctttaagctaaggagacgacgacgacgacgaacaaatgcatcgcccatgcatgccgtatgcacgatgactgaactggagtggtgaaccgaatccgaatccgaattgatcgagatcgattgaaccgtgtaccgatattgttgtgctgctctgtagtctagcttttgattcaggttctaagaagctgtagttgtagaatcaagaaaatgaactagaaaccagaagctgggcttttctaaattctcagaaactggttatcaacttctttgaatcttaaannnnnnnnnnnnnnnnnnnnnnnnnnnnnnnnnnnnnnnnnaaggcgctatctcagnnttacaaagcccagtc

SEQ ID NO: 101 - DNA, 15099 bp, Oryza sativa
  unsure (1)..(15099): unsure at all n locations
nnnnnnnnnnnnnnnnnnnnnnnnnnnnnnnnnnnnnnnnnnnnnnnnnnnnnnnnnnnnnnnnnnnnnnnnnnnnnnattctaccgcatgaatcatttcaaaattttcgatctggatctggggcatgtgtcacggctcacaataacgacatccactgatgcttagaaaaagtacgagtaggtgtgggtggccgctgccgctactgctgccagatccaaaacacgagagaggttggtagtggcagcagcctgagcagcacgtcgatcggtgcaatgcacagtagtagatgacacagtagatctcagcaattgttgcatgcattccagcgatgtttcgctgtccgtctcgtggcgaagaagatctactgggtgcaatgcaaacgcaagcgatcgttttcgctgtcagaagcgacaccgcaccaaacgacgatcgatactgcctagtagtactacactgtgtttgcacaatcaccacccatctctttgtacttgccaaaacccaagagaaaaaagaaccaaaacactccaattccatagaaaataaacttaatatgaaatgtgacacattctatcatattgttacgaatttggatagaaatccgttcagtacattgaaaacatatactcagatttttggcatacccatatattggagatgaacatctgggaatggaatctgtcacagaagtaattgatcaagctgatttttcgtgtacgcagtggaggagctgagcagagcggcgtataaagtattttcaggtactatacagcggatgggaggaacagagcatctgatccggctttgcctcacatggaacctacctacctactactaccagctctggatccgggcttgagcttccggttcttgtttgtgccgtgccggtgataaagtaatcggtggtggctacctcggtcttgcccatacatgtgatcctagtaatgaaccaaattaattttctacggatctctctctgggcaggttaacgttgtgcgcttttgagagtagtttggttcggtatccgttggattttacgttcgtagaagaatttaagtgcatttgaaattgagcatgctctcgtgtagccattcctgtggataaattaagtggtggaggttatatgcttatcaatttatgcccccggaaaataataatacaattttcgttcagcttagtctatgtacgtacaagttaatacgttggacatcttaggacagaatttacatcctactctcaaactgcattttctttttgttccagctgaatgggcaccaaatgttagaatatactccctcctacactaaatatttgacaccattaatttttttaaacatgtttaaccgttcgtcttattcaaaaacttttataaaatatgtaaaactatatgtatatataaaagtatatttaacaataaatcaaatgatagaaaaagaattaataattacttaatttttttaataagacgaacggtcaatcatttttaaaaaagtcaacggtgtcaaacattttgggatggagggagtatgtctaatatactagttttatttggttatacttgcactcttagagactaggtactactccctccgtattttaatgtatgactccgttgactttttaaccaatgtttgaccatttgttttatttaaaaaatttatgttattatcatttattttactgtgacttgattaatcatcaaatgttctttaagcatgatataaatatttttatatttacacaaaaaatttgaataagacgaatggtcaaacgttgattaaaaagtcaacgacatcatacattaaaatacggagggagtactatattgattgggaatgagtgtctttaatcagagctccgaaaatgtaggtttcagctgaattttgttaagagcaagtttaatagtatagccaactactagctccaattcatctatagccaatctaatagctcattcatataatagttaaatactacactattaatatctggtcccacctgccatacacacactgtgtcttggagtccgtgttacagctggctacaaatctgtagcccgctgctcttctctctccttattcatcttcttaaaatatgtttgcagctggcttatagcttgctattgtacctgctctaacaatagcacgtgtttatgtatcgttatatggcgtctcttaggctattaatgactaacatcgtttcgccatatgactaaattttataacattaaattacacgcctgcatacacttaaaaagagagagggataaagttgagttttgggctacacttaaaaaagcgggccacacgcctctctaagctggcccatagaaaaggaaaggctcacattagctatctctcattgggcccctgccaaaccgagcccacttaacacttgctcctgaaggcccaaatatcggcccataataatatccccggtaatggatgggcctaaattctgaacagggttggctaagctgccgccgccggtcttgccctctcgcggagcgatgcatcgataggcatggaatggccgtgttcagcagagaagaagctttcttgtccaatcggttcggccggtgacgcaagagacttgacgtgtacgtgtgtttgtgtgtgcagtacacgaatccatgcgtgcgtggtcgagcgcgttgggacaacgtggctcacgaacaccaagggctatacatcccggtgaggtacggtggcagttgtcaggcatgcagcagctgacgccgcccggaagcctgatctgatctgccgacgacaaggcgaaggcgagatttgagtttagaactactagcatcatcatttcgtacaagttttatgcgtaaattattttttataagcataagtatatgttaaatgatgggctataatgctagagtgacgtatatatatctcatggctcgtttggatctaaggggctccctgaaaattcttatcatttaagagtatttaataaagtttatgtataaaactacttggagaacctcttagctaatttgcaagacgaatctgtcagggttacgggttagatataccctttgcccttcgatatacgttacatatcgatatggcatacccacgcgcatgcggatatttcctgtatattctaaggaaacctttcacggaatctatagatgaaaagaatcctactcggacagaactgggtcgttgacgtatcgtatagggtctgatacctccgagttctatgaggagacctccacatctgctatataaaagaggcccccgggggggtttagacatcgaatctcagagccaacacaacctccacagcctacgaagccggagcttacgaggagccaagtcatcgagagctagtcgaatcaactcgactacaatctcgccggatccgacaagttcccttgttctctttgtaacctttgttttctaccatataatcccatatcaactggattagggctattacctatcaaggggcctgaaccagtataattcttgtcttttgtttgcttgatgtcgtactacgtagatccttgtaccaacgtactccaataccctctatatccggtctacgggtatcacccgtcaacagtggcgcgccaggtaggggtccttggtactcaaggttctactactatgtcatccaacttcgtcgacaacaacgtcagcaccagcctcagccaagtactccctgcttcaacaatgctggtatggactcaagtcggcgaaatcgtcttcccggtttacaccacgacgccgatctcaaccagtcctccaatgaccgtagacgagaacgcagtggctacgaaccaaggcgattccatgtcgaaaaatcctcccgtcgagacggagaacagaatatcgacgacatccaagctcaagaaggattctgatacggccaaaccttgtccttccgacatgaaccacgagccgacaaagatgacttccgaagccacaaggtcttggtgtcctatccacaaaaccaagaaacacaccctgcaagattgctgggttttccttaacgtccgtgctgaaattcgcgcctgcaaagaacgtggaattcagcgtacttctccaactcgggatgtctattgtcctattcacaagacaaagaatcacgacctctcgagctgcaaagtctttctcggcgccatgaaagctcagtctcctaagtcatatatccccatcagggataacggcaaggaacaaggagcgactccaacttcagatcgattcgttggggtaatcgatatcgatcctcacgaaccatcggtcttacatctcctcgaggactatgggtcatcgacaacgagcgcgccgcgggaggtattggctatcgatgacgttggcacgtcagcgcacgccaacacagtagcggggaatcaatcgactactccagcccagcacatcagggccgttcaagcgatactgagggaaactccctacgatcccgttctgaacgttgacctcgagcgttggacagaacgactacgggaatcggtgactaacctcagcaacgcgtttgaagaagccgctaccgcagcacaccaggagcagccaccaactagcgaggccaatggtgaagatccggaatggagggaatcacctcaacaagctacccctccacctcgcggcactggcgatcttcgagatcaaatcaacggccgctgggaagcacgacgcacacgagacaacgtgaatcgctctcggcgtcatgtctcttcacggcgccatgataacagaaatcgaggaaatcgctcaaacgaggaccgggaccacggcaatcaccacgatcacaacgatcgagaacgacgggggccagataatactggtcatggccgccgccgtatcgacgacgacgatggagatcggcaccgagacaacagtgcaagacgacgacaggattcccgagatccaggccgtcatcctcgtaatcgtacgccggaaccaagtgtaggatcaaggaggccgactagagggggggtgaataggcggttttaaaacttaatggcacttaaacaaaactaatctaagttgctaggcaaggtgaggtgcaaggttaactaagcaactaagttaagttttgcaaacctaggtgatatgggctcaaatatgtctctatgaatgtaaattgcacaaatgtaaatgcaacaaataaatgagacaagagacaaggaatttttcaccgaggttcggaaactcgccggtttcctaatcctcgttgaggcgagcccaactccactgctcaaccacgaagccaccgcacgcccccttcatcaaggggtgggcaaggtgggagccggcccacggagaggactacccaagcctcgatcactagggtagttcttccttcactccgaaggtggtgaactctaaaccactcacaaacagcgccgggcctcctccacaatctcctcggagaggtcaccgggcaacacctccacaagccgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttactactggggagtgggtatatatacccccaaccaccaaaactagccgttggagtcgaaatactcaactctgtgctccgccggtcagaccgccatagagtggccggtcagaccggactactatgtaacggctagttacagggcaatcattgagcccactcaacctggccggtctgaccgcagtgtagcggccggtcagaccgtccacggctcggtcagaccgtcatcggctcggtctgaccggttgcagctctggcggctctgtatcgccaccaaaaaacagaccagtgcaacagaccagtggggccggtcagaccggccttaccaggtcggtcagaccggctaacagctccggtcagaccgacctaaggcccacggtcagaccgcaggtcacttttcagcacaaccaaccgttagtaaaacgacgatatctcttgactcgagtctcggaatttgacgttcttggactctatggaaagcttattcaaagggctatccaacccatgaaaaatccatccaagaaacataacttaagtcaaggataaagggctcacactccaaaggatatccaccggacatagccacaagatgtcactcactcctattggacatgcccacttctctcttggtttaggacttgagaaaactcatcacacttggttagacaagccccaaaaatgcacctacatgcatatgaactaatatggcacaagatcatccacaagctcgcttcatagactcctcttgatagtacggcgtctatctagcaaatccggtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatactttgtcaagactttattctcatcacaagcttgacttcattcttgccaacatgacgatgcatttggcttggcgaccactaacccatggtgtcattcattagcctcatcgtagtgggacctattccttttcacacctcaaaggagaacattagtctcaacaaatcagttgtcatccttcacttgatgaccaaccggttgcatatgaaagatatggatatgtttgttgagtattcgttaacatcacaagtgtcacatactcgtatgcaagctcaggtgtaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagaccaacataaaacatataccttcatgatctccatgttctcaatgtaaatgagactaaataagataagactcgagtaaacattagtctcacacttatatatcaataacatagaaatcatatatatgaacctatcaaaaagtaggagataagaagtagtacatatcgttttatcttcatgtatttcatccttgtcatgattaaggtccatcacaaaagaatgcatgtcttccacatctcattatcaggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagataaaaatcttataataaacaaaatatagaataagctccccctcaagatgtgcatacatatggatatgaaggaacgcatatgcacataatcaataaagatcaaataggaagctcacactatattttggatccacaagagagaccaagttagaatatgtgaagtttaatacatacctctcatcatttttactttcatatccaaatgagactagtcaaagaaaggctcataaaaacgttagtctcatataattaaatttgtcattaatcaccgaaaccaaattaaggcatttaaacatacaccaagcgacccatcgtcatcgtcatcatccgcatcctcctcatcgtcagacagacatccacgaaggacacacgaccgccggcaacccaccgcccccaacgctgggtgtagagctttcggtcgttccctacgtgatgtccgatggcctgagagattccgacccggagcaatagaaaagtatgatgggagcaccgacccaaaggagttccttcaagtctactccacagtactctatgctgccggagcagacgacaacgcgttagcgaactatttaccaactgcgttgaagggttctgcacgttcatggctgatgcatcttcctccctactcaatctcttcgtgggcagacctgcggcaacaattcatcgccaatttccaaggaacatacaagcgccacgcgatcgaagacgacctacacgcgttgacacagaactcgggtgaatcattgagggaatatgttcgacgtttaaacgagtgcagaaacacaattcctgaaatcaccgacgcttctgtaattcgcgccttcaaatccggtgtcagagatcgctacactacccaggagttggcgacaagacgcatcacaaccactcggagattattcgagattgttgagcaatgcgcctacgctgatgatgcgctaagacgcaagaacgataggccgaagaccgggggagagaagaaaccagccacggatacatctgagtcaagcaagaagaaaaatcgcaaaaatgggaaaaggaaagctcaagcggaagtcctcgcagcagaatacgcgaaccctcccaaacgtctagacccacaaagcagcgacacaaagaaatcatggtgcctcatacacaagacggatagacattctctggaagattgccttgttttcaaaaagtcgctcgagaagcacatggcatttgaaaaaggcaagcgagtacgcgttgtcgagatgaacgaagagacggctcctcacgaaccggactcagcgtatccagactccgacctccacgtctcacacatcttcggcggttccacaacgtactcctcaaagcgagaatataagaaagtggaacgtgaagtctgctcgacatggcaaggggctgcacccaagatgaagtggtctgagcagaagatagagttctcggaagaagaccaccccaagaccgccgttatcccaggacaatatccgatcgtggtcgaacctactattcggaacttcaaggtagcgcgagttctcattgacggtggtagctcaatcaatcttcttttcgccagcactttggacacgatgggaattccgcaaagcgagttgacaccaactgatcaacccttccatggaattactccccaatcatcgtccagacctttgggcaagattatgttgcccatgactttcggccaagccaacaacttccgaacagaacagatcacctttgatgttgctgaattcgatacagcttacaacgccatcatcgggagaactgcacttgcgaaattcatggccgcatctcactacgcatatcaagtgcttaagatgccgggaccgaagggaacaatcactattcaggggaacacaaagctggcggtgcaatgcgacaagcggagcctcgacatggtcgagcaaacgcccagcccacccgccacgaccgagccacccaagaaagtgaccaagacaaacaagacgccgaaaccagacggcgccatcaagattgttccactctccagtgccaaccccgacaagactgtcaagatcggagtgacactaaacgagaaataggaactcgcgctcatcaccttcctctgcgacaacgccgacgtgttcgcttggcagccgtccgacatgccgggggtccccagggaggtgattgagcacaaactcatggtgcgacccgatgccaagccagtaaagcaaagactgcggagatttgcaccagaccggaaacaagccaaacgagaagagctcgacaaacttctcaaagctggcttcatcagagaagtatttcatccagagtggctagccaatccagtcatggtgcggaagtccaacggaaaatggagaatgtgcgtcgacttcaccgacctcaacaaggcgtgccccaaggatcactttccacttcctcgaatagaccaactggtggattcaacagccggttgcgagttattgagcttcctcgacgcttactctggctaccaccaaatcagcatggcaaaagaggacaaagagaagacagcattcatcacgccgttcgaggtattttgctatgttaagatgccgttcggattgataacagctgggaatactttccagcgcacggtccagggcgcacttagcaaccagcttggcaataatgtcgaggcttacgtcgacgacatcgttgtcaaaaccaagacaggcgactcattgattgacgatctgcgggaaacgttcgacaacctccgacgatatcgcctcatgctcaatcttgagaagtgcacgttcactttctgagatgacgccacctgatggtccgcgagcggtccgatgatatcagtcaaaggaagggcctacgctcaatcaagtcataaagtgatttcgaaaggagaatgcgggatgttcatcgaatatacttatgttgatggcttcatcatgttccgctgcccccttttcacaaaggggcacagggatgtcactcgccgtggtcgggccattggtcatcacttggccgacgcggcgctccacggtttcgccgctcagacctgttaattaagaaccaacctttgataagtcaagaggaatgcgaacacaagtatgtcaagataaatgcgagaaagataccccgaggagaaacccgggtcacgtcctctggctcagaatagttataagctggatgggcccgagcctgaagcagatggatccgcctaccaacgaagtctgcaacgacttcatatcccgacaaaccccgtactcggagatcgtcgatgatgtcgataaacgactgaagagagggggtcaaggggggctttgcggtccaagacggaatcttgtccggttgatcttcgggaaccacgaagacagggttcgagtccttgatctcaagataaaaccacctattcctccacttgctgcgagaagaagggcactggaagggaatgtaatgcgacttcaggccatcccgaagtcggaacccgacgcaaccagataccctattggattccatccaacgcagttcgtagtaaaagcgaaaaagatcaaggaaatgctctaccccaatgtaggcctcacaaagatgcacaaagatgctaaggaaggcgatggaattggggttcaaatggagaagagagaggccatagaaattcaaaaccaggagaagaaattcggaaggtggagggagaaaaccgcagagaacataatcttcgatcgcaaccatgcgacccaagatgggctgaggattagtacctcctgcttccctctccatggttccacggccaggaagagcgccatcctcctggagtttcttcaacgttgcattggtggaagctgatttgccgaggtccattgctgatcgaaggtcgccgaaaagcgagcttaggttgatgaactagggtttcttgcggcggcagagaaggcaaagagtgcttggaggtggtgtgtgtttaacaggtttggcggacttcaagatggactcccaaaattcctttaaataggcgcactaccgacggtgcgaattccagggaacagagagagatacccgccggaaatttctggtcccgttacgcgtggcggttttttggacttcagtttaaaattcgctcacgaccattgagcttcgaatggcgtgctcgactacggtctatctccgcggttctcgcaccgggaatgacagcagtctcgacacccgaagtcgcaaatggttgcacgagttcattttaagcagaagtcgggggctactgtcagggttacgggttaggcataccctttgcccttcgatatacgttacatatcgatatggcatacccacgcgcatgcggatatttcctgtatattctaaggaaacctttcacggaatctatagatgggaagaatcctactcgggcagaactgggtcgttggcatatagtatagggtctgatacctccgagttctatgaggagacctccacatctgcgatataaaaggggccccccgggggggttagacatcgaatctcagagccaacacaacctccacagcctacgaagccggagcttacgaggagccaagtcatcgagagctagtcgaatcaactcgactgcaatctcgccggatccgacaagttcccttgttctctttgtaacctgtgttttctaccatataatcccatatcaactggattagggctattacctatcaaggggcctgaaccagtataattcttgtcttttgtttgcttgatgccgtactacgtagatccttgtaccaacgtaccccaataccctctaacaagatatattaatctatgattagcggatgattactatagcatcactacaacagatcatggattaattaggctcgttagattcgtctcgcaaattagccttggggttatgaaatgagttttgtcggtaataaaacctaataatgccacgaacttacttaaaatatgacacaaatttagcaataatatatatttcatagcattacaaatccactaaaagcaacatttgagttcaaaagtgcaacttaaatagtttcaaagttgctttagcaaaaaccattccatacgaattttaaaggaattggtagaaaataatcatttatttcaaagtaacctatataattatttttcataggataaaattctctagaatttctctgcctttttccattgtttcaaaagagagcctaattacatggttgctggtctccgtcgacgtccatttggcggccgtagagcaagttgggggcggtcgatcggtcggactgtccaggccgggggcggggtcttctctgccgcgatcgacgtacgacgtgacgtgtgcggttgcgcgcgcgtcgtcgtgcatgcatgatattatgatatggtgggtgacgcagctacggatcatgccgcgatgtgcttccgtgtccgccttggaaattattaactggccccttgttagttaaccggccgccttttggttttgaagcaattaaccgcaatcaacacgagcaaatgattttgggggggtgggggggggggggaaggtgaatcacatcggagctggattaattagcgtcagactctacacaggtgcatgcatattgggatgcagttacgagtacctaactcattattctgcaggtaagtttaccatgacaaaaaatcgaccgtggtaattgtcaggaaacttatatagatacacttcatcatgcgcttcaataattaatgagtttttagaagcggacggcatggagtacgtacgtgtgacgactaaacaatctttaattgtcgcaagccaacgactgatgttcgatcgatgaagatgccagctcgatgccgctcgccctatctgaacagagggaggaatggttcagccagcagaagccaactgtttacgtcacccatgatctgtatcctttttagctcgccatggacacgcgaaaaacaagcacataccaacaccaatacgtcgtcagacacttactacacgtcgtgcgagcatgcacacacgtacacatatccattcttacatacgtgatcaacgaagcaatcaattaatccagaaaacaaatgaaaacccagcggccgatcgactgaatggatcaaattaaccatttacagatcgattaagcctctatctagatcccactactaatttgtgagacgaatcttttaaacctaattgctccatgatttgataatttggtgctataaacatttgctagtaacggattaactagacttaataaattcgtctcatggtttactgacggattctataattatatttttgttagtgtccgaacacctcgtacgacattctatataataaccgatgttacatgtcaaaatttaaacacctctaatagatcgaattggatgagatagtactgtagctgcaagaggagatgtccaagtccaatcaaatcacgtcatcgtctcgaacgagcgcatcgatctgccgacgccgtattgcaatcgaaaccttgggcggatcgatcgacgtccgcatccgatcccatacctgctgctgcggcgaacacccggtgctgatgatgatgcagagctgatcaattgatgattggattctttccccaacttggccatggcaaccgatgaagtgacatggtacaatgggcctgtttggttttcagggacttatttctaattcttgtcatatcggatgtttggacactaatttggagtattaaacatatactaattacaaaactcattccataagcttggactaattcgcgagacgaatcttttgagtctaattacgccatgattttgacaatgtgatgctacagtaaacttttgataattatggattaattaggcttaaaaaaatcgtctcgcggattagctctcatttatgaaattaattttttttattagtctatgtttaatactctaaattagcgtccaaacatccgatgtgacataggctaaaaagttttagtcccatctaaacaccccctatactagttgcacttgcacggcttggaagttggaacaggagctgtttgaacgtgtgaggatgatcaacagttgataattaattagtgtcataatccaatgttgccgtgcttactacaccaaattgacactgttggtatactttagcagcagaagcagatcatatcttttttttttaagacttaagcagattacttacttctatatcattgtcaggtcggctcagtgctaccacgacgttcaaatcaaatctaccacgacgtcctcgtggcgattaatcccggccgtccatgtgggcaccagggccccacacgagaccccatccgcacgtcaccctccacgtcatggattcggcgggcgcgcgcgcgcgcgtcgggtgggccccgcagccccctcccccaaaccgcggctgacgccccgccacgtcacgcccgacccgccgcggttgggcgcgaaccgggtcgccgtcctctccagcctttgcgcgtgggacccaccgaaaccgaccggccggctggcgtcacgaccccccgccgtgacgtcaccggcctatatatatcgcggtggctctcggtgcgctctgcccagcacaatttgcatttcgcacgnnnnnnnnnnnnnnnnnnnnnnnnnnnnnnnnnnnnnnnnnnnnnnnnnnnnnnagcaaaggataacaaatggccgtg

SEQ ID NO: 102 - DNA, 2482 bp, Oryza sativa
  unsure (1)..(2482): unsure at all n locations
ngctttgaccatcgcctgaaggtaacccagtcttccaggccctggtgttttctgtcaacaataggcctaaggtgggccggtgtttagaagagaaatttttttatttaaaatatatctaaaggggtgtaattaatgggtccaccaaatccaataaaaaaatgttttgttttttagaattttgaagaatttgattaattaattaaagcataatatggcatnttagaagngtggtagggatgtgatatggtangttaggagnnttttggnnnggnnnnnngccgcccccgccgccgcgtggcgaggagnagaaggtcagtagggcggtgncggagtgcccggtggtggtggtgggtcggagcgggtgctgcctgagccacgtcgtgaagcggctgctgcaggggctcggggtcaacccggcggtgcacgaggtcgccggcgaggccgagctcgccggggtggtcgccggcggcggcggcgtcgcgctgccggcggtgttcgtcggcggaaggctcctcggcgggctcgaccggctcatggccgtgcacatctccggcgagctcgtgcccattctgaaggaggccggtgcactctggctctgaatcaacaacgcagtagcgatcaagctgttttccttttttttttctttttctctcctattaggttcaaatcatctgatgcttttagcttcttttttttttcatggcattaataatggtgttgtaattagataggacgaaaaacttgaattcttttaggattttaataaggatgattaggagaagtgtgtgtccgttaacgctactgtacttaattaccttgtaactagtacctatacctattttcgaccatgtaaatacgaatgggagaaatgaagagaaatatttgcggtatttacttgtcccaaattcccggtgtttttccggttgagaatctgatgctgcaaagaaaaaatattgctgcacatgcgcttgcaaacatccctttctcttcctgaatgcgttgtcgccgctaccgtgcatgaacggcagcgtattggatgcttgtaattcatggccggctgttggttgttgtgcacctgtgctaatatttttcttttcctagttttgatattctgatatcacaattatatatttagacttccctcaaaaatttatatatttagacactattgttctaaacatatggagtaagtactaaaccttaagtttgattaatatttgcacctctctatatctgtcactgacattttgcagccacctgcaggatttaattcaactaaatctgtagcaatttggaagtaattaagccggacgcaggcaagcctgatcatcagcaaagagaatcaagcttcacacgttggcatgtctgtccatgagcttcagatagcagcattattccacgtcaggaaagcagaaaaccttccaaaactaacgagacacaagccaacctgcagcgtactattgtagtacgtagttgtaccatgtaagaaaaaaatatacaatcctatggaattatagatgttcatattctctactccacctgatcatgcatgcacggctaggccggtgggaaaaatgacaagaggcgaggcacatgagttgtcataacgtcattaacaaaaaccacacgaaatgcatttatatataggtgtcctttttcttccttgctgtcaaatgcgtaccaaataaatcatgcaatagtttggataccctacatttgcactggctggaatggcactagccaactacctaggatcagtcagtcccaaaaatcattatctagaaaaagttagtcccaaaatgaaaaaaaaaatcttgatgctcactttgaatttttttcacacattatgtggaacagatatcaaactgcaacagagaatgtgaatatgcaaaaattatagtggtttgttcgatttgtaggattttcaaaacataaaaatagtatgagaatatatatgcaaatctaagaattgtaaaacataggaaatcctatgcaaatctaagaattgtaaagctcgagtggatttttttttttggtgtgtgtgtgtgttttacatcaagtgaagggataaaatttttctattgtcgattcctttgaaacaatggtagttttagtgcccatttcaaaggatggtataattctatacttttccttcacaattttctcttaaacgaatgagccgtagttctttcgccctgtgggaagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggattcatctacgcgc

SEQ ID NO: 103 - DNA, 722 bp, Oryza sativa
  unsure (1)..(722): unsure at all n locations
nnnnnnnnnnnnnnnnnnnnnnnnnnnnnnnnnnnnnnnnnnnnnnnnnnnnnnnnnnnnnnnnnnnnnnnttgcctagcatagatccttttgttccaagtacagtttctgggaagagaaagtccatgacaggaagttcttcccatcttggttcacgggcagttcgtgaataccaatttattcctgaacagtcaagtgatatatatgagaggacgacccagtcacgatactatgatgttttaactgaagcttcggattcaaggatgtcgacaggatcacgattcctccatggtgttgaaaaggcacctggctatacattccatggacaaatttctggttctagccatttatctctacatggcaggccaccagttttttcatcgggatcaacagattatgagatggatccatctaatatcaattctagttctgttccaaatgaaagccagtatggaattcctcaggttgctggatttgaaaactccgttgcaccctcagacagaatggtttatcatgatgacgatgcttttcgaatggaaagaaagcgcaaagtactgagagatcccctcataatttccccaaaacgtaaccatgtgtgaataaattttgagctagtagggttgcagccacgagtgagtcttcccttgttattgggtaaccagaatgccgcaaaacttccatgcctaagcgaactgttgagagtacgtttcgatttctgactn

SEQ ID NO: 104 - DNA, 704 bp, Oryza sativa
  unsure (1)..(704): unsure at all n locations
gttttgnatttgaatgcgcatgagtannnnnnnnnnnnnnnnnnnnnnnnnnnnnnnnnntgaagttgggtacaattcatgcgtcagaactcattcgctctttactgaaaagctcgcgcccatcaagactggcacaggcaattatggaagtagggcgtgtaaacaaaacgctatatctcctcaattatattgatgatgaaaattatcgtcggcggatcctgacgcagcttaatcgaagagaaagccgccacgctgtggctcgtgcgatttgttacggacaacgcggagagatcagaaagcgttatcgtgaagggcaggaagatcaactgggggcgctgggcctggttactaatgcagtggttctgtggaacacgctctatatggaggaagcgttgagctggatgcgccgtaatggcgaagaaattatagatgaagatatcgctcggctatctcccctgatgcacgggcatatcaatatgttgggccattatacattcacgttgccagaggatattttaaaaggggaactgagagctctaaatttaaatataaacaacgaattatcttcttaacgtacgttttcgttccattggccctcaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 105 - DNA, 904 bp, Oryza sativa
  unsure (1)..(904): unsure at all n locations
aannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaaaaataatttacgcataaaacttgtacgaaatgatgatgctagtagttctaaactcaaatctcgccttcgccttgtcgtcggcagatcagatcaggcttccgggcggcgtcagctgctgcatgcctgacaactgccaccgtacctcaccgggatgtatagcccttggtgttcgtgagccacgttgtcccaacgcgctcgaccacgcacgcatggattcgtgtactgcacacacaaacacacgtacacgtcaagtctcttgcgtcaccggccgaaccgattggacaagaaagcttcttctctgctgaacacggccattccatgcctatcgatgcatcgctccgcgagagggcaagaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 106 - DNA, 679 bp, Oryza sativa
  unsure (1)..(679): unsure at all n locations
gcgtgtannnnntatagtatcctatgctnnnnnnnnnnnnnnnnnnnnnnnnnnnnnnnnnnnnnnnnnnnnnnnnnnnnnnatttagtcgataccggcagaaaccctaaaatgagaagcaaccgataaagctaaattgatatgttatcgcaaattagccttggggttatgaaatgagttttgtcggtaataaaacctaataatgccacgaacttacttaaaatatgacacaaatttagcaataatatatatttcatagcattacaaatccactaaaagcaacatttgagttcaaaagtgcaacttaaatagtttcaaagttgctttagcaaaaaccattccatacgaattttaaaggaattggtagaaaataatcatttatttcaaaggaacctatataattatttttcataagataaaattctctaaaatttctctggctttttccattgtttcaaaagagagcctaattacatggttgctggtctccgtcgacgttcatttggcggccgtagagcaagttgggggcggtcgatcggtcagactgtccaggccgggggcggggtcttctctgccgcgatcgacgtacgacgtgacgtgtgcggttgcgcgcgcgtcgtcgtgcatgcatgatattatgatatggtgggtgacgcagctacggatcatgccgggatgt

SEQ ID NO: 107 - DNA, 821 bp, Oryza sativa
  unsure (1)..(821): unsure at all n locations
ntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttctcgacagttcaaacttcactgagaaatgttaattgatcacactaatttctttttcttttctcttatcagttacactgtaaactaataaattatgtatactgaactaagtatgagcatcttgtatgacctgaagtcaatatccgtgggtttatttttcgaatgcgtgaagcggcagcaattttcatcgcccccatggcttctgtctgttcttcaatgcttgccatgcaattggagtatactgattacatctacatcgacaagtggttcgtccacatgctggagggctctgaattcctagccatggacgcccgcttgctgcataggaaggttgggatccatatgcttgtccagcctgcaggcaagatgcagtcgcaggtggccacatgaatgacatgtcagttcagaacgttcagatccaaggctttaggtcaggcaggcagaactgctgaattttattatggcacatgatgaattgctgcgtattgccttgctaatgcctggttcaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 108 - DNA, 750 bp, Oryza sativa
  unsure (1)..(750): unsure at all n locations
aagccaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatagaaattcaaaaccaggagaagaaattcggaaggtggagggagaaaaccgcagagaacataatcttcgatcgcaaccatgcgacccaagatgggctgaggattagtacctcctgcttccctctccatggttccacggccaggaagagcgccatcctcctggagtttcttcaacgttgcattggtggaagctgatttgccgaggtccattgctgatcgaaggtcgccgaaaagcgagcttaggttgatgaactagggtttcttgcggcggcagagaaggcaaagagtgcttggaggtggtgtgtgtttaacaggtttggcggacttcaagatggactcccaaaattcctttaaataggcgcactaccgacggtgcgaattccagggaacagagagagatacccgccggaaatttctggtcccgttacgcgtggcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatngttatattcccccgggggtttttttttttacaaaa

SEQ ID NO: 109 - DNA, 843 bp, Oryza sativa
  unsure (1)..(843): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcattgcgctgccccagccgtcgtgccacgtcggttgatcggaccacaccagtttgatctggccaaaacggcaaaacggtggtcaatgataagagcaggtacaatagcgggttataagctagctgcaaatatattttaaaaagataaatgaggagagagaagagtagtgggctacagatttgtagccagctatagcacggactttaagacgcgatgtgtgtatgacaggtggaaccaggtaataataatgtagtatgtaactattgtatgaataagctattaaattggttataaatgaattgaagcaaatagttggctatattattaaacttgctctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgnnggncctttttttaaaaaaccctttttt

SEQ ID NO: 110 - DNA, 760 bp, Oryza sativa
  unsure (1)..(760): unsure at all n locations
tcaaggcacctagctatacaataagcatgccctgggattggcttactcactctctaacactcatagataacctaagtgccaagggtgtagagctcttgcagggttcaagataatgcaatggagtgccaaaaccttacccttactactggggagtgggtatatatacccccaaccaccaaaactagccgttggagtcgaaatactcaactctgtgctccgccggtcagaccgccatagagtggccggtcagaccggactactatgtaacggctagttacagggcaatcattgagcccactcaacctggccggtctgaccgcagtgtagcggccggtcagaccgtccacggctcggtcagaccgtcatcggctcggtctgaccggttgcagctctggcggctctgtatcgccaccaaaaaacagaccagtgcaacagaccagtggggccggtcagaccggccttaccaggtcggtcagaccggctaacagctccggtcagaccgacctaaggcccacggtcagaccgcaggtcactttcaagcacaaccaaccgttagtaaacggacgatatctcttgactcgagtctcggaatttgacgttcttggactctatggaaagcttattcaaagggctatccaacccatgaaaaagcaccctgacaggccctgtcctttctggnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 111 - DNA, 817 bp, Oryza sativa
  unsure (1)..(817): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctgtccccctcttcccggagaggaactggcagaccatcgggtgttccgaggatttctgcatcagaggttgcgcggagatattattagccaccacaagttatgctacctccgttggcaccaatgcagctcacacgagctgagcaccgggtgattgattctgtggaacgactgataggggagccgctccgggaggatgggccagtgcttggtgtcgagtttgatcctctccctcctggcgcatttggggcgcctattggtatgtttttcatgcccatgatgcttccatcctgcattttataggtgctgcaatatgaatgtttcacttatttagaaagaatcctttgcactgttctaatacatatacatgattctaaaaaccaacatgttggatcgatctttatagttcattttctgtcatcacccactgttcgacaggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 112 - DNA, 26760 bp, Oryza sativa
  unsure (1)..(26760): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctacccttactttttattgtgttttcttaacaggaagaggagatcgcaagattaaacacaaaaattaaccaaaccgaaattcatgccacaaatttgatctcaaggcttgaggtatagtagctttctcactttcatcatctcccctttgcgatatttatgtctctcattcctggaatgaccaaacacaggctactgaagcaaagttgaagaaccatgagtcagattcgctggctttgaaagaagagatcagatcactgactgttagcttggagtcttttagaactgaagctcagtcacgtgagaaggaagtgaagatcttggaacaagaaaaaaaccatcttcaggagaagtatctaacagagtgcaagaggtttgatgaggcagacagccggtgcaaggaagctgaaagggaggctaaacgagcaacggaattggctgacgtagctcgtgcagaagctgttgcttcccagaaggataagggtgaagcgcagaggctagcaatggagagacttgcgttaatagaaagaatggagagacaggttgaaggtctggagagagagaagaataagatgctggaagaaattgagcgagttggtcagtctgagaaggatgctgtatgtaaggtttcatcgcttgaacaaagggttgacgagcgggaaaaggaaattgatgagatgatgcaacggagcaaccagcaaaggtccagtacagttcaagttcttgagagtctactggagacagaacgagaagcctgcgctgaggccaataggagagctgaggctctgtcactgcagttgcaggcaactcaaagcaagttagatatgctccaacaagagctgacatctgttcggttcaatgaaaccgcactggacagcaagcttaaggcctcacatgcaaggcgcctgaggggtgaagctactgagtctgtccatgatatggatatcgacgatgacaacactggcaggcgaaggaaacgatcaaaaagcacgacgagcccgtttaagagcaatcacaccgaggacggtggctctgtatttgtaggagaagacactaacaacgggagccagcaagcgcaggagacggagactgaagactacaccaagttcactgtgctgaagctgaagcaggagctcactaagcatgggtttggtgctcaactcctgcaactgaagaatcccaacaagaaggacatcgtcgccttatatgagaagcacgtagttggcaagtagcggttttctatttatgcgtgctagattttccctgttgcgatgaacgttgttgtcacggttgaggtgagagcgcgaaataactaatgtaacttagcctgaaactccagtttgtgttattgttaacttggtgcagtttattttgcatgcatcattggcaagtgtttgtagtacctgtgtggctgtgtttagttattactcactctgtctcaaaataaactcagcgtgtagttcaacttattttgggtcggagggcgtagaaatttggtttgcaaacccttcattatatctggcttccgtgtttgtactaacgaaataatcctatatgttggggactacgaaacagagatcaaggttaatttctctagctataatgttagaaccatccatccgagacatctaaagatatatatgaagtgatgcatcatcaggacctcttccgtgtgcatgtatacatgtacaaactgatacattaattgacattttcgagttagaacggcgtgtagtaataatctttgcacagtatagcatcggaaacgatataacaactttgaacaaaactgcaaataactgatggatgaatgtaaggttaagaatgtaatataatggcacctatgtgaatcatatcggtataaacggtaatgtttagattttgtgtaattttggtttttccttcaagggccaccaaagctgttccttgccgcgtgcaccgcgaagtttggcgcgaagtgcgcagcaggagcaggtggccggtaacccatcgttgctgccgggtcgtagaactcgtgcacaacgtttgcctccttgagaaagctaccaccaccaccaccttgatggccatggacgatggagtagttgctgttcaccacggcggcggcgacggcggcggaggcctccttggcggcggcggcggcggcggtggagccgcactgcctgggctgcgtctggaagaagaccttggagacgacgagctcgccgtcccgctcctcctcgtcggagccgaggtggtactggtgcatcacccagttggtcttctccggcttgcgctgcttgccgtagttggtgtagaggacgaggatcttcttgtagcccctgggccggccgttggccatcaccggtctcgtcttgccggtcttgtgccaccgcgtctcgccgccgtcgacctcgtcgctgtgcaccttccgccgcttcctcgtccccgtcgtgtacgccttcgacggccggtggaagaagtgcctcaccagcccgtccttgctcacacctgaattaatttttcaaatttatttacacccacaaatgcacgcaacgatcaactcatttatcaagaattttaagctaccgattctgattccactgtaagaaaaaagaatttacacccaccgggaagcctctcgggatgggtgtagcagatgccattctcgccctcgatggtggggatgaactcgtcgacgagagggtggagcttcctcgagtccggcctcgccttcccttccaaatgctcaagaagctcctggtccgtcggatcgaacttcactccggccggcagccccggcaggtcctggatcgtcgtcgtctcctgcaataattcatcttaattaatttgttgatttgcatctcaaccaaaagaagaattaatgtagtactacgcagtatatatgatcagttatcacttgctgaatttatagctgttggctgttgcattcagaaaaaaagaagaagaagaaggcatgatcttgatcacgcagtatatatacctgttcataccgcgcgcggtggccgcaggaggggcacatcttgacgaggacggcgagcgacgccgccgccttcttccccgcggcggcggccacggcggcggccggcgacaagctgctgtccacggcggtgcggacgtcgctgaagctgttgcaccacgtcatcgatctctccggccaaccccctttctcctcctcctccacaccaatatatacacacgccttatattattaattaacctagtattttaccactaactccatacatgacagccaaaaactaagaccagcagccaagaacaatgccggattaaaagaagaagcctactagctagttagcttagctagagacacatctctagctgctaattaagctatctatctagctaggagagatcgagagagacctgagctgatagggaagaaacaacttaaggccggggtcctgatgagagagagatcgtcgagagggggaaaaaagaagaaggaaagcttgcaggcaacagctagcttgtccctgttaaaagctacttgtaatcacacacacccgtactatccctctctctgatttctctatcctcatctggtaccaatgagcaggaggaatgcaatactgtgcacaattcaaccttttccccgtgtggttcattccccaataagagatccattacatatacacctttttctccttttcttttctttaattatgtccaagtgtgtgtgtgcgcatatgtatatatacaaacatgtacgcaatattcctagcaagtagtagtaggcggctaactaatacgtagttgagatggcaatggcatgtagtacgttgcttcgctctcacgtataggcatgcaaaaaccgatctgtgcccaatacgttcaaggtttgttaaaatcttgatcgtgaatcaaaatcgaaagttctaagggtatgtttggtagagtttcaacttctaaatttaacttcaggagttgagtctggagtagagttgtagagctgcctaaactcaattccacttctctagttcattttgtgaaaacgctacacccagccccgcttccattttaagtagagctgaaattgtttagctgagcttcaacttcaggagaggtgaagctagagctaaaattgtgccaagcatgcttaggattgttgtgatcgtagaatcgtacatataaaaattgttaaattgtagattttactcatatgtagtcgtagaatctttactcataaaattgtacgagagaactaattgagattttaaccttagaatacgtgagaaaggaaacgccggagattgatcgatcgaacagctaggtgcatgcatagtgcgacatggtaactgtccacgatccgatcgaccaacaacgcccggcatatcctgttccatttttcaacagaagttagcaaggagctagcagtacaccctgcagctaagctagctgaaattaaagcataatattgccaaggagagaagcatatgcaggtgctctgtgtggatgcatgagatcgatatcgatctaagttgcatgctgcatatatgcacgaccaacattattctctctcgatctgtacgttgttggagaggccgtacgtgcaggtgcacaatgttgattgaaatatcttatactagggcctggttggttgctttggccaggagatatattcccttccattaatgaaaccacgtttcagatatacgcacgcatgcaccagctgcagtagctgggccaccgatcgatctatccatcagataactaattaactaacgcatttgtgtgcagttatgtaatgagcaagtacaatcaggcgaatgaattcaaatactcgcaccaaaaactcttgttccgatctggggcaatgatacataccaaaactttcttattggcatttcctaaaatacttttaaatagggactgtctactcgtcatttgacagaaaacccctcctaatatcttgtaaatttgtgaccattggattgatttgagattcgtgcaaaccccaccaaaccctaaccacttttcctttttccttcctgccgccgcacaacgctcgagcgctcctctcagcaccgcgcgcctcctgcatcgccaccgtcgccgctgccgccccaccgtgccgccacccggcctcgccagctggccgaaaagtgtcaacggcgtcggcgaggccccgccgactggccccctccccctctccttctttgcctcaagccggcggcggcgtgctgtccgtcatcttccccatcgccagcggcggggcgccaccaccggccgcctacaccgggccaccggccgctcccaaccccgcggcttcgacggagccgccgccgcctagccgcccgcccaatccgccgcccgccgccgggctactgcctcccatggccatccctttaaagccagcgaactccccctttttccccctccttccttccccccacccctaccccaccccaccccgggaccctaattcgtcggccctctgccagagtttgggttcgccggcgccggagaagaagaggtggttgccggagttggagaagaagagcacgaatcgtgaagcacatccagtgatccaaaatttgcaagatttgaggttgtgttttctgtcgatagaaatttcgcatttccgttttaaatattaggcttttcaaccttccaacatttagttcattttttttacctcgaaaaagtatcatgtaaactcagtttcatccattatgatatatgtatatttcactgttctgatagatatgagttgtgcgagaatttattactacgtaattcaaaacagtgccatgaatatatatactgaaactttgtgcagtacgtactgtctcagcttccactaaaaatccagctgcaacaatacgtatatcggtatatgtgtggtcatggagacggaaggagtcaataataactgaaggaaagcttagaaggtcaccaactcgccatggcatttttgtgcatgcgcgatagacgatggttggatggggatggatggagtaggtggagtggagatggggcaacccgattcgccgggggacgttccaacgaacaggcccagcagagaagctctttggaaagggtgcactgcatattgcgcatatgctattgctctctcgctagtcgctagctaggagatcgaccgagtccagttggctttagataccaggtcgccgtggagtgtcttgcaagacaaattaaacaccccacacatcacaaacacaaacacatacaaatgagcagggctgtccctagcaatttggggggccttatgccaaatttaaaatgaggctttgtgtttaaaaatactaattatatgatagattaaggctatatattttttacaatacgtcgggacgtgtctttattaagattgtctttttacttgatctgcatcacagccattggcccttcaaccacatcaggaaagttagatcaatttaatgctcgtttcttaagctatgtttcaagtgcggtcgctcacctcatacttgctcagggacgagcttgcaaaccagaagaaactaataaaaaagatgagctatgtttttcctctcgtacatgtacatattgccccttctttaatctctattccataaaattggcaccgtctatatttttttcttaaaaaaagtaataaactttttctttttgaagaaaaaaagagagcggattagctatttatttaagaactagtaaggtagcccgcgcattcgcgcggggatgtattgtacacagggttaaacttttcggtttagccaatttgatcgggcatcaccgaaataccaaaatttccgaaatttcagtctgaaatttccaaaattttaaacaaaatttagttaaatttaaacaaatattaccaaaattcatgaaaaaataaaaaaatgaaaaattcggccgaaataatatcgtatctgaggggttagaaatgatcgaaatttccaaccttgatttgtatattgcgtttgaaatttatcgttttacttgtcttttcccgtatagtcacaatagatattaaaaatacaaacactacaatctaataatgttattttgaattattctaatgttataataggggagtagttttttaaagcattcctcagagttaggttcattttacttttatccatatagatataatttaattatttcgaagtcatatatggtgataaaatctatatcattatccttatataattttataattgtttgaatggcatacaaaaaacagaaaatatagccccaaagtgacatatttcttctcaaagtcgatattatggtagatatgtgtctttaaatgtaaaataatctaaagacgtaagttcatcaaatgttagtagagtgagttagatgttatagttgcttattttgttgcataagttttgctttctaactacatattttgtaaacattactcatagtatattcattttacttttatgattgtagacctaatttaattattataaagttatgcatgatgataaaatctatattattatcattattttatatgtttttaattgcttgaatggcacgcaaaaatcagaaatataaaccaaaatgacatttttttcaaagctaaattacagtgaaatatggtcctcaactgtaaatttagttataaataatctaaagatttacgcagatcaagaattagttgtatgatttagaagcttaattgtttaacacaaaattattacttatctaactaataaggcatgaaaataggagaagtaataggtgaaaaagtggagaaatgaattgaaggaagaggaggcgtacatacgtatgttcggttttgtaaaaaaaagtaacttatacatataggtgttaacaaccaaatttggtaacatcggcatttgggaaagaagattagatcgaagcaaagtcggaggcggagatcgagttcgaaaacagaacaggaatcggctgaagtccagatcggctgagtctgagttgggctaggtaagctgatgtacccgatcccgacaatacaacttgatgtgtgatgtcgggttagattgaggtgctttaagatgattgccgcacatggatagagtcctgagggggcaattatatctattgattaggatgttttatgtaatttccttagagatatgtttgggcaaaagtctgccgtaaagacttatggtatcttagagtttgttagagatagtagtcgtgtccgttatggacatatcttgtaattctcgggtataaatagacctgagccctatgtaacttttaacacacacgttcaatacaatttcggcgcatcgccacccttttgctttagttttgtttcgacgagttcttgctttcgggttgagctgcatcggtttcgatcttcaacaagaggtaaaacttgttatgtcggctcgcattcttgagattagtgcttccatcttcatgatactctaatcttgtttatgtaattcgtcgagttatcatgtatcttatataatctctggcaatatcaccatctaacatacaatcggctaacatctattgaggaagacagccgattaggttagattctgacgttgactcagattatataagatatctaccattctatgaaactttcagcggcttgattgtctagatttggttcttcttttcatacttaatactgcatcagttgagtttgatctattaagtcgtgcttagaataccaatctctagcctgcctcctggttgccgaatagagtagtatcggagtatcagccgatcttacctgatttaactatatttgctttatatgcttcattgatatgttaaatctgtcctttatgtcaagatatcgttgtatttaagtatattaggcttttgtttgttatattatacctgttttaatatcctgacataaagtagtatcggagtattagccgatacatgctaggtctatctgatcggctatgctataaacatatatagtcctgttattaacatatatttcgatctaagtgatttatactatctcggcatggtgaccgatctatcccaatcacttgatttaagtatatatcgatataagaactatatgttggaaatatctacagctgatcgaatagatttatttctttattgtttatttacaactgccgatcgattcatatatgacatcggctcagagataaatgatatgtcatcggcacctagccgatcggctatcatttatagatttaaccgcggtttctttgcttctatttcttgttgattacatgatcaaatcaactggcatgctagtacacccgaaggcgagctttggacatgcactggagttaagcagatctcccaggcctcgtgttttctgtcaacaataggcttaggtgggcccgggtttaggagagaaatttttttattgaaaattaatctaagggttgtaaataatgggtccaccaaattcaataaaaatatgttttgttattttagaattttaagaatttcactaatttattaaagcatcatatggcaacttagaagcgttggtaggatgtcatatggtaaattaggagcatttttgggaagtttaatggacttttagatatctaatctaatgttctaaaacaccaataaggtccaccaatttaaatgaaaatcgaccgtgatatttatgtaaatttatagagtaatatgttttatctttacataatagaaaatcctattttaaatatcatcaattttttccaatagtactaagggcacgcgcaatgtttatttcacaagtgagcaataacgtgggcccattgattaggtagtagtagttgttactaagctccacaatgtatataagcctatgaaggataaaataaggtgggtccatgcacaaaaggtacatctgttagcttgtgacggactacaattcattttttatttgcttgttgccggtagaaacgctatgaccaggtaacaactaataccagctttcacagtgtatataaccaggttagaaggaggaattcaatgcctattacctgcttttgtcccacattgtggatgctctaagtacatatgtttttttttgtttattgattttatgataattctgtgcgtagttttttttttcttctgacgagaacagtaggtacgtaagctttattggtttcttcagttatacttacgtaggtttttcctgtatacataaatacgtaacagagtaagggaattagattgttaaaaataaattacatataatctaatagcctaaaatatcgggtccactgacagtggcggatctaggatttagaatataggtagtccgacctaattttttcctaaacatactaaatctaacgatggtaatatataccatgcaagtatagataatagaatagaccaaaagtgtatcatgctatattaataaagcatcttaaaacatataaaattagtaattacctaaatttttgaagaaaattaccatactaatttttcttcttatcgggtctacgccttctaatggccatgaaagtggtcgttatatcttcttccttcacttttaagaaaacatcccgcttaatgaatgtgactatacaatcatccaaaagctcatcacctatcttttttctcaaccatcattagtaaatgcatcaattctactataatttaatatcacaatgcacaggagtaaagagttcaaaatttcaaaactgaaaattgaaaaaaagtaaaaaaaatagaaaacctatttttttttttggcttggtgcaggactgcatcactgcgggcgggcgttggcggcacacgctgcaggtctgcagcagtgcgctagtgcggcactgcggctgcagctgcggcggcagccggccaaggtgtcgacgcgcgcgcgtggcccggtggcgctcgctctcacgatctgatcagatcgctgatcgcgtcggcgtcgcgactcgcgagggcgaggaggagagatacagagagtcctgtgacggcgcgacgcttcggtttcttaattccgatcgattagatacaccatacacgcgcgtgtagggtggggcctgtggtaatctaatggtttaaaatattaggtacaccaatttaagtgaaaatcgacggttagatttgatagagctacgtggcagcctaagaacgtttgtaggagtcccacgtggcagcttgagtgcgtttgtaggaagtttaatggacttttagtatataatagatagatagataatagatagatgatgttgagatctaatccatccgtcctaaaaaaaagacaaaccctggtttccgtgcccatctattaaccgtccgtcttatttaaaaaaaatatgaaaaaaataaaaagacaagtcacacataaaatattaatcatgttttatcatctaacatcaatgaaaatacgaattataaaaaaatttcatataagacggacaattaaaattggacacggaaactcagggtttgccttttttttgagacggagggagtaacatcatagcaccagaggacttgacgatgatacccctactgtctgacaccctagatgagttgtagggccaacgtggcaagagattagtaccaaaatatctgacactaaactcccaacctcaacgtcaatggacctagcgctgtggtaggggacttatcaatgaagcagtggcgcctagctcagtgacgccaccgcagtctcgacttccaatggcgttggactctcatgctggtaccggttcctttctcttccatgccactgctgtctacgatgagctccatcaactccagtgccgccacgggctcgccaagcttcggagcttctaatcaagtcctataccttagcactaggcccattggcgcttaggttgagaggttagcatccacatgctgagaaagtattttctacacctaggtgctatggcacttaggtatatgcatgcaatttaaacaattatataaaaagtttatataatttaataagataggccatgataattaagacactatacaaaaatgcaagtctaaattcgatcgatatatgaagaaacaaaaataacaaattttatctgcgttgtatgagtactattcaatgtctgattttattatttttgtttctctaattgtagattaaatttagtcctgtatgtttgtgtatagacttatatcatcacaatcgattttactaatttttttataactatttaagtcgtatgcaaatgataggtgccgtcacacctaggtgtataaaatccttgtcctccacatgctgctatgtcgtgcctccaactagtctacggttggggtttcaatgcccaatcatatttcatgttaaaatgatattggacctctgcattattagatttggtgttaagatcacggtttattttagaaatatgttttttgcacagcacattcttaaaacaagtttttcaaaaaaaaaactaaattgtcaattgatccggcttgaagcttaagttaaaccaacagttatgtgttccagttttggtcacatagccgatagccttttcgagcttaggtgtgcatcatgtcagaaaaggattaatcatgcaagagagcttatagaagtttggtaggtggtggtgttggcgcgcgtgtgtgtggcaggaagtggattgcaccaactcgatcaatctgttgcattcttcagtttgcagccacagacagagctgcccatactgtagcttttaggtgaggtgaactgctactacactacgagtctactactgctacagatggtcttgatcagtagggcttattaagatcctctaatcgtggcgatttctgaaaccaacgatcagaatacatgattaagagagtggtcaattaatttgcagaggcaataaaaacatctagcttgttaattaggatcaatcgggagaaagctagcacgcctctatcagaaaatgatttggtaccccaattgtatggcagcgtcgaaggagccaaaaaatcaatatatattatttctaatttctttgctactatgtactccctccgtcccactttaaatacagttgtgtgtttccgtgttcaacatttgatcgcccatcttattggatatttttttatgattattatttttgttgttattagacggtaaaatatgaacaatactttatacgcgacttatttttaaaaaatattataaaatttttaaataaaatgaacgtgcaaatgttgaacacgaaaccctcaactgctttaaaatgggaaggaggagggagtactagtgtgctataagctctctcggtgaatgatgacatgtctaaatcagcagaagttttttttttatataagaaaaatcaacttttctctgcgtactagatggacctacaaagtactacaaattaattaagatatcgcactaggtcatatctggagtactatacgttgccgttgagatgtagcatttgacgcagatgtatgtaaaactttgcattagattgctgatagtacaaagagaataatttcttgccaagtgtcgactgactgtctcatctacgtacaatacaggcttaattgcagtcgatcgttcaattcactcctactattttacttgatatggaagttcttctgtttattagcagttggtagactacctagctagctatatgttaattaagctgctaacaatggcgtttatacgagctaatctattactaatcgaggagtacaattgatctaaaccaactgtttaagtggcttctgggtgaagctcaagttttctccatagattggcgagtaagtacttttgattggaaattatattggcattgattggatgttttgtgcgttgatgttcatctgtcaacgcatgattgttcaacttttagtgagaagggtacttaacgtggatgaaatcgcactcgttcgcttcaattcttgcatatatggttcgtctacatgatgtcaaggctatgttataccacttcgtttcctaaaatgtgtaacgttgattagttcaatttcgagctaaccaacacaattaaaaagaaaaatagatggagtactaattaagatgaactagatgatagtacctcacgcgttgctgcggaggttttagaacaaatttgatagagcagttggatatgatcgactctcaaatttgcatgtacaattgttctattcaactccctaaatgcatgcatgaagcataaagaggcaaatactaaattgttttattcttttgtaccacggcaaaataaataccatcaagaaaaaaacactgggtaatggatatcgatatcgtttaatttcacaacatagaagtttgttagctgtatcctatctagatgtaaatatcaaatcattaggtactcatatgccactacagagaagtacatatcaggaagaatgaacaggttctctttttccaattaatgtcttcatgtattagcttgttgtcgttcttgaagaacgaactaaaacaaataaaacaaaatctgcatcaaatgatatacatagagggatcacaatagttttccattgatatatcagacatcgattgtagatctaatggccgaattaatttaaggtgatgtggcacgttgtgaaaggagaaaattaaagtttgtggggataaattgtataagtatataggataagtacattgtatgatctgtgggtcataattaatttacacgtactgcttaggatactttgatgcagctgcatgaaggtagggcaatactaggctaaagcttacagacatccgaatcgagcatgttaatgattgatggccgaaaaaggataatcacatgattaaagccttgtgctgtcttatagctttgcaatgtttgttctccaagacctcaggtggagcatgcattctacactgttacaacatgcaatgtgtaggaatctgttttgccagaaagaaaggccatggagtactggcagaggttaaaggagcatgcatgtatttggaccactgcatcaggaggtttttgtcttggcacccaaaagcttattcttatcttgcccaagctatcctgttcatgttatgctacttttgattgcattgcgtctgtgtctctgtgatagctaggctggtatagctgcttcagaatgacggcgaacatatcagagcctgactcatgtaagtttgcattgggcatctgggcctttcttgtatcagcttgggattagattgggctacctgtaattttgcaggctactggacctgtccatctctatgggcttttttcataggctaaatccccagcctccaaccgaacatctctagcagccagcacaagcaacaggcagcctatcagcctatcagctcaagcaacggcaacacaacaattcgtgatcacttatcagccatcaccaaaaagaaaagaacacaaaagattttaaaaataccagcaagatatctacgatgatttcatgaatctcaacaaatgacagcacaatcttttcgaatatgcttatagaggtaaagcggtgtatttgtagaatgagtatgcacgtgttatgatcgcatacgtttatctttaaaaaaacacacacacaaaagcgagataccacacttgcccaataatgcttagtcgactacatgacacgtactttagccatctccacaaggcaaatccactaccggcccaagccacagtagaggtatcaccaacaaactcacctaatccgctccgtgccaaagctgcctttttagttttgatccatcaatccttgcaccaaaaacgctcacgaccaaaaaaaacgtagctggacgaaggccggcactgcaaatttgcaatgccattccgttactcaaccgtgtgcggcaaccccgaaagttaactcaacgccgaagcgccagaaaccacacctcgtctccaggctccagcgatcacttgcaagcaacaacggaaaaactgcccgatttgcttcgatttttggttgtttttccttgcaagccaagtgccaaccatccgcaaacgcgcaggccggcttcgctcgaccgccaccacgcctcgtgcgtgcatgcgtttgcacgctttaaatcctcatcaattcccttccgttttcgcagtagcaacattggcagagacgaggaagagaatgcgagcaagtgccagggcatcatcatcatcatcggcgtcaatggcggcggcggcgcagcgcgacgacgtggagtcacggcgtgatggtggtgagaatgagaagcggccgctgctggagaagcgatccgccggcgacggcggcggcggcagcggcggaaatggcatgagcccggtgcagagggcgatcagccagacgtaccagagcacggcgcacctggcgaagctgctgccgacgggcaccgtgctggcgttccagctgctgtcgccgatcgtcaccaaccaggggcactgcgacgtcgaggccaaccgcgccatggcgggcgcgctcatcgcgctctgcgcgctctcatgcttcgtcctcagcttcacggacagcttccgcgacgccgccacggccggcgccgtgcggtacgggttcgccacgccggcggggctctgggtcatcgacggcggcgcgccgctcgacccgcaggccgccgcggcgtaccggttgcggctactcgacctggtgcacgccgtcgtctccgtgatggtgttcgccgccgtcgcgctgttcgaccagaacgtggtgtcgtgcttctacccggtgccatccgagggcacgaggcaggtgctcacggcgctgccgatcgccatcggcgtcgtcgggagcatgctgttcgtgagcttcccgaccacacgccatggcatcgggttcccactctcgccgcgctaatatttagtagaattctgcctgcacgtacgcctatatgtgcatatcctcgtcttagttctttggaccattaattgcatgtaattaaattgtgacacgaacgaacacactgtaaagctgatcacggccccaatgggctcgcaaggagtcgatgcttacaagtttaacttaatctacgctttgtttgagtacggcatgacgatatgatgaacttgtgggtgcaaacgggcgggaaattagctagcattacctcgtactagaaatgcgtgcaagcttggatgatgacaaacttgtgaggaataccaagctcacaagtcacaggtcaaaccggggagtgacgcgatctccaactccaacccgtcgtcctctcgcgccggcaccgtgaaggcgtgaagcgagggcagcgggtgtgtggactgtggagtgggaagtgtgtggtgttttctcgtcgcgtcgcgctcgatcggaggctgtgcagcggggttgcacgccgtggacgatgatacttttggttgggcctattgatgatattgtcgagagaattggcccgtggagagcaggacggggttcggaccgcggttctcatggcccatatgcattatgatgacatcgtgtactatactactgctgttgactttgattgtgacttcttgtattgacttccaccgaggaaacatgtactatccccgtctcaatcagtccaccactactattttttcattggtaaataacaaggcacttatttcgtctacctccgttttttaacagatgacgccgttgactttttctcatctgtttgaccattcgtcttattcaaaaaatttatgcaaatgtataagatataaatcacacttaaagtactatgagtgataaaacaactcataacaaaataaattataattacgtaaattttttgaataagacgaatgatcaaacatgtgagaaaaagttaacggcgtcatatattaaaaaacggagggagtactggatttcatacacgcgtgggaaagaacggctctgatcagctgaacctaatccgatataccaaaacgacgaggggttttctgtaaaagttgaaaacgtggcatggcggcgaacccagcacgtttaagatatatagtataccggtttattctttaaaaatatttttagaggtagagtatacacttatacggatgtgcgtgtatccaacaatctgctttcgtagaaagagagttagagcaggtacaataagctgactgagcaggctccaaaaatatccagctcatcaaattcctacgtggaagagagaggagagaacaaagcgagcgactaatctatagctgggcgatagcacgggttcgcatgcgctttgtgggtcccacggcgagccatccgatcccgtgtgacatgcagcgctattccctccccctccgcagcccatcttgtttctctcctcacgggagtgtcgcagatcgatctttgccagccatcgcctcgcagttgtcttccgcgtcgattccccgcccaatcttcccggcgtgtcttcgccggccgccgcttgcgattatcttccacccggacgcctagcccaatctcgctcaaaagcctgaccaagaagggtctgttgatgtcgtcggcgcccgtggtggcggcgatgacaagggcgttcttcttggcgactcggccgctggcatcgacgaacgcagcgctcgcggcgcagcagatcgtgaacgtggcggcagcggcgggcgccgacgacaactgcgggctggcgctgctgctggccatcgcgtcaagaaggggcagatgcatctacgagcagaacaaacggatctcatcgttgatggagcagcgaatagctttctaatttgagttattgtcatctaatctcttcctaattcttttgttcttctcgtctatttgctgtctgtgacttgtattttccttttatgtatatagcactcctgagtattgcacaacaacgaccacagggattgagttcactttcgatcatgtatatcaatatatgcgtataaaataaatttttgatggatgagatgcagtcaacacaatagccactatgttgtacaaattagctttaacatcaactataaaatgacatggatacgagtggagccatcagctggctatactattgaccttgctcttaggggggtgtttagatccaggggtaaaattttgacgtttcacatcggattttatataggatgtcgcaaggggtgttcgggcactaataaaaaaactaattacagaatccatcagtaaaccatgagacgaatttattaagtctaattaatccatcattagtaaatatttaccgtggcaccacattgtcaaatcatggcgtaattaggctcaaaatatttatcttgcaaattaatcgcaatatgtgcaattagttattttttagcctatatttaatacttaatgcaggggttcaaacgttcgatgtgacggggtgtaaaagttttttttacgttggatctaaaatttttagtggtagtcttcaattcaaaacacgtccaatcacaagaacagtttaaccatcacatcgaaggtacagaacacaaacatcgacggatccaaactcatcaacctgaccccgaatcccactgccacacgggccccaaatcccacggcccacatccccccacccacaccacaggccgcggatacttcactggattcccaatccgacccaacccaactggcacgccaggcacaccaagtaccccaccaccaaccagggccccacactcccaaactcctcccacccgcacgccgccgttgccacagaagatccacgcccagttctacgccacctatgaacacgcgcgcacacacgccgcgcacatacatgatcaaatctcattcgctcgccaacgccgcaagatcgagcgaaccccagcgaatccgagcgcccacgcagccacatcccatcattattccgcacctttcctcgctttccttcgcacactcccggactcctctcctctcctctccccatcgcgaagagaaaaaaaaaggatagcaccaacaacaacaacaaacacagcggaaggaagcagaggcggcagaagagtcaggcaggcaggcaggagcagcgaataataaaggggggtttttattaggagagtagtagtagtaacaccacgatggaacgagcgatccaaatcctgaccagttcggatcgagcggtggaagaacaggtttggagtggcctcccgtgttgctcctcctcatcctcctcctcttttctttctattcctcttcttccccgcggtctctttcccctctcgcacgcaccctccttctcctcatcatcctgctcctcccctcgttttgttgttgttgttgctgctgctgctgcggatcgaggtcgtcgccggattcggttcgggtcgtcgttggcccgtgggctatatatcgaggggatttaggtttgctggattttggagtttgtgtgttgaatcgatcgtgttggcggcgggcggaatcggcgaatctagggtttgggattctcgatttgattgatcgggtggggggatggattcgtccggcgatggaggggacgagggagcgggagctgcgccggctggggtggaggaggagagccctgccccggcgtcggctccggctccggctccggcttccgcttccgctcccgttcccgccgccgttggtggtggagcaggcgcctctggatccagcgggaaggtgaagcgcgtgatgaagacgccctatcagttggaggttctcgagaggacatacacaggttcgtggatgatggcctatgggggactggggattctggaaatttttagggctatttcgtgtttgatttgtcgatttttcgatcgaaacagccctgtgatttctgtgcttacttggttttgtctgtgttgctgcagaggatccgtatccaaatgagacgatgagagcggagttgtctgtgaagttagggctgacggacaggcagctgcagatgtggttctgccaccggcggttgaaggaccgtaagccaccgccgaagcggcagcagctggaggaggaggttcctgtgccggttatggcgccgcctcctgttctgccaccaccactgccacacagcgagctaacaatgggtactggtgggatgtatggcgagccgttgctgtccccctcttcccggagaggaactggcagaccatcggctgttccgaggatttctgcatcagaggttgcgcggagatattatgagccaccacaagttatgctacctccgttggcaccaatgcagctcacacgagctgagcaccgggtgattgattctgtggaacgactgataggggagccgctccgggaggatgggccagtgcttggtgtcgagtttgatcctctccctcctggcgcatttggggcgcctattggtatgtttttcatgcccatgatgcttccatcctgcattttataggtgctgcaatatgaatgtttcacttatttagaaagaatcctttgcactgttctaatacatatacatgattctaaaaaccaacatgttggatcgatctttatagttcattttctgtcatcacccactgttcgacaggtaaactccgtggttacctacataactgagaattgtgacagatattagacttgcatttcatcttttatgtgtttaggaaagcgttagcaagtttaaatgatgattgcattgtttcagcgttgatactgataatatgttcatttcatacttccaatctgctgatttcaattgtgctgttattttgctatgtttggagcagttccagagcaacagagacagcctttccgatcttatgaggccaaaatgttttctgggcatgatacaaagcacattaaggtatgttacattagcacttagcttgctgcatgcatgcatgctgtcttttgatagttgacttccagtaaagggtctatttatcaatcctggttatcagccttcacaggttataataatgtaaatagtgtaaaaatattcatgttatactactgatgttggatgcatcataattctgcaatatctataagctaatgtggtccaaagagaattaataattaatacttataaaacaaaactttagactaccgatgttatattgtagttgtactagatatttacctaaacccatgaccattcacatccacttttaaatacttcaccgtccttatatttgattacgtctcctgttctgttcatcttcaagtttagctgcttttagtatagtcttttgtttctttacttatcaatgtattcaatctatgttttcccctttcaggcatctgcattcttgcctagcatagatccttttgttccaagtacagtttctgggaagagaaagtccatgacaggaagttcttcccatcttggttcacgggcagttcgtgaataccaatttattcctgaacagtcaagtgatatatatgagaggacgacccagtcacgatactatgatgttttaactgaagcttcggattcaaggatgtcgacaggatcacgattcctccatggtgttgaaaaggcacctggctatacattccatggacaaatttctggttctagccatttatctctacatggcaggccaccagttttttcatcgggatcaacagattatgagatggatccatctaatatcaattctagttctgttccaaatgaaagccagtatggaattcctcaggttgctggatttgaaaactccgttgcaccctcagacagaatggtttatcatgatgacgatgcttttcgaatggaaagaaagcgcaaagtatggtttttcactgactttatgtaaacttgctcattattccggatatgcactagttgctgatgtgtgatcattttcttaaaacagcatagcgaggaagtgaagattgcaaaggaagttgaggctcatgaaaaacgaatcagaaaggagctcgagaagcaagatatgttgaacagaaaggtattccttattcatgttacagaggatcatgcatttgttcttggtatgagatttatatccccctgtttgcagagagaagaacaagtgcggagggaaatggagagaaatgatcgtgaaagaaggaaagaagaggagaggttgttgcgtgaaaagcagaaggaagaagagagattccaaagggaacaaaggcgtgaacacaagcgaatggaaaaatatttgctgaagcagtccttaagagtgagttctctagttctaggacttttaatgtgacaagtatagagttcagattattgctactatgtagtttacaatcttttgtatgtgcaggctgaaaaaataagacaaaaggaggagcttcgtaaggagaaagaagccgcaaggcagaaggctgccaatgaaagggctacagcacgtagaattgcacgggagtatatggagctcatggaagatgagcgcctagaactaatggaactggtttcacgaagcaaagggttgccctctatgctatctcttgatagcgacacgttgcagcagcttgattcattcagaggtacgttcaacactcctagatctagtcttctagtcagtgtacgctgcagaatttatcagcttactttgttttcatttcagaaagaaactacatttgctgattgaataaagaacttttcttttctcaattgggtagatgcaattgttatggctttaaaggcacttcattttaaggatgaaaaatatagttatatgtttacaaaaataatagacctgatactcgaatttatgatagttcttttgttaggttcaccctttatctgatatggcagtgtgaaatctaatttcaccccttcgtagttttatatctttgtaaagagtagtgcttggtatttaagccgaaatcagtgtacctctctgtacgaaaaactgaaataccttgtaacgcacttccacattctcaaattcaggatgagaaaaaatagaataggttatgcaatcattatctacagcctacttgctgctaggtcatcaaaaatactttctttggtttggatcgaatagtcacactatgggttatcttggtgtgttatgacaattttgttcactcatgttacctagtattcagtgacaatttcttctaggtgacaattttaaaccaaaaggcatgacaccccagacccaacttttattaaaaagagccagcaaagttcttagcattttacagcgcgcatacaaaacacttcacctcacatgatcactacacaaacatctctggctgcataatataggggatctaaagttttgtctgcccttttacaggaatgctgagacaatttcctagtgaaattgtgagattgaaggtgccattttcaataaaaccatggacaagctctgaagataatattggaaaccttttgatggtactttcttgttatgaattttcttctattcaaagtgcattatatgctagaagcctatagagttgttgtaagttgtaaaaattgctgctgtttaatgatatccacaggtgtggaagttcttcattacctttgcggatgttcttgggattccgtcattcacgcttgatgagtttgtgcagtctcttcatgattatgtaagttaattgcccattccatcatgctaaaagtgaatcctggtatggtgcaaacacaaatgtgtgagttgatggcatggtgttgcttctctgttttatcctagtaatatgaataagaaccacaacatgacatggatgttttgacatttgtactgtacatgatattctgtgctctctgagtttgtatatccaactcatcgataccaaaatatgctaactggcatttgactcttggtacattattatagtacgagcatttaacttttggtacatgtatgattcattctcacatctaatattttttagctgcttgttctatgtgagtatgactattgatattcatgctataggattcaaggttgttgggagaattgcatgttgctctgctgaaatccataataaaagatattgaggatgttgcccggactccttcagttgcttcagggatgactgctaatcctggaggtggtcatccacaaattgttgaaggggtgtgtgtgcagatctttgctataacatagagcttctattcaaattgagtaaattctgtgctatttatattttctaaaacattcctgatctcttattgctaggcatacgattggggcttcaacatacttgcctggcagcgacacttgaatttgcttacatggcctgaaatattgcgccagtttggtttatctgctggtcttggaccacagttaaggaaaaggaatgctgaaaatgtcaataatcatgatgataatgaggtatttgtctgttgaaagtgtccaatgcatatgcatttaaattagtttattcctgatagctgcatcataatcatgtgcaatctgtgtagttctgttggaggcaataacttgcacgattgtagattgtattgttgtatcaatatctctggtattttggttcctgagcaattttcgattcagagaaaacgcctactgtttagtcttatagttggctccatagaatcctgaggtacaatggtatttatgcttttgatggaaaattcaaacatagaagctatcagtaccgcgatcctatgatcttgctaggctattttgatcttggtccttccaggattgtagttaggaattacaatataaaataacagcataatcctaaatatttggaatcatagttctcgaggcattggtaggatcatggtcctacgaacaagggattatcctatcttaaatactgaatgtggtccttgaatgaaagtataattggagaaacttttgtaatctgaagcaaaaaagcagattagccacttcacagttttattctctttatggcaagaaataaaattctctcaaccctaacagccctgaacaactcaaaatttgcaaacagggtcgtaatggtgaggatgttatttccatactgagaagtggctcagcagctgtaaatgctgctgctaaaatgaaagaaagaggctacggtaatcgccgcaggtctcgacaccgtctgacacctggaactgtaaagtttgctgcgttccatgtgttgtcacttgaagggagccaaggtctcacgatattggaagttgcagaaaaaatacaggtatgccgaccacatccaaaaaagttcaattgtaacctgttgctatcttattgattttgtttattgatctcttcagaaatctggactgagagaccttacaacaagcaagacacctgaggcatctatatctgctgcactgtcaagggattcaaagcttttcgaaaggactgcaccttcaacatactgtgttaaaactccatacagaaaagatcctgctgattcagaggctgtgttggcagcagcacgtgaaaaaataagggtgtttcagaacactatttctgagtgtgaagaagtggagaaggatgtggatgatgctgagagggatgaagattctgagtgtgatgatgctgacgatgatcctgatggtgatgaagtgaatattgaggaaaaagatgtcaagacttccctggttaaggcacaagatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngngttccatcgcatgtattatcatggcaca

SEQ ID NO: 113 - DNA, 730 bp, Oryza sativa
  unsure (1)..(730): unsure at all n locations
gcgtgattgagnacgcnnnnnnnnnnnnnnnnnnnnnnnnnnnnnnnnnnnnnnnnnnnnntctccgtcgcaaatgggcaatataataaaaatcacaagaattattcccgtagctggaacggttggctcaaacgaactcctgtctttctcttcagtgtccagctctccatgatgatgagcgagtacatatacatacagttgtatgctgttcctgaaaattacctgctcaatcaatcatggcgcatcatctcgtcgtcgtgctcgctgcgaagcgtacgaacggatgctgacaaggaccaaccattagagtgaccatccccgttttgtgtcggtagatgatgctagctgccgttggagctggaagtttgtctgaaatctagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntn

SEQ ID NO: 114 - DNA, 683 bp, Oryza sativa
  unsure (1)..(683): unsure at all n locations
cccgtgnaactgtagatcctctnnnnnnnnnnnnnnnnnnnnnnnnnnnnnnnnnnnnnnnnnnnnnnnnnnnnnnnnnntagcatttgacgcagatgtatgtaaaactttgcattagattgctgatagtacaaagagaataatttcttgccaagtgtcgactgactccaaagtgctggcgaaaagaagattgattgagctaccaccgtcaatgagaactcgcgctaccttgaagttccgaatagtaggttcgaccacgatcggatattgtcctgggataacggcggtcttggggtggtcttcttccgagaactctatcttctgctcagaccacttcatcttgggtgcagccccttgccatgtcgagcagacttcacgttccactttcttatattctcgctttgaggagtacgttgtggaaccgccgaagatgtgtgagacgtggaggtcggagtctggatacgctgagtccggttcgtgaggagccgtctcttcgttcatctcgacaacgcgtactcgcttgcctttttcaaatgccatgtgcttctcgagcgactttttgaaaacaaggcaatctttcagagaatgtctatccggcttgtgtatgaggcaccatgatttctttgtgtcgctgctttgggggtctagacgtttgggaaggttcgcgtattctgctgcgagga

SEQ ID NO: 115 - DNA, 686 bp, Oryza sativa
  unsure (1)..(686): unsure at all n locations
ccccgtggnttgtagatcctctgatatacactnnnnnnnnnnnnnnnnnnnnnnnnnnnnnnnnntgcaagcgtacccttaatgttctaacagtaccagcaccctctaatgcgcttgtcatagcttacagcttataaacacgtacttagatggttccagcggcgacaaatgccgctgacagttaaagttgcagaggcaacaaatgcagacgagcagctaggtactatgtcacatgataagtgctccaacgcctacatctaagataaaaatatcagaatcatcagtccctccatctccctgatactcggccaccatctggagatccacagcaaaatctggaacaacggcaaaacaatgatcataacatttctaggtaaaactgtcacaggtgaggattttatgcctttggagtatcactaacatgtggttggaagcaatcctagtgttacttcacctccagataattttgcaaatccagctcataaatcagatcatcatatccatatctttgtgctaaaaactctttgattcctttcgatctaaatttcacacacgaccagaacaaaaatttcactggatgattgcacaccagtttgcattcccctgcactacgagattttttttttttttttgcagtgtgtatgcatttggcggccgtgggaagtagtctcggcccgggaggcacc

SEQ ID NO: 116 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagcaactgtgagatttaaaaccaatccaccgagattcttaagagaaaggattaccttctcagacagttggctagcaagttctgcccttaaagcgtcttccctttcttgcactttcttattagtgcgttcttgtgctacagctgctctttgcagagctgtttttgcctcacttacagcaacttcatatttccgtttccactccgatgcctcttcttgagcagactcagcctgttctcgcacagcagataatctgccctcactgatatttaccctggattccagagaagcaatttgagactttaacttactttcatctgccttttgctgtaacagattgtggtcgtatttgttcttccaatcaacagattcccgttttgcattgtcaagagcagaagacaagctcacacatcgttcctccaacttgctactcttggtctgaagttcagcaatacgtccggagtaatcccttgaaattttctgtttatcattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 117 - DNA, 39027 bp, Oryza sativa
  unsure (1)..(39027): unsure at all n locations
tgattgctgtgggataatcggtattttccgccttttgaagttaagcctgaaaaccgcttagccggcaagccgaaacgatccaaaacgcatccaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaagaggttctaacaactgtagtttctcttataattaaaaactccccaaacaatcccgcatattatccatattttgagatattggagttacaaaatctagaaaataaattagaagccagattatggatttcttatagcatatccaaattctcagaagttagctaccaaccagctgtttcttactccatccgtcccattttaagtgcagctatggttttccgcgtctaactttgaccgtccgtcttatttgatttttttttgaaaaaatttaaaaacataagtcacgagtaaagtaatatccatgttttattatctcataacaacaaaaatactaattataaaaaaaatttaaaataagacggacgatcaaagttgggcatggaaacttatggttgcacttaaaatgggacggagggagtacaatattaagcttcctcaaactgggtttaagaaagagatattcttccattgttagagaggttacttccctaccatttgaaaggtaacgaatttaaatcatttgaactgattaaaacaaactattgataatataatgttaatacttttctggttcttgtgatgatgtataaaatgttatatatacatcgtagtattagacaggagctagatatatacccataactaaaaatattttactgtcttcgagaaaacatctgcatgtaccaaaattttgtaccgatatctcgagatacccaatatatgtaggtaccacgttttacattatcaaatccgatatatctcggtacaatttttaaggatggtaaaattacctcctaactatatctaagttgaactaatttggggctgcaacgatcaataagtatatacatatatattcttatagaattgatttcagacttgaattgagttaatgcctccgtaactccgtttgacatttcctttatatttttgtggcaattcgtgtgctcacgtgtagcatcaactgacctatatatatatcttaacagtttggctgaaaaatgtaacttgtaacaacttggtacgcaactggatcaataagtacatattttcataaactcgatttcaacgaccttggataattgatcaacttaatgtctcagcttaattagaattttgttcgtatttttatggtgatatatatatgcatgctcacgcgtagtatcaattgacctagatctgttgcagtacagtgtattgatcataattaacacatcagtactgcaacgcagcaatcgcaaatgcacgcactgtggcagaaagaaaattccaacttaattcataattgtccctgcacgagattgatcaacttctgaaacttaggattaattgcacgggctgttttaatcaagtcgattgatctctgggtgtcactggtttgtttctgagtcgattcgcatttgcacctaattattattatttcgatcgcgtcagcttcagcaagtttaatacatgtcctgagtgactcgatagcgttgctttcggggtcagcgtctagaataaattggccattaaactcggtttcgctgaactgaaacaagaagaagaagaagaagaagaagaagaagaagaagaagaagaagaagaagaagaagaagaagaagaaactgtagctagctcgatgtgtgagtagctctctctgctacgtacgcgtgtacaactacatatatatactgacatacacatcgtctgacggattcaattcgatcatcgatccatcgatttctcccccttaatgtcacgccgcagtttactcctcgatcgacagtgtgcggctttaaattttgtttgtgtgcatcgtatcgatccatatctcctacgatcttggacgacaaattcgtcccatctagtggcgaaggcaggaaatttcctgaggcaggacgccttcttcgtagcttaattatggattatgcattatcattagcaactaaccccttctagctatgaacctaaacacatgcatgtccagattctttatatctagagtttctttcttttgagacaaagtagtaattctaactccaactagcatttttctaaaaataaacacagtataatcacaaacattcacgtacacgtacgcacgcactcacatctaacaacatacacatgcatcctagtcctataaacatctccaagaaacttagccgcatatcttcatattggtaaagtcatctcgatatggatgattgggaatcggcatgttttatcccagaaaacctaaccagttaatctacgctcacttcgtaactgatataagcatcgcattagcatgtgaactcatcacaccctaatcttattctagctagtgaaagttaacaggggttttgactgtatgcgtatatataagcatgagtaataattgagcttaatttgagttttgggttcagttaattaatcaaggtaggcatgcaacctgacagtagtgatcataatctgcgacgaaattcccccacatgatgccaattactccaatcactaatctgccagtgtccggccggtgcatgcaacgggataacaatggcgctagcaatgttgcagcaaaaattagctgtacgcatgtgatggtgtgtgtggccgaatagttctagcgtacacatgtacactcttatattgtccaatatatatattctggtgccacacagaggagctaggcagctgtttccaatggaaaattaaatggaatatgacgacacaatcgatccatgcatgaatgccggacatttgagatgcatatatttctccatatatgggtcctgaatctgcaattaacaccactgcaggagttactcgatgcattgtaattgcatccagtactatactatactaactcaagttattatatatggcaggcaaagtcagcagcataaaatctagaggttgggttgccaatacttataccagctagtactagtcagtactcagtacatatactgctacactgcttcttacacatattttcctgcagtaacattgcaccatgggtatacatatcatctctcatcaataatgtatactccctatgttacctccgttccattttaagttcagttgtaatttctgtccaatgcttgaccattcgttatatttgaattttgttatgattagtgttttttttattaaatgataaaacatgaatattattttatgtgtgatttttttaatttttttattttttttaaataagatggacggttaaacatacacacagaaactgataactgcactcaaaataaaacagagggaatagatgtgatttgttctcactctcttgcagcctcgcagtgctgcaatttagtagtagtaccatgtcagatggctcttctactatccatatggcaaataataatttattgtgagcaacttaattaattatttatatatgatgatgatccatctctggatagtaggtagtactatgaccatgtttagatcccaactttttttcttcaaactttcaactttttcatcacatcaaatttttctacatacaaacttttaacttttttgtcacatcgtttcaatttcttcgaacttctaattttatcgtggaactaaacacaacctatatatagatacccttgatgcatgcatgggcataatttctccttagattattgaagaaaagatatgtaattaagctatagttagtacagcaactttgcatcgatgcttcagtgcaaaacacacatcatccatgcatcctgtgctctctcctccatatattgatctttagttctttacagctaagctagcaggagaggcaagcggcatatgcatgcagtgaagtacttgtatggatgatctctctatctagccagagcatactaataagtcatctcacatgtgcagtggtggaggtgtgcatttatgaatttgttttctcttttgctcagcattcaattcccacactctttgagtctgagttttctctgccactttgtttatcaccatgtctctggctccatcagcaccaccgtagctgtttagatcgaggggtgtaaagttttaacgtgttacattggatagtattatatagggtgttgtatagggtgttcgggcactaataaaaaaactaattacaaaattcgctagtaaaccgcgagacgaatttattaagccttattaatccgacattagcaaatgtttactgtagcaccacattatcaaatcatagagcaattaggcttaaaagatttgtctcgtaaattagtcgcaatctatgcaattagttatttttaaacctatatttaatactttatgcatgtgttcaaacgttagatgtgatggggtgtaaattttttgtgcgggaactaaacatggcccatgtctctctctagtctatatcttttctttgactgctatatatttcatactcctactcctactatactcagtaattaagagggtgtttggatccaggggtgcaaagttttggcgtgtcacatcagatattatatagggtgtcgcatggggtgtttgggcactaataaaaaataattacagaatccgtcagtaaaccgcgagacgaatttattaaacctaattaattcgtcattagcaaatgtttattgtagcaccgcattgtcaaatcatggagcaattaggtttaaaagattcgtctcacaaattagtcacaatctgtgtaattagttattttttaacctatatttaatacttcacatagatgttcaaacgttcgatgtggtagggtgaaaaattttgaggcgagatttagacagggcctaaattactgccaatgttcaaccatgcatgtgctctttctccatgcaactgcactgaaatttttgatggagcagtagtgcccaaattctttaggattatgaatgggggtaacattaagttttccctgcatatatatattcacatgtctcttcagcatgcttgcatgaaatcttttttaacttttggccatgaggtcatggcttgcatatgagagccaggccatatttgaaaagttttttctaaaaaaaaaattaagtaagggtgtgatgcatgaaggacatcatgaacaggacagtgcagtgccttggctacctgaacatgcaggagaaaggaaaggtcgatggcactctataaaatctctgcaagcgagagtgagctatagtggcatttaagcgactctttgtacgtttccaagaactactcaagtcatgacattgcactctagctcttgtttccttgtacttaaattcagcagtagtatatctacaagcatatgtacatgtgcatatgtactatccctgtaatgcgatatactacttgcatatacatttgtttttaactctcccaacatttttgacagtatgggtaaaatctgactgcatgtaaaaaaaaaagaaaagaaaagggagaaatctcactactgaaccaaccatatactctacccgttccaaattataattatttctaggatttaaaatttctaccttttcatcttaaccaatcctaattcttttttacctcaactttattaatttccgctaaaacttccggaaatacttatagtttacagaatcagtaaaatatcactgcatctcaaaaaagagaaatctctgacgttctgaaccaactagattctacacgctgtacaatcaaacatgcatgtcggtaaatttattagcataggcttgaatttttatcccattattaaaaaaatgtcggtaaagttattcaataactattcccgtttgatatatttgcctatttctatctcatcaccctggtaagtcatttattcaagataataccaatttatagttttctacttcccgggctccttatgatgagttgatgacaatcaacattggcatgtaaaatagtctttattagcggtctctctttatcgtcatgtaagtatatttggtgacgtggaagagagaggaagaaggaaagagaaagatggttgctacgcatgacaacggcatatagtcgactcttagcatttattagaaattttttgttgcattgagtctaataaaggaaagatgactagtaagaaagtattttggtacattaatggttagagaccgtactatcttaactattgtaacgtgatagcctctaattaatgtagagaccacaccggtctctacctttgtacttgccctcagtccctcacttacttgtggttttccgaaaaatcatgcataaattaagctagcatccaacggatttgctaactggtatgcgacagaaatttagggataaaatcttacatgttttggatcgtcaaattcgcaccaagatttgtgcctgagctccttctcctataactccggcgccggtgacgcccagcccaactcgatccagctgattaatacacagttcttcacaaccaaacggaagaaattcgccaccatctgctcttcccaagtttctttggagctctcgcgtcgtcctcccctaggggcggcacgggaggcggcgacccggccgcccctctccctcccctcctccccctctgcttcgccgccgcccgagcggccgccggcaaagccggccggccgcaaggacggcggcggcggggcctctcgcgtcctctcttccgggcgggcagggggccgtcctaggcggagcggcggtgaccaccagatccagcccgctccggccggatctggcggggtagcgactagcggcggcgagggtgggggcaacggcggcggggagggcgacggcgatgtcaagggcgcgtgacgctgggcggtggtggctgaaggcggcggggatggcgatggcggcggggatggagttggccgatggcacggaggcggcggcctggtgctctcgtggcggcgacggcacgttacttggtggcgacggcggcggtaccccccagatccgcgcctctcggccggagctgcagggtggcggcagttggcgacggcggcggcagtttggccagcggcagtttggtcggcggcagtgggcgacgacgacgacgacggccggcggcagttggcgacgacgatgacgacggccggcggtagttggcgacgacaaggacgacggccggcggtagttggcgacggtctcggccggatctagataccggcggtagttggtgacgacgacgtctgtgtggtgtcgtcggcggcgccggcagtggccaggcgaaaacgtggtggctgccgtgtcaactggcaacggtggtggaagccatggcgttgagctgttagctgctcggtggtggagggcgacggtgcagcaaaggttttgcggaggcggtggtgatgtcggcggcggggaaggagtcgggtacgagttgggaataatgacggcgaggtggttgggtgttcgccagcagcggctgtggtggtggtgaccgtgttcgcggtcaccgaaggcatagcggcctcggttgactagccgagggcgtgggagacgtccgcatctggtcggcgcggcaccgttcggtggaggggtcgaagaccggcttggcacagagaagtgcagccgatggcagtggaggccggctcggcgcgaaaggcacggccggcgnagatgaaggccggcttggcgcggaaggcgcgcccgatgaaggaaggccggattggcgcgagaggcgcgtccagtagaggaggccggcttagcgcaaaaaggcgcgcccggcggtgaagaaggcgacctaggtgtgaggaggagctgccggtgggtgtggcgcggtcttcggcgcacgaaggctggccggcgggggacgccggtgcaagggtcccacatgtcggcaaagcttgtgtggtggtggagcatcggtgcatcagtcgtggtttcgcaagggcgatctcgtctgtgccctttgttgatctagtggcggtcggtcacgcttagcggcggccaatccggtgctagccttctcctggtcgtgtgtgttggcgatgtcggcgtgtgggtggtggtatattttttccttttcctagttacgactctctccagggttgtaatcttataattttttcctgctctatcaatagaacttcgcaccgtctcgtgcgagtcgttcaaaaaaaacaaccaaacggaaagaaggatttcgacaaatttgctaattaaggctgttgagccttaattagctgttagaacattcagggattcatcgttaggcatattttggtgttgatctttatatagaaatacatataaatgtgattaaaaagacacactacaagttgttataaatgtgatatttatatagaaatacatataaattccttagactctgtttggaattagtgctggctttttttttctgaaagtagtgctcggttgtcattggttggataatcccccgtccaaaaatataacaacttttagcactcaggttttatcctaaaatataacaacttctccactaacattctcttaccaaccaatctcaatcctcccaccattcacttttcacaccaaccaaattcaaaaaatgcatattgaattttaattttttttgacaaaatttgatcggaatttaccaggaggcagtggtcgtttttggctcggaaccggttaatttgatgaaccctgaacataactctagtaagatacagtatatacttgccaaaggagctagctgagccacagggtcgccatctcaaaggaagaaaaattaggtcaaatgtctaagtagttataagagctaacaaaaatgtgatgctgtcgaattaatctaatgacgtacaaatggtcttctaggtacacatttggcggtgacggagaggctgtaggagagctagcactccacaaaggcacaatgccaatttatttcccatccctttccttgtgtcgatgcctatctttactcaatttaattcgcattaattggaattgtcatgtaaaatcatgtattgcaagtgcttttaagagcttccgctcttttctataatttctaagatatcgacttagactttgatacatatatatgtttgatcgatcattgtcttttcttatcatatatccataaaaataaaaaatatataactacctaaaagtattgttatgtccaaatttgcttattttcacatatgaaatcttaatttttttttctctgagctggttttgttagacttggccacaataacgtggggataacatatcttaaattaatttacatagactatgatgacccagttggcacatttgaggaaaggcaatcaatgatattcactaaatgagatgcaagatttattgggcatgcattatttgtcttgctagtacatagtagcagaggccctatttacatgtatatataaataaataggagaaaatcagaaaaggattatgtgttgaaaatttgaagatttttcttaagacattaagtccatttcaaagtagaattaagttgcttttgggaaatcagcaccatctataatctatttttttattggtgtggggaatggtaggtgtatgactccacctatcaagtaccaagttttagatccatgtgttcagaaatatggttgtgtacactttttgacgtaggagtcacaagttatacttccattgtaaaaaaaaaaatgtttgttccacatatcaataggaggaaaaaagttacagtatatttttatggaattgggctgtgatgtttgttattagagatgtagttatatatactctatcgaagtgcatcaaatagttgatgttttgttattatccaggccaaacaaatatatattgttcaacctcttttaaacaaagaaatactagcaagtcaatggaagtgatacactatgcaaattttaacgtttcatatacagctccatgaaagtatttggataatgaattatagtaattaattggcatttcatcctacaaaaaaatatgtttttttttaaaaaatacaaatggaaattattaaagattgttattagcccacacaacctcgaatttggtgctaagtatagttgctaacaagacaaagtttaataaaatcgatgtacatatattatataagtagagaaattaaatactacctacagcatgcatgtgattttcattattaaatcgaatcaaataaatgcatgatagctctatttttattctaattgaataaaaagatcatttgattttcattatttatgctttgtctgataatataatttaggttaaattaaaaggtgccacaaacacacaagcattcatagaaaaattaaccggccggtgcaacatgatgcccggatctcaagatttaaatacacgtaatttaaacgagtatgatttcttatgaatattaactagctctcaaacgagtttaaactaaatttgagcttaaaaatgcctttttttaaaaaaatcttatgtgataatggaataattaaaataaagttgagtttaagtttgttttgttgttatgtatatttataccgattcacttaaaaaacattggttaaaagccttaaggcatagtatttaaaaaaatgcaggaatttcattggaaatatgtcatttccaacagaattcgggaagaactcactttccaagctactactcatcagagcggcaacactcgctagatttttctcagaaaattaattaggggaaacaagacacgatgtatagtaaaattaataaactgtaacatctatacacatatatatcttttaaaaagatgtacatttatgtctttatttatccactcaggactaactaatcacaagtcacaggcctaccattagtataaattaacttacatatgatcagttccaaaccctagcatcatcagagagactaattaactaaaaacctacaaaagaaaggattaattaaccaagctagatcaacacctgcaaactcgatttaaatcaccgagaattaactcgaagcccttttaattagctttgattagttgcatcttgattaattaactcggcaactttccattatttttttttgttcttgctgtctacttgattaatttaattttggttgtactacacttaaaagaactcactggggtcccccaatggcaccacgtccatgagccccatgccgccgtcgtcgagcagccagctctccagcatcgagaacgccggcgcggggccgccggcgccgccgccggtggccatcttgctcgtctccgtcgagcactccggcgtctgggcagtcgccgcggcggcggcgccgctctggctcgccgacgcggacgcggatgccgcgccctcgccggagcactgcggctgctgctgcgtcgtcgccgtcgtggaggtcgaccccgacgcctcggggcccttgccgttgccgccgccgccgccgcccgggcgcatccagccctgcagcagccgcgcgatgttgtccgcgctcgacgcgtacgccgccgacgaccccgctggcgtcgccgccgccgccgccgtcgccggcgacgggtcggggtggtcgagcgagagcgcgtcgcgcagcgcctgccgcgccgtgtggatgtccgtctgcagccgccgctcccactgccccttaggtgcggcggccttcacgcttttcccgccgccgtcgccgtcgccgcggccgccgccaccctccgaggcggcgccgctgtcttccccaccttcggcggcctgcatcttcttgagcttcttcttgaggtgcgtgttccagtagttcttgatgtcgttgtccgtcctctccggcaagtacgacgctatcgctgcccacctacacagccagcaacccactcatcagccatggacgccatggacaaatcaatcaaagcaaaccatgaaaaaccaagaagaaatcaccggttgccgaggagagcctggaggtggacgatgagcttctcctcctgctcggtgaagttcccccgcttgatccccggcctgaggtagttcgtccaccggagccggcagctcttgctgcaacgcatcagccctgcacacgcgacgcgcacagatgaaaacaaaaatctcggatctctcgccgatcgatcgatcaagaacgcaagaacacgcaccggtgttcgtcggcacggcgcgccagttgccggcgccgtgctcctggatgtaggagaccagcatcaggtcctcctccggcgtccatggccccttcttcaccccgaccttgtcgcagcacggcggcctccccatcctgcagctcgccggcggcgggcggcggtggttggtggtgtatgcgtgtcactactactcgatctcgatcagggaggagacgaggggagaccggggtccaagaagaagaagaagaagatgggggtaaaaggggagggggcgaggtatatatataaagctagctagtagctagctcgccatggccgatagatggcaagctcgagctacagctgctgctgttgctgtgaactgtgaagtgtcactgctagctgcagtttgtgctcgggtttgacctaggtagaaagctgagctaataacatataacgatggatgaactgcggcgaaatgacatgttacatgtacacatggtgacaagaacgcagatatatactagtatggcgtaataaggcgaaaacgaaatattgtttttttattaaggccctttttagtttcaaagtttttttttctaaacttctaactttccatcacatcaaacatttcatacacacaacttttctataacatcgtaccaatttcaatcaaactttcaaacttcagtgtgaactaaacacaaccctgtttattttattttgttttgcttgctggcgcaagatagatatgcttttttaaaaaaaacaaagtacaaacacatacacttgtattgcgcacgcatccgcgcacctatctcaatgagcatctccgaaagacaaaactagtatatcttgagactggcgaagttatcatgagcgtctcgctgtcaacgggtacgtgacctattactgaaggaacaattagccgtaaatgcaaacattcatatcaagtttagaacttaaatccaagcggttagtttcaccacaaggatcataattagttgagttacgctcatttcgtgtgtgtcgtcattttagtttgctcttaaatattaatgaattcatttaaagtggtatagtagatttgatttagttgtgtggggctgttgaattttataagcagaaaaatgcaaaaataaataaataaatcttctcatatgtaattttcctacctagacattttggccacgccattggtgacgtgtctaaacaggacaatgctgccacactggaaagaaaaacaaactttggggttggcagcctctcgttgccatgccgttgctaatggcatgacaaaaggttgaactattgggaattaagatgcaagaaagcttgtatgtattcttttaggaaaatatttaaatatttttaatatcatctgtctgttgtgattgaattttaaaataataaccgtatgcatcatttctcatgaaatcgtatatatatttaatttgtggtgtcttgtcgtcacacaaataataattatggctttccggtgaacataaagatagtaaatatgctatcttgctttcaagtatttgtttttagggttaattggtccatgccattacaaatatgccaaattagaaaaatattattactattcgtgatatcagctaagtgccactgaaattttataaaattaaaatcatatcatcgccgttaaatttactgtcaactccatcgattttaatctcgttctcctccctctctctctcttactgccgctctctcttctccactctctgtgcgaggctgaggccgaagaggtggtcaccgcaacgctggctctggtcgaggtagagctcatcaaggggaagccaacggtggtggccataggatctagggatgccctgaacgacacataccagcgtccgaagctcatggcaaaaatggagagagaactcggaggaactatgaggtgcaggaccttggaaatgaccagtggaagggaggggaggaggttgatgccactttattggtaggaggaaggaggggaatgaccgtggggagctcggccggccatggaggaggcgaaatggccgaagttcaatggagatagaaaccggtgatttaggtggtatttgaatccagggactaaactttagttcctattacatcggatatttggacactaatttgaagtattaaatatagactacttacaaaactaattacataaatgagagctaattcgtgagacaaattttttaagcctaattaatccataattagagaatacttactgtagcatcacataggctaatcatggattaattaggctcaatagattcgtctcatgaattagtccaaggttatgaaaaaatgggtttgtcagtagtctacgtttattacttctaattaatgcccaaacatccgatgtgaaaggaactaaaattttttatagctccatccaaacacccccttagtgcggtattgaatggagattcatgggggaaataaaaagaagggaatggggaatcgatttttgtaattactaggaaatgaaattgtgtggggaggtggattaacttgttggtggggctatggttttggccgggagagatgaatggctgagctgaggtgaaagacgacgacgtgtcacctccctaggttggaacttatggtgggtcccacatgtaagggtattttggtcaatatgatgatagaaaatgtgacggcgatggtatggttttaattttacaaaattttagtggcacccaaccaatatcgctaatagtaatgttatttttctaattttgcacatttataatggtatggatcaaatttaatctactcttgtttttaccttgtcttgtggatgtcatggttgaaatccaaccaaaccttgtcctctgccaaaatcttgtgtccctcttatttctctcaagggaaaaatggaagaaaaaaacgaatgcgtgggagacggcagtgtgaaaatggctaaaacataaaacaaatttaattttaacttacttttcttccttacctttcttaaatcatgtggtttagatttattgttcccccgagagcctgagacatgcatgtatttgttctttcttctcgtttgatctcctttacatctgtaaaagttcagggtttcttcaagaacataagaatcttaattataacacgaattttgtaggaattagttcaattcctacaaattttcttcaacatgtccttcatccaaaagaagcccttgaggccacactagcacaccaatggacaacatattgaccgtgtatttgtatctccaataagattaggtggtgtttggatgcagggacgaaactttagtccctgtcacatcggatgcttggacactaatttggagtattaaacatagactacttacaaaactaattgcataaatgagagctaattcgcgagacaaattttttaaacctaattaatccataattaccatatgttactgtagcatcacataggctaatcatgtattaattaggctcaatagattcgtctcgcaaattagtccagagttatggaatggattttatcattagtctatatttaatacttgtaattagtatcccaacatccgatactggatccaaatttagtgtaggtgtttcttacaccccaaactcaagtcttttcagtttttttagcaagggcttggcagcccctatttctattgccagaaatgtgacaagctacagagttccaactcaaatcttttcatgtcatctcatcttacatggcagaaaattaagaggtgcactcacactaggatttaatttagttaacccacaacaacctagcttactatcctaattaacacgatgttgacgacccaaacattgtttagcataactcatagtacaaggttccagaaatagattttctgggcaaatagctagtacaacagtgaacagagattgtcaaacaattaacaagaattgtcaacaagccatgttttcacaagaatacacaacagtaaaatcttgtgtgcagatgcgccaaacacgtggtactattatctttttggcagtgagtagggagttcttcaaaggaggacagcaagggtgcatttaatcggatgggggctcgctaaagtcagcttgattggagtgaactgatctgcgtgcatttatttcctgagcccccctcatcatcatcgtccccggcccacacacctttttttttccctccttaaactcactttttctgcaccatcttattagagcaggtataatagtgggctataagccagctgcaaatatattttaagaagataaatgatgagagagaagggcagcgggctacagatttgtagccagctatagcacggactctaagacgctgtgtgtgtatgactggtgggaccagatattaatagtatagtatgtaactattgtatgaatgagctattagattgtctatagataaattggagctagtagttggctatactattgaacttgctcttagtagtattaaggtttttaaacgggtcaaatgtgaattcaatagtttcaaaatgaatgcagcatccgaacatggcatgtttggttgctgctacaatttaccatcatttgttagcaaaattgtcaacttgtctaagggtatatttgggggagctactcccccaaagagtttaaatttcactcacattctaagaatctagttgtagaatctaaaaaatgaactagaacccagaaactgaaaaaccccttcttcagattctcagaagctggttactaaccagcagattcttaaaatcttaaactcacccaaacagaaccaaaggttatgtgcgtaaattctttgccaaacttaattagcaaggctaaaagaatatctccacatttttttaagtcattcacaaatggaacctaatttgttggttggaaatattatcgtaattgtggctacaacggaacaattatctgagttaaacaatcttaaacgtgataaattatggtaagtgtgttgtgtctgacaactaaaacatgtcaatagcgtggacatgatctttgaaactattcatacagctcggatgtcatactaagcaaacagataaaaattaccagctcgccatcactttagaatagtgacaatgatctaaatgtttaatctatgactgataagtcatggaaaaataaactaagtaaccaaaataatttatggacaaatcttccattgtatacggactactttgcaatacatgattctaaaaatatacgaaagtagaaaaatacggaaatatgatgtcatgttttacacaatgatcttaggcaaccatgtttcagtagcaaataataaaacaataaatggacttttaggggaatttcatacctttcactcctcctctttcttctttagctagaaaataataaaataatgaacgtggtgtctaatagcaaataaccatgttttgatggtgtctttttttttctaaatattgacttctatcgtatccaccaacaaaatttaccttaatcttatagggttaaaacacatgaatataaatttggtgtgtttggatgcttcacgggaaataaatgtaggaattttaaagaaattgtgtgtgccagagatagggtagaggaaggaagagagtgcatcggacaaaagaggtatgagctcatgtttattttcctatgaaacaggggcaaacccaaaccatcggaattttggcatctctatgcctttgatccgaagggtctatagaaatttttttttgaggatttcagttctccacaaatcctttgaaaattcttcgatccaaaatagccctacatgtgttcttagcgatataaaaactaataatggaaactaaactgcaaaaaaacttcaaaataggtttcaaataggttgcgaaaaaccaatgaactaaattatgttttaaaatctaaattttagctacggtagatataagacaacaagcaatcgaggagaggcacgtctcatttttatagttaggggctgatcggaactgttggctgctacagccgtcacggctgtggccgttttcagctgctgctgctgctttttagctctcgtagccgcagcggttgcagcaggaagcgctaccgatcacactcttagactcaaatagggaacggtttcctattcaaagtacagtgccggtttgaagaacctcgtttcctatgtatttttacaggggtttacttgcagtaaactttgcttgagtgctcttacctttagaaaggcaggaaagatcaagtatgtgtggtatagaacactagttcttgttgtatcctaggacataacccttcgaagggggttaaatctcactcaaaagtcgctcaccttcaaattgttttgatatcacatatgtgaagccttggatcatcaggttatatataagcaattttaccatccaacatttggtacctcgaggtaccacatttcacacacaattttcatacctcaaggtattactccctccgttccataatataagggattttgacttttttgcttgcactatttgaccactcatcttattcaaaaaatttatgcaaatataaaaaaagtaagtagtttggataataaagtaagtcacaaataaaataaataataattttatttttttaataagacgagtggtcaaacaatacaagcaaaaagcctaaatcccttatattataggacggagggagtactaactaccactaattaagtacctcaaggtaccacatttcacacacaattttggtacctcaaaggtactactaagtacctcgagctaccaaattttacactagaaagtatgtggaggtaccaaaaattcgtagtatctcgaggtattaaatgttggatgataagattgctcagctatataagctatatatagttaggctcatccctttgagtatgccaattgatatcagggaaaggcatgactcaagtattattgacaacatttttttgagggattattgacaacaatttatatgctctaaaatttactgcatgtggccggccttcaaaaaatgatcaaaaaatttatagaaacacgtcttgtttaattgtcctgcccatcatgtactgaacatatgtacgtagaatacgatgaaattaagccagcatggtcccttcttgagtgtctacttcatgtattaattaacgcataagtaattattgattaagtaaagccggaattgcatgcgctgctatattattttgagtgaatcttctatgttgtacagaatcaaaccagctctcatgtatgttctgtacgtgcatatatacgcgcgtgtacatatatacgtactgtgtacacgcgtatatacagtatgtgcattagcgtgcaaattttaaggcccatttgaatagcaggattgagaaaacagaggaaaagaatatcatacttattggattcctatgggattttaaaacacaagaaagtctccaaactatcgtttgattagcacatgaaaaaaacgcaggaattttagatacatgaagatgaaaccatgaggtgagaccttatatttattttcctctaaaattgctctagtaagatctattccataggaattttaaagaaattgataggaaacaatcctctgtttcaaaggattctataggattatttttcataggataaaatcctgtagaattcctatggttttttccttttgaatcaaaaggggcgttagtatatatatacggagtagatcagtaggatcgatgcacgttaaataatatatatacttatatttgcgttctcgattggtccacaacaatacttgctactcgtgcatttacacacacacacacacacacacacacacacacatatatatatatatatattgattgattctgactcgttaaattgagatataaaacgcactactttcatcgtaaaatataagtttttggttaataacggatcctaaaaacataaacctcactttagtggaattaaatagggaatgttgtgtagtggaattaaatagggaatgttgtaattggttgagaagatgaagtggatatggaattttaatgatggaagattctgattggttgaaaagataacgtaggtgaaaaagttgttatattttggatcaaatttaaaaggctagatgctattacatatattttgtgatagatgaagtaaaaggtcaaaatgttttataatataaaatggagatagtacctgtgtacactatatataccattatatattcgtcattttcactgtataacaagatgtgtggatttaattgtgcgaagtaaaagtagctcaactgatttggttccttgtggtggaatcaacccatccggattcaagtctagacttgaagtgaagcgctcgtgatgatttcatcaatctcaatatatgctggtccagtcttccggaagtgatcataggggtagggtgtgcatgtgtgcgttaatagggatgagtatgcgcacgttacaagtgtctatgattgtactgtgttttttttaaaaaaaatgtgtggattttgtcgacgggtggtacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttacaaagagaacaagggaatttgttggatccggcgagattgtagtcgagttgattcgactagctctcgatgacttggctcctcgtaagctccggcttcgtaggctgtggaggttgtgttggctctgagattcgatgcctaaaccctccccggggggccccttttatatcgcagatgtggaggtctcctcatagaactcggaggtatcagaccctatacgatacgccaacgacccggttctgcccgagtaggattcttcccatctgtagattccgtgaaaggtttccttagaatatacaggaaatatccgcatgcgcgtgggtatgccatatcaatatgtaacgtatatcgaagggtaaagggtatgcctaacccgtaaccttgacagtagccccgacttctgcttaaaatgaactcgtgcaaccatttgcgacttcgggtgtcgagactgttgtcattcccggtgcgaggaccgcggagatagaccgtagtcgagcacgccatttgaagcccaacggtcacgagcgaattttaaactgaagtccaaaaaaccgccgcgcgtaacgggaccagaaatttccggcgggcatctctctctgttcagtggaattcgcaccgtcggtagtgcgcctatttaaaggaattttgggagtccattttgaagtccaccgaacctgttaaacacacaccacctccaagcactctttgccttctctgccgccgcaagaaaccctagttcatcaacctagtctcgttttccggcgaccttcgatcagcaatggacctcggcaaatcagcttccaccagtgcaatgttgaagaaactccaggaggatggcgctcttcctggccgtggaaccatggagagggaagcaggaggtactaatcctcagcccatcttgggtcgcatggttgcgatcgaagattatgttctctgcggttttctccctccaccttccgaatttcttttcctggttttaaatttctatggtctttctcttttccatttgaaccccaattccatcgccttccttagcatctttgtgcatctttgcgaggcctacatcggggtagagcctttccttaatctttttcgcttttactacgaactgcgttggatggaatccaacagggtatctggttgcgtcgggttccgacttcgggatggcctgaagtcgcgttatattcccttccactgcccttcttctcgcagcaagtggaggaataggtggttttatcttgagatcaaggaatcgaaccctgtcttcgtggttcccgaagatcaaccggacaagattccgtcttggaccgcaaagccccccttgaccccctctcttcagtcgtttatcgacatcatcgacgatctccgagtacggggtttgtcaggatatgaagtcgttgcagacttcgttggtaggcggatccagccgcttcaggctcgagcccatccagcttataactattccgggccagaggacgcgacccgggtttctcctcagggtatctttctcgcatttatcttgacatacttgtgctcacattcctcttgacttatcaaaggttggttctcgattaacaggtctgagcggtgaaaccgtggagcgccgcgtcggccaagtgatgatcagtggcccgaccacggcgagtgacatccctgtgcccctttgtgaaaagggggcggcggaacgtgatgaagccatcaacgtaagtatattcgatgaacatcccgcattctcctttcgaaatcaatttatgacttgattgagcgtaggcccttcctttgactgatatcatcggaccgctcgcggaccatcaggtggcgtcatctctgaaagttaaggtcgtcaaggaggtgtctgatgctgccaccactagcggtggcaatgttccgacaaagccgaggaaattctcgtctgtaagcagacaacgtcgcaagccgtcgaccccctcggtaatttattttgtcgttaaatcatgcagcaagaaggatttttccttactttgcgttcattgtcttccaggcctcagatgcgtctcccccacctccacgacgacaatgcattgtgacaatcggcgagaagtaagtagatgatttcttcaatccccgcgcttattattcgattgttgtctgactcgtggtcgtcctgtagggaggcgcaggcaaaggctgcgcgagccaagtccggaggagcttccagtgcgtcgcctgtcgtggcctcgacggatgtcgtgcccgcaaccgggagccgggaggcgacgcctagtgtcccagtcagcgaccccgcggcaggtcgtgatctgccagctgcagtcctcacctgggaggagctccaagtcgagatggggcgcctcctcgaagccggtgctcacggcatcggccgcgagattgcggaggcgaggttggaagcggcgacagcgaacgtgcgtgctgacagactggtgcgcgagttggctgaagcccgtgaagacctcacgaagatgagggagttggcggccggcaacgagcgacaacggaaggggctcgaggaccgaatgtcggaactcgggaacaacctatctgagatccggggctcgttgagggtcacctacactggccttcaccagctcgccggggaatgcggcgtcacgtccacgatcccggcgaatcccgatgagttttcgctgacctcctctctcgcggaactggcgacagcgatgggggaaatcccctccaagcatgcggccaggattgcggaggagacgtcaaacggaatctacaccggggcgtgtcatgtcctcgtgtgtgtaaggctgttgcgtcctgaactcatctgcgcgagatcttggactagggggcggccagcaacacgcgtaaggaggtgatggaagaagtcggtgatctgggggagtctgttctccccctttttgaagagtaggacttcttgtatttcctagataatgtgtaaaactcgaactctgaccgccttcgtgcgtgcgattactatcccggcttactttggtatgctgacctcgggaacttttgtcctctgtagagatgttgatgacgaggatgtccagcagcgcgggcagcccgagtcactggcagtaatttcggtactcgagtttgaaccacacgtctcgcctgaccatgtggatcaaccccttgatatagagggaaggatggcgacgacttcctcaggttagtagtcccttcaccccttaatgcccacctgactaggtcagccatgttcccgaaagagatgtatagcttgacttagtggttatcacgtttagcagatctcgagggtgcccttgctagccaagatcgtcgtatccaatactggaagacgaagtttgaagtggcggagctcgagagaaccatgctggccgtgaagaaagagcaggctgtggaaacgctccgaggccgtgaggtatggtttaactcgtacttgaagagttgctgcacatccatggccagagtatgcagggagcttcgagtagtccgcggagatcccgaggagtcggtggccgggtacatctcgtggcttaatagggcctatgcccaactcgatggaatcggcaagcgtatcgacgaggccttgaagcaggagtgtcgtcgatcgagccgatatgccggggggcacgtgttggcttgcctacaagatcatcgcccacacttggacctcgaatatcttcgtgagggttttgctcgttctcggaggactccggcggagatagactatctggcaaggtcaatgtcgccgctggccaagaagatcttccagtctatggactgacgttggccttcttggtagtactcgtaccctataacaaatatcttaggaaaagatgtaatgtagcgaaatatttgtgaaaaaactgtaaggagtattttgtgaataaagaaatctatctttgacaaatgtctcttactctggatgtcatgtgtaagagtgcgttctcagttaacgactttagtcagccgtttgagtcgtacactctccctagcccccagccttgtcgtcggaggaattttctcagaggataaagctcttggacctttggcctgccttggttgaataagctctgatcctagcccccagccgtgaagttggaaagttgatttccgatttcacggcttagttaatacgcatggcgagaactcttacacgaccagatcttacatggtctttcgtctctacaggatctgacaaggccttatcggctctgggcgtccctagccgaagatcccttaggttcctcggaggccttgtcgagacggcgtaaagggacataaggacaggtttcaacgctaggtgtcatcacagtgagggatcatcgggcgaaacacgttgattgtgatatgggcctagaaatagcctttattgatactgtaagggtgcttacaggtatggatgatattgactcatacatagaatttacgtatttggtcaatgttccaagaatttgctaattcgcgaccgtcgccgtctgcgattttgaatgcgcctggccgcaagacttgtgtgatcgtgtaaggtccttcccatttaggtgagagtttgtttcgccctgcttggctttgaactcgtcggaggacatagtcgccgatcgaaagtatgcgtgcacggatgcgcttctcgtgataacggcggagggtctgttgatagctggctgctcggacggcaactcgttcccgatgctcctcgagaagatttacatcgatatctcactgctcctcctggttctcgtcggagtacttctgtactcgtgtactctgatgttgtagctcgcttgggagcatggcctcagagccgtacacgaggatgaagggtgtttccttataagacgttgtcggtgtggtgcgtacggcccatagtactgatgggagttcttcaacccaccttttgtcgtgtgacatgagcctgtcatagacgcgggttttcatcccttgtagtactatgccgtttgccctctcgacttgtccgttgctttgagggtgagagaccgaggcgaagcatattttgaccccctgcccgatgcagtagtcctggaaatcggcgctgatgaactgggagccgttatcagttatgatgtagtgtggtagtccgtatctgcaaaatatccctttgatgaatttgatggcgttgtcggccttgatttcccccgtgggtactgcttcgatccatttggtgaatttgtcgatcgccacgaataggaatctgtagccaccctgtcctcgtgggaatggcccaagtatatctagcccccagcacgagaatggccaagtcagagggatagtctggagcgcttgcgcgggtagctttgtgtgtttactgtggaattgacaggcttcacatcgctggaccatgtcgcatgcatctttaagggcggttggccagaaaaagccttgtcgaaaagctttgctgaccaatgtccgaccggcggcgtgtgacccacatatgccttcatgtatgtcgaggaggaggtgtgtagacccccgattttggaaatcagaaatcttctgtgtttatccgtaccaatccctgtgtcggtgacatggggccgggggtatcgtgactagaggcttgggtagccgtggtcacctacgtggcctgaccccctcggtgggggggggggggtcgggcccgacggtaacgtgcccacccctccctctgtctccccgaggggtcggcccgctcccgtttcggccccgagggttggggcgccccgaccccctgtggttttggcgccacgtgtgtgggttaggtgagcacaaggggctcacctaccggcatttatagcagttggcacgagcgcgccacgccgcatttaatggggcgcagcgcacgcttatccggaccgtgaccagtcgcggtgtgtgaccggtcacagcccggtaagatcgcggggtaggtggcaacaggcggcctgtcacacgcctcgccccatccggtaagaataatgagagcttcctggctctcgtccctagccggagccggcgtgctaactcctggagttggtatgtcagtcccggtcagatccattccaggcttcagcgcaaggatggcaaggaagtcgctggccattaaatgaaggttgaagtgggcgtccccgggaaaagcgggcgagcggggcaggaggcgtgtgctccgcttgtcatatgtcctttccggctgtagattagccctcattgtaaaagcgtgtttcctttcttaggtagcgggaggcccatgtggtgacccctgaccagataaaaaggaggcccaggcctgagagagaaaggaggagaaaaagaaaaagaggagaagaggggggcgaacggggctagagcctgaacgctctctcgctctccggctctggatattccttcactcacagatccaccagaacacaggagtagggtgttacgcttctcagcggcccgaacctgtctacgtcgcccgtgtcttgcgcatttcttctctcgctgacgttcctcagatcgagggcgaagaacctcacttagcgcccccggtcgaaccggcaaaggggggcctgcgcggtctcccggtgaggagccccacgctccgtcatctggcgcgccaggtagggggcgcgcgggtctttctaagccctcgtcctctctcgtgtgcgccaagcttcgcccgctcagccgaatggccgaacgggcagtggcgcacagcctctctccgaacgctagcggtgacgatggggagcagaacccgcgccgtcgggctcgcaccccaccgtccccctctcgccgaaatcctgggcggggggaggcgctcggggaggtcggaggatccgcgacttcgccgcccgcgggcaacgggggaggacggcgagacggggcgcgtcgccgcctcgtctacggcgatggcagcacgccccagggcgcgctccaggctgcgggcgcgctcctgcgtcacccgcccgtcgtccccgatccagagactccagcccgacgttagctggatgacgtggccgacttggtcatgacggcgcagcagcgactaggcgccggcgggcggtcctccgccatcgaggcttctggcgctgccgccgccggctccaagtcgtcgaggcgaagggcgcggcgagcggcggccgttacccgccgttcgtccgccattccctcgtcaacgcccccaacccaagaaaatgtgcgtggggggccgaatgcccgcctcgatatcgagcgccggcgcgacgctcgtcacgccgcccacgcaacggagggcgcttcctcgtccggagcgccacttcggtccgggcacgggagccggccccccgtgtccccggttggcggtgccggctgtcgagcctttgtggcgagccttcggaacgtccgttggcccccaaggttccggcccaccatcaccgaaaaatatgacggaagcgtcaatcccgccgagtttctccagatctacacgaccgggatcgaggccgccgggggtgacgacagggtcatggcgaattttttccccatggccctgaagggtcaggcgcggggttggctaatgaacttgccacccgcgtcggtccactcttgggaggatttgtgccagcagttcaccacgaacttccagggcacatatccgcgcccaggcgaagaagcggacttgcatgcggtacagcgaaggaacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgccttcaaggagccccagaccacagcgcagctttttgagctcgcggaccgtgtggctcgcaaggaggaggcctggacctggaactcctccgtttctggtgtggcagctccggccgcccccgggtccgccgctcggttagggcggcgggacaggaggaggaagaaggggtcggcccgttccgacgacgaaggtcacgtcctcgccgtcgagggcgcttcgcgggacccccgaaaggggaggcctgcgagcgacaaaaagaaggaggccggcgctcccagcagggagcgcccgaccggcaagtggtgtaccgtgcacaacacctccctccacgacctcgcggattgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgccgaggacatcgacgatggcgacgatgacctggggttccaggagcctgaggacaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacaggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgacaacttccgcacggagcgggtggacttcgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccaccttgccgcggcgtccaagcctgcgggtggcgacgagaggctcagcacctccgtcccggccgccccaaggcggcggatggtcacgtgcgacgaggtcccggtcaaggaggtttccttgggcgacggcccgtccaagaccacacgaatcggtggtcttctggacgacaaataggaagacgcgctcgtctccttcctgcgggcaaacgccgatgtcttcgcctagagaccggcggacatgcccggggtccccagggaggtgattgagcaccgtctcgccgtgcggccgggcgcaaggccggtccggcagaaagtgcggcggcaggccccgaaacgtcaagccttcatccgcgaagaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcataaaccagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcctgcataaagctgaaccccgataagtgcgtgttcggcgtgcctgcgggcaagcttctcgggttcttggtctctgcccgaggcattgaggccaaccccgagaagatatgagctatagagcggatgcgcccccccaccaagcttagggatgtgcagtgcgtcaccggctgcatggccgccctaagtcggttcatatcgaggctgggagagaaggcgctacccctatttaagcttctcaaacgctccgggccgtttacctggacggaggaggctgagcgggccttcactcagttgaaagcgtacctcagttctcctccagtcctggtcgccccggagccagatgagccgttgctactctacctagcggcaaccccgcaggtggtcagcgcggcgttggtcgtggagcgcgacgaggacaaccctcgctccacgcatccctaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtgcaccccgcgtggcctctcggacgaagagcaccctggagatgcggcccctggcgcagaggatcggccccgccgaaaggtgcagcggcccatctacttcgttagcgaggccctccgggacgccaagacccgataccctcaggcccagaagatgctttacgctattctaatggcttcgaggaagttgcgccattacttccaggcgcatcaggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcaccgactttgtggcggagtggaccccagctcccgagcccgtctccgcccccgaggccagctcgggcccctcgcatctgcctcacaccgcctactgggtgatgcagttcgacggctccctgtctcttcagggcgccggtgcgggggtcacgttgacctcgccgagcggagatgtcctcagatacctggtccgcctcgactttcgggcgaccaacaatatggcggagtacgagggactccttacgggactcagagtggcagctggactggggatccgccgcctcctggtgttaggcgactcccaggtggtcgttaaccaggtctgtaaggagtaccagtgttctgacccgcagatggacgcttacgtgcgccaggtgcggcgtatggagcgccattttgacggcatagagcttcggcacgtgcccagacgggataacgcggtcgccgacgaactctcaaggctcgcttcctcgcgagcccagactccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacctgaggaccgcgaagggactgaacgcgtccggcgcatctccaagcgctacgtgttggtggaagggaccctttaccggcgcgcggctaacgaagtcctcctgaagtgcattcctcgggaacaaggcgtcaagcttctcgccgatgtccatgaaggcgagtgcggagcccactccgcctcacgtaccttggttggcaaggcctttcgccagggtttctattggccgacggctctcaacgatgcggtcgacctggtccggcggtgcagggcgtgctagttccacgccaggcaaacccatcagccggcccaggccctgcagaccatacctctttcatggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagccaccggggaaacgcctttcttcctcgtctacggcgcggaggcggtcctcccatctgagctcaccctgaggtcccctcgggtcaccatgtattgcgaggctgatcaagattagcttcgccgagacgacctcgactatttgaaagaacgaaggcggcgcgcggccctccgagccgcgtgctaccagcagagcctgcggcgctaccatcagcgccacgtccgggcccgatcactctgcgtcgacgacctcatcctacgccgcgtccaaacgcgtgctggactgagcaagctctcaccaatgtgggagggtccgtatcgagtgatcgacgtcccccggccgggctccgttcggctggccacgggcgacggcacagagctgcctaacccgtggaacatcgaacaccttcgtcgcttctacccctagtggggatcgggcatcatgtctcgggctcgggccaaccccgcaccccccccgggcgtgcaggattggccgggggctaccacatgcatatacttaccttttttctcttccgtatttcaataaaagcatttttgatttcctgaggactgtgtctgtgccatcatttccttttgaagaatcttggcttgaattagcacgctcgtgctcgaccttgccctcggcggcccgggccggctaaaatcgccaaacggggcccagaaccgagccgtgccctggggcatggtgaactccgagggggaatcggcaaaggcccacaatcgggtcatccataaccctcggtcaccgcgctcccggcctggccagtctcgacacgaggatctccccaggcactagcctcgacccgcgccgtttgaggctgggacctgggcacgagcccttgttcaagccaagacacagaaggaccgcggcacaaaccattctcgtctcatacacacaacaaacagaactgacgcggaaatttcctctttacttgattacagattaaatcagtctatacaagaagggggcccgaaggccacggaagaagaagcaaaagttattaagattggcgggggcctgggggctcactccgacgcgcccgggacgtcggcctcgtcgtcgctgtcgtccgcaccgtcgtcaccgccctcctcgtcggagtcgagcgcgaacgcgagccgaggggccgtaccctcgaagctgtggacgatatggtcggtggcgtcccggaccttcgcgcgcgcgccgtcctcggttccgggaggaaactcttccagcgctgcccacggggagaagtcagggtccctggcctggtagcttgccagtacgagctccaccgccccccgggcgaggtccctcgaggatgacttgatcgtctcctcgagctcctcggggagccgctcgagggccccggtcatctctgagaggcgctgggcgaggcccgcctggttggcggcgtacttcgcgtgccgcccgccccagaggcccgcttgccgcccggcgcggtctagacgggagacggcgtcccgaagcatgccgggccctacttcgctcgccaaacggagggcctcgacctccccggcggacgagtccagcgcgccctgcagctcggcgatggtgtgttcggcggctgcgaggcgggcggctaggtcgccttggcccgcagccgctccgccgctgtgcgctctcgcgtccagctccttcgcccgcgcttcgagctcagcggcccgctgatccagtgcggccctctcggcgcgggcgccttccagattgcggcgcgcctgctcctcctgcgctgcctcgcggaggaacagactgtccgccagccgctgcgccgcggcctcggcctcctcgagagctcgcccccgctcggtgagcgcgtcctcgcggaagcggagtgcggactcctcttcggcgcaggcggcctcgtgcgccgccagtgttgcctcccgggtggcgacggcggcctcgcggtccgccaggtctctctccttcgcgtcaagggcgcgggcgtgctcctccagcgccgtggcgcgagcctcaagggcctcttcgcgctgccgggacgccgcctcgttctccgccgcccgccgttcccgggcagcggcggcgtcaaggactccccgggcggcgtcgagcttctcctctagctccgccgcccggctcccgtattggaggcggaggtcgttccgcgcctcgtcgagcacggcggtggtgatgagggcagtctcccgctcctcctccacctccctggcgatctccgccaggtccctacgacgggcttcgagctgtgaggtgtgccggcggtgcgccttgcggcccgcctccaccatggcctccaccgagcgccgcccctcctcgacgcgcgcccacgccgtgtcgagctccgcccgctccgcctgcagggcctccatctgggcacttaacccatccagcaccgtgctgttcgcggcggccaaggcctgcaggaagggctccgcgctcagtggggcagcagaagacagaggggagagccgcctcggtgtgggtgccgtgcggctcggcccgccgatcaacgtgccggactcgggggcgtcccccgaagctggctcgtcctaagcgtcacccgaagggtcgggcccgagcggcgcgcccgcggcctcgtcgtgggtggcctcggaagtcgtcgtcgcctcgggcggagtcgggtcgggggtttggcaggccgcctggcgtgcgcgcgccgcctctgcctcccggacggactccccggcccggcggagtctggcctcctcccgagcggcctcctcaacctggcgaacccggacggcctcctgggcagcctcctcggcttcctgaaggcggtccgcggcttctcgccggtcagcttcccgcctccgggcctccgcggtcgccgtctcctcggcctcagaccggccgggcttgaaagggcgggggggggggggggacgcaacgggatctcgctgaggcagaagaaaaaccagaagacaaaaagaaataggtgagtgaaaactcgccttgggagatgggagaatgaatacggccgcggtgggcgcggggacgaacctgcgaggaggtcggctaaacgaccacctcaggggcgagatgaggttcccccgacatggcacgatcccccccatcttgcggagccgtttcttctttcgctccccctcgggctgcggcatcggcacggcaccctccgggcgcctgctgctggcacgcaccgccccgccccctcggggaggagatgggggaggggttccctcctgcttcctcttcccccgggcgtcggcagggcggctgccccccaggcccccgtcgcggggcccagaagcacgaccccctcccggggtagattgttcccccctgcggctcccgcccgcgccatcgtggcctcggggggcccgctcccctgacgccccgaccacctgcatgatggtcaggatcttggcgcgctctggatcgcagcagagggggaggaccccttgggggatgagggatgcctccacgtagctgagattcagcacccgttggaccaccatcctgaagtcctcagggtcccagtcccatttgcgcccttggtgggtcctcatgtagtcgtcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctactgtcgctcgccagctggaggcctgcgccgggggctggctcggaagtcggaggcgcgcttcgtcggcgaggggggtgtagaaccaatcgcttttccagtcgtcccactttttgcggaggacgcagggaatgtagcggttcaacacctgcccccgcggctggaagtagcagccaccgactaccgtcggcggcgacaccggctgtacggtgaagaaccaccggaacagctggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcaggaccagccccgccattgcgaaagagaggaagaagatggaccgccccgggtagtgtggcgccgggcgtccctcggccagcgcgaccacctcccggccggtggcggattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacggagagttagagcacaagtggcaaaggcaaggggaagagtggcgagaggaaggaaacaaatcccttccttggcgtctttgtacccttgccaacgctatgcccggctcctcgcttcccgcgcccactacctcgccccctcgtttctcgcgcccacgcctccactaaccccactcgcccgtttgcggcgcacgcggaagatgtgcggccgtggcgtttgagatggggcagatcgtgcgcgcattaactgcgctcgccaaccgcgaaaaacgccatcatcgtgtccccgggcgaaacaaacctgctcgagtaatgtagcggtcttgaagaggccgctcattattgtcgatcggtttttcccttgccaatgcgcgcgatttgcgaccgttgggttttcgcccgcctgtggggaccggccccacctgtcaccgggcctaaggagtggcatcacgcccgagcgcctccctcgggggggtggtcgccctagcgtaacgctgggggctactgtcggtgacatggggccgggggtatcgtgactagaggcttgggtagccgtggtcacctacgtggcctgaccccctcggggggggggggtcgggcccgacagtgatgtggccacccctccctctgtctccccgaggggtaagaaaggtaangaagaaaagtaagttaaaattaaatttgttttatgttttagccattttcacactgccgtctcccacgcattcgtttttttctttcaatttttcccttgagagaaataagagggacaccagatttttgcagaggacaaggtttggttggatttaaaccatgacattcacaagacaaggttaaaacaagagtggattaaattcgtccattacattataaatgtgcaaaattagaaaaataacattactattagcgatattggttgggtgccactaaaattttgtaaaattaaaaccataccatcgccgtcacattttctatcatcatattgaccaaaatacccttacatgtgggacccaccataagttccaacctagggaggtgacacgtcgtcgtctttcacctcagctcagccattcatctcggggggccggatgcccgcctcgatatcgagcgccggcgcgacgctcgtcacgccgcccacgcaacggagggcgcttcctcgtccggagcgccacttcggtccgggcacgggagccggccccccgtgtccccggttggcggtgccggctgtcgagcctttgtggcgagccttcggaacgtccgttggcccccaaggttccggcccaccatcaccgaaaaatatgacggaagcgtcaatcccgccgagtttctccagatctacacgaccgggatcgaggccgccgggggtgacgacagggtcatggcgaattttttccccattgccctgaaaggtcaggcgcggggttggctaatgaacttgccacccccgtcggtccactcttgggaggatttgtgccagcagttcaacacgaactttcagggcacatattcgcgccaggcg

SEQ ID NO: 118 - DNA, 4553 bp, Oryza sativa
  unsure (1)..(4553): unsure at all n locations
nattgcgacccgttgggttttcgcccgcctgtggggaccggcccccctgtcacgggcctaagagtggcatcacgcccgagcgcctccctcgggggggtggtcgccctagcgtaacgctgggggctactgtcggtgacatggggccgggggtatcgtgactagaggcttgggtagccgtggtcacctacgtggcctgaccccctcggggggggggggtcgggcccgacagtgatgtggccacccctccctctgtctccccgaggggtcggcccgctcccatttcggccccgagggctggggcgccccgaccccctgtggttttggcgccacgtgtgtgggttaggtgagcacaccgggctcacctaaccgcatttatagcaggttgacgagcgcgccacgccgcatttactgcggcgcagcgcacgcttatccggaccgtgaccagtcgcggtgtgtgaccggtcacagaccggtaagatcgcgggttaggtggcaacaggcggcctgtcacacgcctcgccccatcccgtcagaatgatgagagcttcctggctctcgtccctagctggagccggcgtgctaactcctggagttggtatgtcagtcccggtcagatccattccaggcttcagcgcaaggatggcaaggaagtcgctggccattaaatgaaggttgaagtgggcgtccccgggaaaagcgggcgagcggggcagaaggcgtgtgctccgcttgtcatatgtcctttccggctgtagactagccctcattgtaaaagtgtgtttcctttcttaggtagcgggaggcccatgtggtgacccctgaccagataaaaaggaggcccaggcctgagagagaaaggaggagaaaaagaaaaagaggagaagaggggggcgaacggggctagagcctgaacgctctctcgctctccggctctggatattccttcactcacagatccaccagaacacaggagtagggtgttacgcttcttagcggcccgaacctgtctacgtcgcccgtgtcttgcgcatttcttctctcgctgacgttcctcagatcgagggcgaagaacctcacttagcgcccccggccgaaccggcaaaggggggcctgcgcggtctcccggtgaggagccccacgctccgtcaccctggatcagtagttggtatacacatacatagttggatcacaacatatcacgaatgaattcaggctaaaagagttaaatacttacattagggctaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtacccagcaagccaccacaacaacaatgcatatgatagagggtttttcaaggaatggcttcaggttcttttgcataaagctagttttgtaattcttttcacaagcctaagacctagcatagactgatcaaattttaataccagttttcacattaaacaacgacggttctgtccaccatccattatgatcccaaggatagctttccgccattgaatcgtcatggttttctgaggacttccactttcccgcctctcaggaagtggctccaacagcataaaatcatcatgcaatatcccatcccacacaagttaaagaatttagagtctagccaagtgtaatacatgtcccggtgctcaataaccgcgagcacggctattcgaatagatttggtttactcacactgcagtggatatacactttacccgcactccgcgactgcccaacacatgagcctcgtcccaacacatgagacgcgtcacggcaaagcttttcgataacctcgcattggcagtatccgctccatggacttaaatcctcatgcactctaggcgtccatgtttctagtagtgtgaggagttttggcgctcccgggaaagagaagtctcacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgcccaagtcgaaaacaattgtttaattttatttctcctttcacaaattatgtcatcaacatcatggcaatgtggcgctcatgtctccacatgccgcatctcaattaccttcccaaaagtaattgcccaagcatcatttgataaatatgagtatgcatgattctagaatagcatttctaagcaattgtcataattgactagggactcatacgtaaacatggttacgaaggaataaggggcaaacaataatcaaggcatggcataatcacaagtaggatgttcatcattgcatgcaattttatttgtaaacaaaacaatttcacaattgggatcaacatgttcaaggaatagtgatgacttgcctgctcaggatagtccttattctcgatataatctcgatcaaccttcacctcctggaagttgcagacattgcctcacgactaaccgatacacaaagtctatgatacgcgagaaaaaccaatattcaaacaacaatcaaatatgcacaacaaaatgtacttgttagggtcgtacctagggttgctcatactattattgcttgctaggggattccaatcatgctaagggctaaagtttcttaatctttctgttgtcacggtggtttatttggagctagccatcgtagtataaatgagatacacatcttgctaatatggggtttagtctagctagtggttatggaaggattatggctatatatgcatctatctaaatagaacggttatatactagaggttcttttgtcggatggatttaggatcaatcaaataattacagtgaatcatttgtattattatgaacatattttatttgtcacaataaattatgaaaggttaataattatccatgctctatatgttacacttgtgaggctaataatattacagattatcccatcacataattttacaatgaataatcctaatttacaattgaacttagatcatattagatcaaggtctataattagtatttatccaccatacatgttgatcatatattctcttaaattttaatacatgcaatcaagcaatttaatactacagcgtatagctataatgggttgtacagtatatgtgtatgtgtgcaacaacgtataaggttttggtcgcctactgtacatgagcttatttagaaaatgtactacccaatgctccaagtgattcctgaatatattgtagtttaattatacattagctagtttctatgagtgatattgtatatgtgatgtgacaagtttaagcactggttctattgggttactaataagtggtaatcaatttaggcatatatatgctattctatatggtattgcatcgattaatttacttagtgattcctccacatctagctctgttattattctcctaaacaggttaaagattcatctatgtgtgtttatattttagttacataatcataaggctatacttgatttaaataacctataagccatggatttaattatatggccatcgaatattaaataagtactagtattttcctatacatccattcatttgagacatcacataaaattagtttgtgtggttgttacagtggcaagacatgttagagacaaatattattacatccactctactgtacaatactaattttatttattagcatatttttaagttgactattatgcatcatcttgatattaattatttaatatttataaatatattttatcaaatagtgaattatatatcattggaaagcttatgaatttaggttcaagtttcactcaaatcggagctgaaatgaataagttatgctagtgtaaagattcaaatttgaattaattctaataattgcgaaatggtactgttcctaattcatttatttataatacaaccttatccacaagctatagtgactgacaggtggggtcaaagtcttgattttcttttctacagaattagttttctaagggaaattggatggaattaatgacaggtggggccactctaacctctctcctccattctcttttctctctcttttctctgttttctcctctatttctctcacggcctcggatagaacaggcgggcggcacggcgcgatggcaagcggnnnnnnnnnnnnnnnnnnnnnnnnnnnnnnnnnnnntttncganngnnttgtgcagctgncgatctcatccgcn

SEQ ID NO: 119 - DNA, 11210 bp, Oryza sativa
  unsure (1)..(11210): unsure at all n locations
gccgtgaattgaagatcgnnnnnnnnnnnnnnnnnnnnnnnnnnnnnnnnnnnnnnnnnnnnnnnnnnnnnnnnnnnnnatcgtgctgcagcctcccagttacctccaggcacaggccattcttggtgagtctcttgctctgtcgagctctgtcagtttttggcttcactggccctgtttcgatgaacacgggctgctctctgattgtggggttggcttgtatgcggtggatctgatccttctcttcaggtggtcccaagatccggtgctcggattccaactggcgacgcgacgggcgacgcgacggcggcgacgggagtggcgcggggctcggcgcggcgcagccgacggtgacaggcgatcatgacgatgtgacggcgatgacgacggcgcgcggcgcggtaatgatggcgacgtgacggcgacggcgacggcgcacggggcgcgaggcggcgcgacggcgcgcggcggcagcggcggagcgaggcgacggcgactgcgacggcggcgcggggcgcgaggcggcgcgcaccagtgggcggcagcggcgcggcgcggcgcgtgcatgggcacggggcgcgagggggaacgcggcagtggagggggggaagggctagggaactacatcaaacacctaggccataatgaacagtgactttttcctaattatccacttttgaggcctatttcctattaaaacttgtcccataatttctagatttcacacaattagagttttacccaatatatgttttattttagatgaaagttgaccaaaatttaatattacccatattttatatattttcctattgtattatttaaatgaggtttaaatctaaaattaacctagataattttggaggctttgagggttctaaaattaatttaaaatatcctaatgtggccattattattacaatagcacattgaatgaacttatttgtataacaatgcattttacgtgggtctactcattctataaatataaattgagacttagtacaacattaatctaattgtttaattaaacactcacatattcttatttatgtataaagcctaatttatttatatgaccattattttatatgagtgattttcatgctatgaggagcttgataaggtgtttcaaatattaattatatattctagtgagatactctattatagatggggccattgatgtgatcatcatttcatgtgtacttatatttcatgtgagattggattcaagtgaattatattcaactatgttgtttccttttgttaaatatgaaatcaggctatcaacatggtttgattatttaatatttgatttgtgatttataccacagggtttaataattgacttgtactttatttggcctggctttcatgtgcataaatatttatgggattgataataaatatcgtatcgttgtaaatcgtaactattgctcgggtgtaaatctttagattgatttttttccattgcgtcgatttatggtttggcaagcaataacaaccataactttcagcatgatgcaaaaagttttaaaaagttcgaaattttagtgatttttaatgtcaggaattttcaggatgttacaaggtgtctaccgtcgtcggtcgagatgcatttgagaagtaccccgtttggcgctttcttgtatagatcgttgccgaccatacagtagatctttgctttacgggttattttctcggcctctgtatcgtcctcgggcaactcctcgctgctgatgaatttgattagtggggtgcgccagtcgtctgtggtttcgatgtcggcaacggcgcgttctgcctcggtgacctccgagctaatgtcgggggtgttcgggctgacttcgccgctaacctctttcactgatggctttgtcaggatatcgagaaaagtgccgggctcgagcgattctcatctggacgcatgtcgtgctatgtcgtctggctcgatgttgtcctttcggtagacgtgtcggaccttgatcccatcgaactttttctctagcttcctgacttctgcgagatacttggataactcggagttagagcatttataatctttgtgtacctggttcgcgactagttcggagtcccctttgacaattagtcgcttggccccaagtgtagctgcaactcatatcccggcgagtagtccttcgtattctgcagtgttattggtcgccctgaagttgaggtggattacgtgattgaattgatctccggagggagacgtcaagataaatcctgccccggctccttggctgttgagtgtgccatcgaacgccattgtccatgttgcattgtcgccttggttgtctgatttgttatctggcatagtccaatcggcaacgaagtcggcgagtacctgggacttgatggctgttcgtggcacaaagtgggcatcaaactggctcagctcgactacccatttcgcaatgcggccaacaacgtctttgtttctcacaacttcaccaagaggaaaagaggagacaactgtgactctgtgggcttgaaaatagtggcgtagcttccttgatgtcatgatgactgcgtaaagcagcttttggatctgtgggtatcttgtctttgcgtcgtggagagcttcgctgacgtaataaactggtcgctgtactttctctctctcgacaacaatgacagtgctaacggagtgtggcgtggcggcgatatagaggaataattcttcattagtttagggagcaacaagtacaagggggtttgataggtagcgcttgagtgcaatgaatgcctcttcggcttcctgtgtccatacaaatttgtcttgtttcttcaacagagcgaagaaaggttgtcctcgttctcccatcctagcgacgaatctgcttagtgctgccatgcatccggttagcttttgtacctccttgagtcctgtaggcgacttcatgttctcgattgccttgatcttctcggggtttgcttctatccctctgccagagacaaggaatccgagcaacttgcccgacggtactccgaacgtgcacttctcaggattgagcatgaggcgatattgtcggaggttgtcgaatgtttcctgcagatcgtcaatcaatgagtcgtctgtcttggttttgacaacgatgttgttgacgtaagcctcgacattgttgccaagctggttgctaagtgcgccctggaccgtgcgctggaaagtattcccagctgtaatcagtccgaacggcatcttaacatagcaaaataccccgaacggcgtgatgaatgctgtcttctctttgtcctcttttgccatgctgatttggtggtagccagagtaagcgtcgaggaagctcaataactcgcaaccggctgttgaatccaccagttggtctattcgaggaagtggaaagtgatccttggggcacgccttgttgaggtcggtgaagtcgacacacattctccattttccgttggccttccacaccatgactggattggctagccactctagataaagtacttctctgatgaagccagctttgagaagtttgtcgagctcttctcgtatggcttgttttcggtctggtgcaaatctccacagtctttgctttactggcttggcatcgggtcgcaccatgagtttgtgctcaatcacctccctagggacccccggcatgtcggacggctgccaagcgaacacgtcggcattgtcgcggaggaaggtgatgagcgcgagttcctatttctcgtttagtgtcgccccgatcttgacggtcttgtcggggttggcactggagagtggaacaatcttgatggcaccgtctggtttcggcgtcttgtttgtcttggtcactttcttgggtggctcagtcgtggcgggtgggctgggcgtttgctcgaccatgtcgaggctccgcttgtcgcattgcaccgccagctttgcgttcccctgaatagtgattgttcccttcggtcccggcatcttaagcacttgatatgcgtagtgagatgcggccatgaacttcgcaagtgcagttctcccgatgatggcgttgtaagctgtatcgaattcagcaacatcaaaggtgatctgttctgttaggaagttgttggcttggccgaaagtcacgggcaacgtaatcttgcccaaaggtctggacgatgattggggagtaattccatggaagggttgatcagttggtgtcaactcgttttgcgaaattcccatcgcgtccaaagtgctggcaaaaagaagattgattgagctgccaccatcaatgagaactcgcgctaccttgatgttccgaatggtgggttcgaccacgatcggatatcgtctgggataacggcgatcttagggtggtcttcttctgagaactctatcttctgctcagaccacttcatcttgggtgcagccccctgccatgtcgagcagacttcacgttccactttcttgtattctcgcttggacgagtacgttgtggaaccaccgaagatgtgtgagacgtggaggtcggagtctggatacgctgagtccggttcgtgaggaaccgtctcttcgttcgtctcgacaacgcgtactcgcttgcctttttcaaatgccatgtgcttctcgagcgactttttgaaaacaaggcaatcttccagagaatgtctgtccgtcttgtgtatggggcaccatgatttctttgtgtcgctactttgtgggtatgggcgtttgggagggttcgcgtattctgctgcgaggacttctgcttgagctttccttttcccgtttttgtgatttttcttcttgcttgactcagatgtgtccgtggctggtttcttctctcccccggtcttcggcctattgttcttgcgtcttagcacatcatcagcgtgggcgcatcgctcaacgatctcgaataatctccgagtggttctgatgcatcttgtcgccaactcctgggtagtgtagcgatctctgacaccagatttgaaggcgtgaattacagaagcgtcggtgatttcaggaattgtgtttctgcactcgttgaaacgtcgaacatattccctcaatgattcacccgagttctgtgtcaacgcgtgtaggtcgtcttcgatcgcgtggcacttgtatgttccttggaaattggcgatgaattgttgccacaggtctgcccacgaagagattgagtagggaggaagatgcatcaccatgaacgtgcagaacccttcaacgcggttggtaaatagttcgctaacgcgttgtcgtctgctctggcatcatagagtactgtggagtagacttgaaggaactcctcttggtcgatgctcccatcatacttttttattgctccgggtcagaatctctcaggccatcggacatcacgtagggaacgcccgaaagccctacacccagcgttgggggcggtgggttgccggcggtcgtgtgtccttcgtggatgtttgtctgacgatgaggaggacgtggatgatgacgatgacgatgggtcgcttggttccggcgtacgattacgaggatgacggcctggatctcgggaatcttgtcgtcgtcttccgctgttgtctcggcgccgatctccatcgtcgtcgtcgatacggcggcggccatgaccagtattgtctggcacccgttgttcacgatcgttgtgatcgtggtggttgtcgtggtcccggtcctcgtttgagcgatctcctcgatttccgttatcatggcgccgtgaagagacatgacgccgagagcgattcacgttgtctcatgtgcgtcgtgcttcccggcggccgttgatttgatctcgaagatcgccagtgccgtgaggtggaggggtagcttgttgaggtgattccctccgttctgaatcttcaccactggcctcgccagttggtggctgctcctggtgtgctgcggtagcggcttcttcaaacgcgttgctgaggttagtcaccaattcccatagtcgttctgtccaacgctcgaggtcaacgttcagaacgggatcataaggagtttccctcagtatcgcttgaacggccctgatgtgctaggctggagtagtcgattgattccccgcttctgtgttggcgtgcgctgacgtaccaacgtcatcgatagccaatacctcccgcggcgcgctcgttgtcgataacccatagtcctcgaggagatgtaagaccgatggttcgtgaggatcgatatcgattaccccaacgaatcgatctgaagttggagtcgctccttgttccttgccgttatcccttatggggatatatgacttaggagactgagctttcatggcgccgagaaagactttgtagctcgagaggtcgtgattctttgtcttgtgaataggacaatagacatcccgagttggagaagtacgctgaattccacgttctttgcaggcgcgaatttcagcacgaacgttgaggaaaacccagcaatcttgcagggtgtgtttcttggttttgtggataggacaccaagaccttgtggcttcggaagtcatctttgtcggctcgtggttcatgtcggaaggacaaggtttggccgtatcagaatccttcttgagcttggatgtcgtcgatattccgttctccgtctcgatgggaggatttttcgacatggaatcgccttggttcgtaaccactgcgttctcgtctccggtcattggagaaccggttgagatcggcgtcgtggtgtaaaccgggaagacgatttcaccgacttgagtccatatcagcattgttgaagcagggagtacttggttgaggctggtgctgacgttgttgtcgacgaagctggatgacatagtagtagaaccttgagtaccaagatcccctacctggcgcgccactgtcgatgggtgatatccgtagaccggatatagagggtattagggtacgttagtacaaggatctacgtagtacgacatcaagcaaacaaaagacaagaattatactggttcaggcctcttgataggtaatagccctaatccagttgatgtgggattatatggtagaaaacatagattacaaagagaacaagggaacttgtcggatccggcgagattgtagtcgagttgattcgactagctctcgatgacttggctcctcgtaagctccggcttcgtaggctgtggaggttatgttggctctgagattcgatgcctaaaccctccccgggaggccccttttatatcgcagatgtggatgtctcctcgtagaactcggaggtatcagaccctatacgatacgccaacgacccggttttgcccgagtaggattcttcccatatgtagattccgtgaaaagtttccttagaatatacaggaaatatccgcatgcgcgtgggtatgccatatcaatatgtaacgtatatcgaagggtaaagagtatgcctaacccgtaatcctgacagatttattttccagcagaggaaaaaaccataatagagaaaaaaaaatgttggcaattgctgctggtacagtagacgaggtgggtggcgatgcaataatttccacgttttcgagctagtgatgcacaaatgcatcaatttatccaacacatatcattaagttattgcatactttaattaagtactctctccgtttcaatatttgacaccgttgactttttagcacatgtttgaccgttcgtcttgttcaaaaaaaattatgaaatatgtaaaattatatgcctacataaaaatatatttaacaatgaatcaaatgataggaaaacaattaataattacttaaattttttgaataagacgaacggtcaaacatatgctaaaaagtcaatggcgtcaaacattttgaaacggagggagtaccatataatatatgttgctgcttcaaatcgtgactttggcacgaaaaggtattttttgtgtgttttctttgaatctgatcacacaaagaaaaagggttgcttaattacatatgtgtggatatgcatatgatccacatgaaagatcgaattaattaagcaccaaatttattgcaagccaccaagaacagcctgttaaagagaggaatacgtatgagtgtcacatgtacgtgactgaagtatatattttccttgttttcgtacgtcacagttataaaacagctacagtgatgtataattattccaggcttccagcagctaagctagatggccgtatatccgtatagcatctagtagaaattaatttaaattaggagtactaataaggaagaaagtactcttgtcatgtacatatgtctatttgatcctaaacataagagcaattttacggtacttaaggaggtaccatgaggtaccacttttcttattgtaaatttggtacctcttattgtaaatttggtacctcttagtatctaggtactatgaggtaccatgaggtactcaaaattagtgtaaaatttggtacctcatggtatctcctcaatgtcacgccccgaactagtcccgaccggaactagcccgtgacgctccaaattaacctgctaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggggatcatttatatagagcaagggtgagtacggaagtactcagcaaagccagggaaataagtgtttaatgcaggcttcaaggagaggctgttgttttcgcaatttattttatttgaactcttttctaaaaagtctaagtgagtgcttctcaaacgacacggatgagacagtgcgcctcgtccggtcggagtatgtgcaatgtatcagtctttagatcttgaaacagggttggcacccggccaacagcttttcaaacggccacccgggcctagctgatcccgtcagctgctgatttttttttcaaatatcgaacccagattcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccagatcacccagcccgtggggatcagccacgtcgggagacctccaagctttcacgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaatcggtccttaagtgcgagagcgggaaaccgtacacccggtacgttccccggtccgcggttttggaaattcgtttagttcgcaagcaccgacccaggtgtcgggttttccaagtcttttgtaaaactccagttttacccaagctgttactcagattataagtttgaaggcgtccgtcgatactcgcacaggatgcacgaatatcaggacgcaactaggtggttacaaggggacatgttgtaacaattaacaaggaaaggatcaaatgcaacaatttaggtaggtctgccaatctgccttgcagacgggacaacagatttagtgtgatcctatcaatgcatagtatttcgcaagcaatataattaaatttcaaatataggctcgagatgttcaagggtggcttgccttgctcgagatctggagcttgatcctcgaaatcctcgcactgcaggtcctcgggctccggaactacacgcgaaacggaacaactcaacaaacggtgaaaataaagccctattaatgacctctaagcatgccattagatagatctcgagatttgaggaattttggaagttgaacggagtcaaacggacttacggttgggaagatattgaatttctaagattattggatttttggtctaacggaaaaaggatttaattaaatcctttttggaaaagaaaaagaaaagaaaggagggagggaatatagacttttctcgggtggctagggtgcggcccaagagatttggggcggctcggccgatcttaacgggccggccggcccaagaaggcggcccaagacggtcgcgcgcgcgggagggaggagagagagggagccggtggaccgggctcaccacgcgcggtcctgggtgggacccgcttgtcagcggctcggctcaccgtgcggagggagtatgcggcgtacgcgcgcgggcagggctgggacgcggtgcacgcgcgtggttcgcggaggaacggatgcgcggggcccacgcgcagcctcacggctcaccgcgggaccacacgcacggggagaaacgtagggagcggctggccgggtcggcttatccggtcgcggccgaggtggcgccgaggtggcgcctacgtggcagcctcacgggccggcgggaggtagacgacgacccggccgcgaatggacggcggtgcgacagcggcgagcggcggagcgtgccacggcgataccggcgaaagcgcgcacaccgggcggttgcatgtgacaaggggagacgagcaaacggctcggattcgccggaggtagctcgacggcggcggattgcggcggcggcaaccagcggcgggagaagagggaaacggcgacgaggtcacgagaggtcgattcccggcggtgagagcatctacgcgaccacgggaatccgatgctagcgtcggattggacggagctacgccgagcgaggctggcgacgagcgggtgctacggagctcgggcggcgacggcggcgagcacatggcgaacgacggcaacggtcggggcggcgccggctagctacggggagtctactcgagctactaccgaaagctagggggaggagatggagcgaggaggaagaacggaaagagnnnnnnnnnnnnnnnnnnnnnnnnnnnnnnnnnnnnnnnnnnnnnnnnnngtggntgtctcatngtcctaccnggggacagc

SEQ ID NO: 120 - DNA, 2865 bp, Oryza sativa
  unsure (1)..(2865): unsure at all n locations
ctcggcacgctcgcgcggaaaacaacgggcggaaaggatggccatggggaccggacaacgcggacggcgcaacaacacggctcggacgggaaaccacgcggcgcgcgcgagcaacggcgcgcggggccggctttgcgagcggggggggctcgcgcgagagaagggggcgctcggcgcgggcgactcccgcgcacgcgcgcgcggcgcgcggcggaaccggaggggagcggaaagagaggcgctcggcgcggctctcacacgcgcgagcagcgagggggggaaaacgcgccgggggggcaatcgagagagagagagagagagagagagagagagagagggagacgcccgggagagagagggccggggaagagatcatgagatggcacgggcactagacaacaatcaaagaaacaactttcgcaattagggtttttaggagataattttcccgctaggcgccacgacggaacgggcgctacactcaaggaccgtaaaattgttttaaacgtaacactagacaacaatcaaagaaacaactttcgcaattagggtttttaggagataattttcccgctaggcgccacgacggaacgggcgctacactcaaggaccgtaaaattgttttaaacgtaattaaactggatcgaaagccaccatggaatataattcagggggaaaagaggcattttcaaagtttttatatggattatcctagaaccgagttgatggttcattcatcacaggacttcagttagcgtgaattttaggttggactctattttatttccaacgcttcaaattggaaccttttctaacatgttgtgttttgctttggatctttttcataatatttcctttattttccaggtaaaaacgagagcttaaatgtagtggtggagacatgtgtccatggagaatatcgtgagtaaaagggttgaatgtaaaactaaaagttaaaaaagagaggattaaagtgaaaattaattatcagtgtactaaatataggatttgtacccgtgtacgcgcgcgcatatacctcagtaagaatactacctacatacctattattggacaagaaacaaattcccaaatctaagataaactcgtggacatgaaatgtgatctcagaaagaggataaagctcatagtctgacataagaatgactaggactgctcgaattgtgtcttagcttttgcctttcgagttctgcttggataaggaggtgtccaggcaagtgatataaacacaaggcattgaaagggaggacattctaatctctatagataacacaatacatatataaatacaatgtattgctgaaggggcctctacttgttctttgcctccactagattttgcattggcaagtgaaggtattggaggcagaaagttgctacatcgagatcaattggatctggtcgacaaaaggaggaatgtgacaaaggaactagttagaggtggaaggaacacatatgagaagtgtaggttgccattataccttcaaaattttcttaatggagagattgaatgtgatccacgtcttcatccaagcagcggatacgtcttgaaattagttgccagcccttaggcaccaccaaagtacagcatggtttcctttgtaaggaggtcttgctgctcgggggaggcaaagataactaagtcattggcatatattaacctttatatgtaagtattaaatttgtgcaacaaaaacaactacttcctccatccaaaaaaaactggatgttgtaacatcctaacaattttccagaaaaaaaaggtcattttagcaatatgtaattaaagaaatggggtcagtctatttctatcgactcattccagaccactcgtgatttgctttgccctatgtaatgtttgtgtccatggcgccaatgtgtattgtaactcctgtggcacgtggcaataagttatggaaggcttaattaattacaatcaggaaatattctctcgaaccttccactacgccagaaccctacatctgtgacggtacaccagtgacgggtttataaattggtcacagatgaccgtcacctttgacgggtcgttaggtttaccatcatcggtgaggcatctggcctcggcccgtcacaggtatcacctcacctgtgacgggccagaattttaagccgtcacaggtaagatagtgacgagtttgacttccaacccgtcactggtatgacctcatttctgacgggccagggagttataacccgtcacaggtgatgggccgtcacttgtgacggatatgacttctggcccatcactgattttaagtttgcacccatcaaaggtgatcaattttgacatataaaaaaggaacccccaccccccacccatggggccccaccgacacctgctcagtctctctccttctcctctcagactctcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 121 - DNA, 32421 bp, Oryza sativa
  unsure (1)..(32421): unsure at all n locations
ngccgacggnaagttgggcangncaanncnncgagnnnttggaaaaagctatcgatttcgaaccctacttattagtgctaagcagaagtcaccctttccttctcttgtatccagatctgagcttgcagtcaaccgattccggcgtctcctgtggttcctgtggctaaatccttgtccaaggatgcatctagctttaaccccatcaaaaatcatgagctattggatcattagttagatgctctttgtgtactagtattttgtttggatagtgggcatgcatgttgtttcgctttgttttcttgttctatttaagttgatgcatcagtaaatctgtttttattttccttgttagacctcttaccagaagttttttttggtgtgttcttggatactctacaaatcccccaatttctatgctagctgaacaaattagatgctagttctttctacaaatggtgagcttcctttgccagttgatctatttccgtttctttcagataatatttaactactgacatgcatatggatgactatcaaggatggttgaaaggctagctaatgaatactaatctgaggtaaacttatttttgccttctcagacagagtgaccccattttaatttgttgttttggagcaacttatgctgattatctggctgttaggctattcttgcatagttatatgcatttgtaacatatcgaagctgttcctgctactgtcatcccatctgtaacatatatctggttgttaggctgttaggatattgttgcattaaacttctctgaatgatgtcattgcaggcactgggggctgtacttatgctgatctaattgtaagtttgtatgtcataccatattcgtcaggctcagaaaccaaagatggaaatgctatgttcaagtttgtggcacttaggctatatttctcatttttcagtatgttggcatcgaagtatgttctcttttttctggatttatttctggtgctttgaagcatcggcttggctcaatttgagaacttgcaatgcatgtgtgtgaatgtctatggattttcggtgacaacttggaatgcatgtgatgttagtttgaaacttttaatgcaatgggctgaaactggagacatatatattgcatgtgtatgttctgtttttccagaggcatggctagcaaatcctaggggaaattattatttttctggatgtaagctcaccactgacggttcatattgcaaaagccgtcacaggtgaccataccagtgacggctttgcacatacatgtcgtcacaagtgacacacctgtgacgttttttactctctgagccgtcacaggtgagtcatctgtgacgggttgcaaaatggcatgggttagcgcagacacttatctctgacgggccgtagagttctagcccgtcagaggtgactgtcatcagtgacggtcttccacccgtcaaaggtgaccgaactcaccagtgaccactgatcactgaccaagcctaaagccgtcaaaggtgagggtttgggcccgtcactggtgaccttgtccagtgtagtgttctgaattgcatgtactcttatcgaaatgataattgaatcaaataaataggctgagaaatcttaaaacatcgaggtttttttagagagaggaactatatttttttcaaatataaatgctacatattcataattttgtcccatttcaccaatcatatgcaaattcggttgggttgtgtccatattgaaatgataactgaatcaaataaataggctgagaaatcttaaaacatcgagtttttatttgagagagaggaactatatttttttcaaatataaatgctgcatattcctaattttgtccccatttcaccaaccatatgcaaattcggttgggttgtgtccgtatcggcgagagtgaaagattaattaaccaagaggatcaaatggtcattgtcaaatatatcctcccaagtaattaatcctctcacaatccaatcgatcaaagtggacaaggaagttattttggtttgaaaactgtctataccaattagcaaactgtttctcttaagagttaaagtggatcgttttcacgtttactagctacttcctatgtcctaaaatataacaatttttaacactaaaaatttgtcctaaaatataacaaattttgtacctacattcctttttaactaatcacaaccttccaccattcaaattcttcacctactttcccttcttaaccaatcacatttttttcctatttaattccacatgttttcttaatacctgttcttaagcctaaaacacctcatgtattgggacaaaggtagtatttgttaactcagaacatatcctatacatacaagtttcgcgagtacactcaccctgtacatcaactaataaacatcatcaaaaatccagaaaaattatacgagtatttctaatagtattatacttgtatatatatgaactctcaactccaaaattattatattttagccataattaaaaaaacaaaaatctgatagctttaatagtataaatttgtcaatcttttgtttatttctgctctatatatatgatgaattttaggttgagattttatgcgtatgtataatactatagaagtatatgtatgacttctgttaaaaaaattatgataacgttttgtttgtgtgcttgacagtatactccaatcttaacgttatcttgcgtgctgcagtgggaactacaaatcagatatactgagaaaggaaggatgagggaaaaaatacatgtatgttttgtactcgtttcgtcccaaaaaattaaatcctagctatgaaactggatatgcaattgtccagtatatagctaggatttgcttttttttagacggaaggtgtatctgggaggtgccaaatataatagaccaaataatttggcattaattaggcatgcttgactaaaaaaatactaggatattagggaagcccctactaaccatgtttagtaatgtatatgcggttggagaaactccatataaaagagagatcaagtccatggagagtgccatttatatactagattgccagggcatttataacaaatactgatccagcaatacggtgcggtcttcatctgcacagcaaggcgcgtagtagttgatttttagtggaataaatttaaagcttacaatcaagtggttctcgaccaatatagctagctccatatcacttcaagtggcagatttagctcaaattttaattatatagaaatctagatttctcatatccaaaaaatatatacactaatatgtaaaaaataaaataacttcacaaaaaattagaagagaaaagggtgaaatcgaaactcaccccagtgaagcaactctcaactggccaatggttctagaaactgggataatcaatgataagtaaacagctttaacaatttatggggttagcaatggcccattgccacacctggacacgtggtaagagcatgagcagataccgacgcaaagagtataagagtttaatagtagagtccactactagctccaattaatctatagccgatctaatagccaatttatacaatagttgtttactatactgttaatatatggtccacttgtcatacacacattgtgtcttgaagttcatgctacagctagctacagatctgtagcccgctgctcttctctctcatcttttatctcattaaaatatgtttatagctagctaatagtctgctattgtaccttctctaatgtgtggtataagagcaagtataatagcagactataagccagctataaacacatatcgaggagactaaagaagagaaaaatgagcagcgagctatagatttgtagccagctgcagcatgaactccaatacgtaatgtgtgtatgataggtgggaccagatattagtaatgtagtatatatttataggtaactattgtatgaattgactattaaatcgactatagattatttggagctagtagttagttatactattaaatttgctctaactccgtatgcaagttttccagagctggatattctaactccataaacctatggatttagatatgtaactatctatgttaatgatatttgaatgaatcttttttaaatcattttaaattttaaatcactctaatttagcacacaaactcaatccagcatgtatatatgagatctagagtaagacttagcagggcttacttataagtctacttatttacaacccaatgtggacatcatctacagtactggcaaagtggcaagaggcaacattaatttgtttggattaatttccgcgtgttgtcttcttaaggaaaaagattatgcaaataatcgaaatcaaccgtaccttttataaccttactgcttcatcatactccttctcaacaggatacctatatgtctagttgtctactttggactaaagcatatgttactcttgtgctagagtacctgacaataaaggtcgatactaggagggaggccatactatggacgcactataacgaaacctattacatcatggtcgatcggtgataaagaacctcctttcctaaaacgaatccatctcgatctagagatgaatctagacacacatgcatgagtcttttaggatagcgggatcggagtaaataggaaagacggcgggaaaatgtcagcatgcagcttgaacggactatcattgttgaaattagagagggcacctaaggtggctacacaaagatgacaatattagcccttcctgtaacgatttcctccttttttaaaaaaaaaaaaccttctcgaagaaattgatgcatattaggctactttgaaaaaaaaaatctcctcatatacatatataaaatctcgcatatatagaccccttccaccacttggcgtttagttgtgtgttttcttttaaaagaatgcctaatattttaaagaaatataatatgaaaaatagaaaagttctaagtgcgtaagaaacccaaacttattagacaataggttgaaactcaaaagaacaatatatgtttattcctcttatattaacacaggttaccattttgaagagtctatgatactctaccatgaaacacttttgaaatttttcataactattttatatattcaaaagatggaagcacatatattccatcgtgtttcaaatttttatacgcgtgaacactgaaaacgaaataacaaaatcaaaaacagataattgtaattaattgtccatgatgaatcgtcatctgtgtgtgctgtatgcacccgttcatcaaaagtgaatttatgtgcgttgcaacaaaaaggatatgatcaatatcgtcccagctgcactgccagcaaaacgaaatggtttttgcaaacgtgtgatttgtcatgttgggcttgacgtgtccaaaatagtagaagtacgcagaaagcgccagcgtcacttgagtttctgtactcaacactcaacaggtttttgctagccgacatgagatgatggggcaccgtttaataggtttttcccgatgagaaggctatgaatctaaaggacgaaccactgtatgtgttgtctcttgtgtgcatgtatcaatttaggttaattttattatctttaaaagataccccaagttactacatttgtaataaggtggaaaacttggagataaaatttagttatctcgagatatattttgtcaagcattgcaattttttttatgatttactacataactacttatatccttttaacacgtatgttaatgtttctttctaatgctcataatatagtatcataggattatataagacatcacctgatacaatgtatctggataaagggcatattcagataaattgtactgggtgatgtcatatccaatcttaagttattactccctccatcaacttttgatagtcatatttcatcttgacacacagaccaacgataagtgattctacctatcatccatttaaatatgctactagtcatttctcgtaaacaagtgattcattaatatttatatttctcgatgcccatgtaaccaatcttatgtagaagaatggagagtcgcgcattaaatccaagaaagctattaagatgataagttgttggattgaaatatgcctatcaaaaataatttttttagatttggaaatatgactatcaaaagtagatgaagggagtatattataggacgaagggagtactacttttgcacctaaagattaataggctgtgttcgttggtgggtgttgggaacccatctcccacgcacggataattagtggtcaattagagcatgattaattaagtattactagttatttttttcaaaaatgaaacaatatgattttttaagtaactttcgtatataaaactttttataaagtacacactatttaacagtttgggaagcgtgcgtgtgaaaaacgagacggagagagttgggaaccaactgcaacgaacgcagcctaaatggctctccgtcatccccattacccttcaccaaacctatctcacagtcaccactgttacacgtcagttacccaaagatttttcatcctaatgttcggtttgtgaaacatattatgccatggcatattgcaccttttagcaatcattttcatcaataaatatatttattgactttttggtcagcctttcgaaaaatgagaccatctttatcacctttgtttaagcaatgcagccgcaaaattcaactaatgaaaaataagattttaaggaattgataattctatatagattttatagaaaagttagcaataattcaaatcttatgaaaaaattctttaatttgagtctatctctcatccaattcatgtatttttttttctacgatctcaaattattatttctgtatttttcctataacttacatttctctattttgcacttgctttttaatcacgtgtaaaaaagcccttggttgttcgttcaacgtatatacagttatacacacatgtatgtactctaaataaataaggcataccatgttcgtcctattaaagctatgcttggctctactttcagatcataatcaaaagtttgtttttttcaagaataattttattttacttgtgttcttagccatcataaaaagaaagcaattagccatgcatgcagtaaaggaaaacccctaaaatcaaatcaggcaaattaacaattcaactttagcttcatatatattaattataatccaaagtagagacgagattcgtcggcaactcggcgtcggcgcgtgtgggacagtgggacgttgcaatcgcaaggccgctctcccggtagactggtgtgcgtcatggagtcaattggtgaatgctctagttaatttactcctgattacagcagtccacgtcctaattaatctctacatgctacatccatcacccctaggctgagtttggatgttgataagctctcattttctgtaaacacgcttttaattggtgtttttttttttacaaatattttttatatattttttaacatctaattattttttaaaaaaattataattaatactaaattaatcatacacacataacttgtctttttttttcgtgacaccaaaaatctaacacaaattttactttcaaattcagccttactgattgctcacttttaaactcagccttgctcattgctgttcttaatagccttcccttttaatgttgttcgacctaccatctatatgccaaaaaaaaagggaagaaagcagttgtgtcaatccggtgaatatgtaaattgaaatgaaaaccatccattctcacatgaaatgaacaaaaaaatatgtaaaaaaaatccatccaaacctatgaaaatctgacgttgagaacgggacaagaaactacctatatgtaccgagatgatgggagctaaccaaaaaggccattgagatcacgaagcagccctgcatttgttacagttggtgggacttagcagggaatagaggacactgacgtagcaattcagttaccgtggactcccttccatcccaaaaaaatatcttagtacaattaatctgttaattttagtataatcaatctggtaagggttatatcctcttttaggttaagcttttttaaacaggacgagtcacatttatttctaggttaagttttttttaagagcaggaggggtcgtagcaacaaaggcccccaaaacagcgcgttgttatccacgtccacgagaaagcataggacaaagggtatttaagactgttgctatttgtgatacggagcggattgcgagtggatattgttctgtatccagagctagacttttcagagaaacgctgcttaccaaactaaacctttgtcacggctatacgtgtggcgaaagccggaatttggcccccatgacctcccttttccattcggtttggaatgatacaaccaacaaaaggaaaagttgcaaggcgggcactcatagctcacgttacaattccagcaaccccacagaattttggagtgcaaattacaacaatggaatttcttaagccccttttgatttagattattaagtggattgttgtcgtggattatctacctgattaaagggataaactatattttctaaaataaagttaacagatagtttaaaataagtggtccaaacagtgcagcagaaaaaaaggatttcgagaaaacgtatttttcgaagcgtgagttcaataatcccgtggatgagctaaaaagaacagagatcatacggcttaggttagtttgggtattgacagtggaggtcttagagtaccacgggctgcggccagctcctttggaacgcatgattcttaaaacaggaattacaagaaaaaatgtagaattaaagtgcccttacacctcaaatcccatggattgaaaaaaaaaagacataaaaactatatgaatgacgtgagaaaaatgctagaaccagaaaagagatattcacaaagggtttttattccaagaggttgaagcttatgttattcctccaaaatttctatgttttgaggttttgagccaatcgaaaggaattgcccaggatttttgcatagctattccatttatacaaatgaccatataggaaaatttttcaaaggattggattcctcccaaaatcctttgttccaaagcagggttttcaatttcgaaattggattttatgccaggggtgaccgtaatttcgggaatttctggctgaaattatttgaaaatttgactgaatttgaataaaatttgaccaaattcgtaaaaaattacaaaaaaacaaacatttcgggcgagatttgaacatgccggtaggggcgaaattattgaaatttcagaaatttcgaaccgggatttcaaaccctgttccaaagtggttttaaaatgtctgctcctaagggcatcaccaatgtatatgacaaagtgatccatatagatgggacccacataaatagtttttccctatagcaatctcaacagtgtatatagatacaaggtatcaataggagaagagagatgagtagagatagataatataatttattccatatgggtagtccatatgcatatgggtatcttttgttattttttctatatggactagttacacaatggttatagatggcttaatggaatattctattgcttatggactacttttacaccacattgtggatgccctaacatcttcaatttcaatcctcattaaatttcacgctatatgctataaaatctagaaactagcataaaatcactcctctatctccctccccttccactctctgtcgatcccctatcctttgacccctcactctttggcactgccttttccctctcccctctcccatctcccctatcctttgacccctcactctttggcactgccttttccctctcccctctcccatctccaatgacaggtagacctctcccttctcccctgcctactcacccttcttggtgacgcaaacggagacgaggcgagccaacaagctctcggcagcacagaatgaagtggggtgcaccgatgagctcccagtggagtggattaggcgatgaggatgaactcggcagtggcaaatcgaacgaagagctgagcgactgtgagactggacgaagaagtcgacgttagcatctcctcgcaaacttcataggcaaagtcgatatgtcactcgtagttattgcctctccattgtccacctccctccaaattaggcacagcatggggctccgtgcttttcctggtgaggccaccgtaacttgcggaaagcacaagcacacccacaagaccactcactccaccccctttctcctccacggtggtttgtctccgacatggtcaactagagccgctggctagctcaccgtgttgtgaatagccttagggcactcacaatgcaggacatgggtatgagggaccttagagagccacataagtcacaaatctatttatctcatggtgcaaagtggttctaggagtggatttaatttatcatgttagtggctaacttcttcacttctatcctgacattttctaaaggaaattacaaagcagtccaatattttacacggaacactctaaaaattaaaaaaaatcatctccctacattttccccacacccacctgtcacttttcactccactcgcatttttgtctctcccttgctcaccggcgtcgccgcctttaccctcaccttggcaatgcctcaaaccaggcaagcatcgagcagatcaacgcagcgatgagcagaagcatcgaggaggccaaggcaccgtagcaaggaagctactgctgtagacgggtcgaggcggccatcatcgagctggtgttgcggacgggttggggtggcttggagtgggggacgataacaagctcgacaacgcagaacagggaacaacaataaggtcctaggcaccaaatctgccaccgccatcttccttttttcttacctgcatctctccccaagctgtcatcattgtcctgtcgagctcgctagatctagcatcaggctcgtttgctagcaccactgctttagggatgacgaagcaactcagggtagtgccctcgccaacgacaaccatgcaaggagcagcaggacgactgcgccacatcacacgggtctaggggcatcgcatgtgataacaatccggcccaggtggggttgcccgaggcccaataacttaaggttgcccggaccccaacagttcataggcacacccactcggggaaaggcccaatctccctaaaagactagtctgataggggaaagggtggctctcccttttaaggtggcttcctcctcccaagctaagcaaagcaaggtgggattattcagaggctcacatggtcgtcgcccgacttttgcgtctttgcctgcggttaataatggaggatgtcctcatcattcccacccccttaacaagggcccagctctgataccaaaggataacaatccggcccaggtggggtttgccgaggcccaataacttaaggttgcccggaccccaacagttcataggcacacccactcggggaaaggtccaatctccctaaaagactagtccgataggggaaagggtggctctcccttttaaggtggcttcctcctcccaagctaaacaaagcaaggtgggattattcagaggctcacacggtcgccgcccgatttttgcgtctttgccagcgggtaatagtggaggatgtcctcatcagcatagggcaacgccctcttctaatgcaacgtgcgagccatgccctgtcttgttgcgacaaacctaacgaggaacgtgcctcaagggatccgtggatcttcatttggtaacggagaggcagactagaatctccgacgtgagaaatcggggcaaacgccacctaggcatactgcgaaagcccttagagcagctccattgtgtgtttgactactgcagtaccaagatagcgaacacactttgattcgatgacttcagcgtgcgcaccgatttatgggacccgcataaaaaaagtttggaggaaattttaaattatgtgactgaggttggatgggttcaaccccatctgcaacaaatactattttaattatctaagagcgacttatattttgagctcgatttagttcactgacacacaacaatcgactcccgatagttcaatttctccacacaccatagggttgtttagcacagctccagctctagcttcacctctcatagaattaaaattcagccaaacagttttagttccacctaaataacagcggagctgggtgaaacgctctcataaaataaactagttagagtttactcccaaacaagccctataggctatagctgctcttatgaaatccggttctgatcgtttttgtttgtccttttcatgtgcgaggttttaggcagcagctgcagctcagctctacaaccggagctcctgcaatgcaggcactccacgcaaccgcaaccttgaacagttcactagtactagtactggctctgttcgggagggcactctattattgtattctattattgcataattaattaagtatttactatttattttaaaaaatagattaatataattttctaaaataacttttgtatataaactttttgtaaaaacataccgtttagcaatttcaaaaactttcgcgtgaaaaacaagagagaggatggtgggaactgctactgcagaacgcagccagagcggagcagagaaaaggaagcgcgatcgacgccacacgccaacacgtgcatcctatcctaccagtccactcaggcaaatcaaaggcaaccccccatcactccgcatttataaccccacccgatgcaaatgcggtggcgcctctaaccgcgttcttttctccaaaccggctaccttcacccgtgtggagtccaagcgtccaaaactccaaacccccgcgagctgggacacctcacttgccacaccgaacttcgctttccaagcccttcaacgcggcgcccacacggccatcctccggcatccctgaccctgtgccgcgcgccacggctcagacgacgacgacggcgacggcgcccgccctgacgcggccgacagccgacgaggtggtcgacggcgatggccaggccagaccaggctgagccgaatgccgcgttgatggtagctgcggcacggcgcggcaataggatgcgtttgggttcttctctcagttttcccaactcacatctctcatttttcacgcgcacgctttttaaaatgttaaacggtatactttttaaaaaaatttctatacgaaatttattttttaaaaaatcatattaatccattttttaaaaaatattaattaatactttattaattcatgtaataataccgccgtgtctagttccaaaataattcttcaaacttccaactttttcatcacatcaaaactttcctacttccaacttttccatcacatcgttctaatttcaaccaaacttccaattttagtgtgaactaaacacagccgggtgctgttttgcgtgccggggaaggtccaattattgagcggatctgcacgtacagcgccctgtactgtactttaccaacttgttcaggttgtagcagcaggagatagcgcgttttcagccttcaaaagcatggatgatttgattccccaggggataataacagaaacaagaatgcatcgatcggcatatcgctatggtcaaaaaagtagagttttgtttacctgtggagaccaattgtcatggatgtgtgggcttgtacttcctttccatggatgagaggggatcagggaattagaacagagattcgggcaaccgctgcaatcatgtgcgatgaataaatgccaccagatcaaaagggttaggcatcgattcgatcataccggaaccaccataagctgaggagcatgatggtgagctgcaattattgatcagggcaatatgctttgcacacactctctgtatatatggaattgtggttggtttgccaagcttggaaatgtggcacccagacaggaattgatgctgctgcttctgttactacaagctctagtacagtatgagtataggatgttgttgaatttgaccctgccgtagttgtcgtaactgcacattcatctacctgacgagaatgattccttcagaaagctgtagagttcctccgcgactggtgatgggaattcctcctgcggcagaagggcacctggaacctccacgaattttgtcacgcctttggcgcctctgagagcttccatctcagccttcgacctcttcggggcattcacggtcgatgcaaccagaactggagcgtcaccgtccaacttggcaaacagctgaaggaattcttcccttgtttggacagggtcaagaaggcctgtcaagaatgcagccgggacaaaccgtgcacctttccttttggttaactcgtagcgactttccacgatatttggagtcacgttctcagggttggcataaacgtgagacttgtactgggactggatggacttctcgttgctcaccagaacattgtacatcatccagccaatagccggggccctgagggtccctcgtagaagcccatacctgttgataatggttagggaaacaattttcagcatgatcaattttgtatctaaagaaacaaaaggctgagatgtctgtaaaaaggctcaacgggaacatgttatcacataattatctacatcagtcagttttcaaaaatgtaaaaatatatatatacaccattaattgttattttgttacatgtactttactacatctcactgattagttacacaaatatatcattagttaaatgaattgtactaataaacgtaaaaggaatgaaaacgactaatggaaaatcaaatcagtagctttcttaaccaatttggaaaataaagtgccagcagaaacatggcactggcactttctgtatgcaacgacagtataacacacagatatgtatttatcaacatggaaaacgaaatgcctgcataaacatgctagttgctactggcacttcatctatgcaataccataaacatattcaaaccataaatggcatccaagactatattactagtggcttgactgcataaacacaaccatattttctcagttgcaatgcatcataacctcactgcaatacttacttacccatcacccatctaccaaatgtgcctcttgatttaatgagataggtcagtaagtatacacaattcaacggatgacaacatgaaagatggctctattgcaagagcccaaggattactatatagaatacaagacaaaaaatctagaaattactcatctatacacatgagactgcactattacccatttacccttgacagattacaattaccattcacaattcacacatatcacaaaatatatttacatcttatatttgtatttatgaagggataggtaatacatactacaggattacaacctgcaggacgagatcttaaatagtgtgtgtggtatcaacaaggagcatcgaaaatgcaaactgttgctgaaaatgtagtggtgaagataatatttcatattagcatcaagtgttcgggcctcatcatttgccccatggcttataagctgctgctgaaatttaaatttctaaacttgatttcgaaattgattttgatgttttttcaacatagtttctttttcagcattggcttttaagtcgctaaggacacatataaaaaagttttacccataaattaatttttggttgttaataagctgttacagtttataataagctgtaagcaactgatgaggaccttccttttttatagtagtactgatgttgtctttgaaattatcttaccaaaaaaaccactccgcataatgctgagcataaatcaaagagcaaaggtgataggaggacctttcctagcattctctgacaaatatttgtaatatcaaagctatacacttagtctataccttgtctccatatcagaacctcggccaaatacaatgggaaggggtccagcccaagtaggtgcaactgcagcaatgccagatggccttataaggcccttcccagccgcacggactgcaattgttgctgcatgacctcctccaactactaccacttcaccatctgatcatgataaagaattacaatggcaccatcagttgagtaatgatattcaagaaaatgtgttgttacagaagtattaactggaatatttttgtaaaatatgttttctgcactgttttagttgcattgggtaatagtactgctaaccttggctatgagtaatcctgatttctagttgaatcattgactattacagtaacaatatgcagataaagtagtcatctataatataagaaccagaagaaagaaatgtattgttcattacagaatatgcccaagtgaagtagagtgtattgaatcaggtaaaaaatacagtggaaatgcttacagtatcagactatcagtgcgctttaagatgaaaatgttgtatacctgtatttgccacaggactatttggtgaattaattaactgaaccagaaaattctccatcacatcagcattgtagttcagtgatggcctgtctgaataacccagaccaggccaatcaacaattgtagcacggtaacctaattctccttttcgtgccacaatatctttggctaccaccctccattcctccactgtgctaacatcagaaattgtaggaatcataagaatgttcttcacgttctcagcagtctcatgctcatgttcctcatagtaaatgtttattggcttatcctcaaatgtccactgccatttcccagtctagaaacacatgtatgtaatgttatagcttagtgtcacagtcaaacaacaaagaaaagcagaacaaaattttccatacaactacatccaaaacatttcattcaaaatctagtgtttcagtacttgccactgtggtgactgaaatccattctgaacattaacaattgagacaaggacaattgatcatttgccactctaaagagtgctgtttcattaaaaaaaatgccattataaacaatgtaaatcttttttcttttgctgctctaacaatggaattattcatatttgcccctatgggcaatttaacccctctccccctctgtaataattggttgtagctctcttgagtaaaggccgggatgttatattccattatctaaaaaaaaaaccctctccccctctcatccttcttcctagtcttgccatgcccactggtgaggcgctctaccacaggcaaacaaaaatatagaaaaaggcataccactagaacttctgatctcttgccatatctattcttctatgctcccaaaagaacacaaaaataatatatccacccattatttgaccgaacccccacaagcattcttgtatgatctggcagttgagagtcacctttcttgaaattgtgaatttctcacccttcaacaatcaaaaccattcatgactagcttccttccaatggcattcatatcattggttttagggttaaaaaaatggcatcaattataaacaggagtaacatggacccaacagagcaggaggcatcatgtttataaggtagggcccaagataaaagcatgcaaatgacaggaagaaaataaaacctgcatatctcaaaaatgtaaggctgggtcccatttttgtaaatctaccaggtgatggatcattaacctatcttcttttaggaaaaaattttcaaaagatatcccaggaaggaaatgaagagaacagggtgataaattccccttgcctctgtccctccatatggttgaatcgcattcctcgttttaaccataggagcaatttgccaacaattccctctcatggagaactggagatcatgcacactatgcaatcagccaagcgcatgcatgtgtgtcaacagctaagtaataaaattccaattttccctgaaattgtctactccataatcacttcagtagaggccaagtaggattgatctaatgatgggaagatatagcactgattatgaaaagaaactaacgagacaaaactagatattccaaactgttaacctagcactctgaaactaaacggacaattactagactaacacaagaacacgtacgtaaaaactagatcttataatttaacaaaagaacagctcgtcgtaattgggagttcaaggattcgctagatgtattctgtaacagaaatgcatgttaacaaaactgcgttgtttcaggtcaaaataagcagcagtttgcgccaaaagttaagcaactagatcccaaatgttctattctgttcacgatcagagcaaagttttgcaaacatcaatgggattttattcgaacctgcataactacgcatttcagaacacatttagcattaccaattctgcttgttcatactttagactcacaagtcgacacgggaactttactaattactactacccaccaatttgagatctacaaaaccgcacagaagcagttagtgccgtgtggattgcatggcttcaacgcattcactgaccacccaaattggcgatccgtccggtgagctcgatccaccaccaggcgcaccaatgtaacaaatagtacatgactaccggccgcggccaactcggcgagcaagtgagtaccaggcgatctcatctcaccttgaaggggggagccgcgggcttggggaccgttggaggggaggcgacggagcgcacagcgaagcgcctcgagcggcgaagtcgacggcgggcggcgagcggggccgcgcgactgggaaccgcgacgaccggtaagacaaagccggcggtgccgcccccgtcggtgggacgcatggttggtaaggaaggagtgggaggtttggtggaagcaacggtggagttggagtggatagaaaccgaacgacgtgtgctgccgtcgactcgggactccaacgttcgctgccgtcgttttgtcgcgtccatttcctctcctctggtgcaggtttcacctcgttttttcgtctctttcgaattttttttctcaaaccactatggttccttttttttctcttgattaagatacatgttttatctggtgttaacacgtttttccaaaccattaaattgtatattttatacgaaaactttatattgtatataaaaattactttaataattaaaacttaattgattatgatctaatgattttcttattttatatgtcagtactcaatctcatctaaacgcaaatggctgataggccacgtatatgtacttgtatccgtatcactatagtacgtatccatatctgatacggatacgtggcctatcagtcatatccgggtacttaagaaaaacacaactctatagcaataataaatttagatcagctactagctcaatatatatatatgtgtaggagaagtaataatggtgtagtggtggagtagtgggtggatgatccattcaccaaggtttaaattttaatgttcacgaatattacgtacatataggtggattttcaatagtattgtagtaagattagggatgtgcctgatttttggctttcaacagaattttaggaagagtaaagatatgatgctagtttttagcttttcacagattttagcaaaattaaagatatgctggtttttatctttttagaacgtgtgaaagagagtgtatatgtgggagtgtacgtgtgatattatctgtgtagtagtgtgtgcgcgtgtacactactagtacgtaataaaaaaaagataatactattgtacgaaacagaatggtctgcgaccaaaaccagtttttcgtgggagccatacgaaaacgtggacgctccaaagtccaaaaggatcaccaatcgacgaaaatgaagtccgtatggtgaagtgaacacgcagccaaccaaactactgttgggcctctattccgtaaagcagaagctctctgctccgtgccacttgatgggctacaacttctgtagacgacgaacggatgcctcacagcaactcaaacccggcctcggatacatcacactcctcgaccggaaaggctaatgggcgggtgatccctcccccacccgcccagcgatcacccgtccaccctctcccctatactattagatgcctccctcttctctccctttctccattccttctcctctttctactacagtagaccacacaaatttttttgaaaaacaaaagttagaaaaatttatatatagaaatactatatataaaaagtttgaattcaaattcaaatttgaatcgggtatgtaaacttttgacttataaactttgggtctataaactttagatgtataaactttagatgtatagaaatactatatatagaaaatatttgaattcaaattcaaatttgaaccagatataatttaaattcaaatttgaatcgggtatataaactttaggtctataaactttagatgtatagaaatactatatatgaaaaatatttcaattcaaattcaaatttaaaacgggtatataaacttttgacttataaactttaggtctataaactttagatgtataaactttagatgtacagaaatactatatataaaaaaaatatttgaattcaaattcaaatttgaaacggatatataaacttttgacttataaacttttggtctctaaactttaggtgtataaatttactaaaataggaaagtaatgcggtgccaaaaaaggaaaccaggtggagggatgaaggggggaggtggggagcgaatctgatcgctacccccatccccacggtgatcgatcgcccattaggcgtacccctcctcgacggccctttcatttttaattttttttcttttaatatttacagaaataatctattggcgtaaaaaattacaaaaatagactctgccgctctagtggagggcggcaagctgacgtggcagacggcggctcgacggcgccgtctgcaaaaattgcatttagccccttgccgccctcggcaaggggctaaatgcaactttcgcagccctaaagagcatttggctagtactttttgcatctgagccccttgccgcccaaggggcctagatgcaaaaagtaccagccaaaaagtactaggcccgggctggcttttttgcatgggggtagagggcggcaagggttttcgtgcaaaaaaaaccctccctctcccgtctgccgtcaccgcccgtccctcctccgtttgccacgtcagcttgccaccttagtggagggcggcagggtctatttttgtaattttttgcgccgatgggttatttctgtaaatattaaaagaaaaaaaattaaaaatgaaaaaaattcggcaagtgcatgccgcccgagagacaggcctaatgcccaaacccacggttacccacctaccgcgacagcacgattcactctcgcgccacgtaaacgccacgcaaagaaataagttcacttttggtcccttaattttgtcgcccagtgtaagtttcatcctcagtccggaaaacccggatacgatggaacctccaacttacaaaacgagtgcaaacgagccatgtaggatgaagatatgtgggacgaagaccagtaaaagaagccacgtcaactaaaatcggggatctcgtttgtctggtctagtaagtttggggatgcgttgtattcgtttttacggttaagagacgaatctcagattcaacaatttgatgcatccagtgtgaacttattgcccacgcaaatcacaccgagcgggccgcagaaaccggagagaacacgcgcaccgcatgcgcgcgcgccggttgcgcgtcgcccccgacgccgagtcgccgacggccgcgagcacacctgcctcgtctcgtctcgctctcgctctcgcgggcgacgcgaccaagcgcacaaaccaaaagcaggcgagcataacaaaaggaaacggacgacctcacgcacaccgtacgagtcgtcgtcgtccgccgtttcgatcgatcgatcggctctcgggccagccgcattttccagattcgcgctagccggaaagaaaataaaacattatcatcgtcgtcgtctacgtcgtaacctcttcttttctccaataaaaattagaatattcgtgacacgcttttcaaactgataaacagtgtgtttcgtgtgaaaactttctatataaaagttattctaaaatatcagattaatttgtttttttaagtttgtaataattaaaactcaattaatcatatgttattattactccgttttacgtgaaacacttaatctttaatctttaccttgactacttttttcgccggcccatcgacgtcgtaatcgtcgtcggcgactcgatcgatcgggccgtggagttcacgtcatgggaagaacggccggacggaccggcctgagctttactcatcttttttgcctttttggcctcggctggcctccccgtccttttcatccgcttagctaagctagcgagcgccagcatgtgtgtgatgtgttcacaaaactttgtatattgttactttatggatagattggatcatcgatcgattaattggcgagtgtacttgcatcatcggaccttgattagcatctacgaaaacggtgagattgtgcttataagatatacatatataatactccaattaagtaatctttcatgtcgctctccgggaagacgagtgctccagagtctagaccgacacacacggcaggcacaggcaggtccttccccgttagctacacgcgccggggctcatcgtcaaggagatactatgtatgttaggtatgtcgtatgtgcaactcttccataggtatgggttcaccttttcgattgagtgctggattcctacccacctataggttcccctttttgattgagtgttggattccgacctccaatgatattatatttttttcctcaattttggattaaattttgattgaattttactatcttaaatttgaatttttaagaacctcgacagtgtcttgacctccatactggctctactgcgtgcagtccgatttgtaagaagaccaccttctggatagatgcgggggcgcaacagctcgggatcttgctggccaccctcgttacttcatgatttagcctcttctgcccaatctcctcggctggagcttgtttgctaatctgtgtgaaatcaatgtgtgttttgattatttagtttgtgatgaacaattaattttacaaataatttattcgataaattggtttgagaaaatgtgtgaatattggtgtgtgggtagactaaaatcattgtaaattctaagttttgaggttctggctgctagtaggtagacttatgcaacttgtttgaatttcgtctaatatattgatgcgcaagtctcttgcgtgtttcaaaagtaaatctcgtaaaccattcaaaattgtactcagaacctactttttgtcttgcgtcgaaacatcgaaattttgtcgaaaacgtgaactctgtttaccatgagttgttggataaaaaacaatcatgctcgtacgacagtgttgaactttttttatttttttcagttttgccgagtttttcatcattcatctttgttctttcatctccattgttaatttacccttcagcttattagccgcgtctaaaatttaaattttaaaacttaatcaaatggttgattatgagtttcttcatcataatttttttagcatttacttttaaattttaaaaacacacatataatatgttttattaaaaaaatacttttatgtcgttaacctgttacgtatacggggagcctaataggcgatcgtccagtgataagatctgccctgcctcctctcctccctcttctcccccttcctcctccccttcttctcttcctactacaatacatcacacatttttttaaaaaaacaaaaggttagaaaaatttatgtatagaaatactatatataaaaatttgaattcaaatttaaatttgaatcggctatgtaaacttttggcttataaactttgggtctataaactttagatgtaaagaaatactatatatagaaaatatttgaattcaaaatcaaatttgaatcagatataattcaaattcaaatttgaatctggtatgtaaacttttgccttataaactttaggtctataaactttaggtgtataaactttagatgcataaaaatactatatatagaaaatatttgaattcaaattcaaatttgaatcggatatataaacttttgacttataaactttgggtctctaaactttagatgtgtaaacttgagatgtataaattttaggtgcataaatttactaaaatagaaaagtaatgcggtgccagaaaaggaaactaggtggagggagggaggggatctgatcgctactcgatgggtcgggcgatcgatcgcccattagaagtttcgtacgtatacggccataataatctgtataagcgaaacgatgattgtgttcagatgttagctctgccatctagcatcttctccaggaacacgctctttccgtgtctcgacaaccacagctgcggtgcttccgtgtgttcctttgcagaacttttttgatgcttgaaaaccctgatctcaccacccaaatctgatactgtattgtcgacctgatcgagccaacaacaactgggtccaacagaaaatctaggccaattcctcctctctctctctctctctctctctctctctgttgctctcgagctgatcgtagttgggttttaggtaggtgaggatgtacgcgccaccatattccacaacataatcaacatgaggcacaaatggcaccaaaaaagaattcctggaggttgtagttgtactagccgtgcatgcaccatcaaaaaaaatactttaatctaaattgatatgatatgcaaatcaccatgaaagaatcttggcctgattttaagtgggatgcaatttgcaaacattctttttttttctgggaccagcatgaatggacgtctctgaatcgatcagttgctataaccataatctgagtatgaatgtgcatgatgatcatgtacgaaatgattagtggctctcccggaatcttctgcaggtattgaatactgatcactctttttttagaaggatggttagtaggtagaggtactgtattaagtacgttgatgtaaaggtggaggcttcaatttaattgtgagattttgcggaagaacaattaggatacggctcttcagtcttgaatgctaaatagtcgttgaagttgttgactccccctcaagtttaaattcagagtatatacaaagatgagaaaagattgttgagttgaacctaatgtatgaactgttgaaaattgcgaagaaccgtgaacgtttctgctggttttacttggacagaaactgggaaatttcagcggtctgaaactaacaaaaccttctgagcatcatgtcgcttaatagatgtcgcatctgaaactgttactgattttttatttttttttctttgtagaacatcttgtcgctttgactttttacttactattcgttttatttaaaaattagtataaatataaaaaataaatcatacttgaattacttttgataataaagcaagtcataaataaaataaataataattttaaatttttttaatgagacgaatgataaaaatataaacaaaaactcaaagcgacaactaatatgagatgaaagtagtagtattttttttccagaaagaagaacatctcatgtagtttattgttggagtggactattgaaggcaaactaattaagttcgttgcttctcttattttatttttgttgattgatgtatatattatttcttcttctcctctaactgttgcaacgaataatttctgtcgctctcaccggtctccctcaatcccatatggaaaatttgtcggtttttaactctatgacaggaacccgtctttctcccactgaaagcgatttttttactgttattgcgaatatttgaagcaaagacaatcaaccattgccaggcaggcatgcagattatcaaagctggacacaacaaattgagcctaattaacactatcaacttcctgtgcttattcctgcaaagaacgcagacaaggcccagtcctgatcaagaacagagctttctcaaaaaataatactaccaataatcaagatcagagcgagttgattaaaacagagtggaatgcacacaaaggcaactgattcgatcacccaaatggctccattcaagtggtgacccatcaaactgggtaaaagtgtttaatgaacctgccctcacgccacccaaaatcctctagagtttgtactccctctatactcgtaaaggaagtcgtttagggcaatgtttaagtcgaaccttaggaatataaatcataaataactctcaagttattgagtttgaaaaggtaaaaattatacgaatagatttatcttgaaaaatactttcataaaagtatacatatatcatttttaaataaatagttttatagaaacaagaaattaaagttatgttttgaagaccgtgtcgctgtcataaacgacttcctttgccagtacgttccaaaccaccaagaaccccgctttggtttcatggacaaaaaaaaaaagttgagattttgagggcgacttggaggccatctccactggttttttttcctcctctggtcgccatctgaatgcctctcgtctcgtcatggtttgggtttaacccaagcaacctcgacatgaaaggtgagattttcctttcgccggtgttggtgtcaaggacatcatttttcccaacaaggacaaatttgctgtggatttatttggtgcagatatattcgatatcgaactgtcatggctaatagttccttgaaggctcaactgtgatatggtacgaactcggttcatacaagtttctccttgacaaaacagatttgtgtgtaataatcaaaatgccatcaccatgagctgtttcgtggagcccatgcgaaaacgtgtactgcattcgcatttctatatgcattgtgcagatattctgcatttatccgtactcatatggagtgcttctcctctaagattaggcgagctgaattaatccatttattatttattacttggttttccgtactgctgccgaagaaggggaccaaataaacttgaacactaatcgattccttttcattttttatgtgttcccttgttctatttgaagaaatggaagaatggattaatggcacgcttcttaagcaccaaaattgttaaaaaaaaaatcaaaaagaaattccatataataatttcttaagaaactatttaaattccaatttttaaactttataataatcaatttatttgtttttctctcgaatagtaatcataaaatcattcagctattctaccatattggtaaaaaaagaaaaaaaaaacatagccacttagctaaattgtccgaataatttttttttacaacacggtacaaacgtgaacatccacgaaagcgtggacactcacagaacacatatatgcacaccatatccttatgagcatctttaaaagactgggtctatatatcttgtttgacgaagtcactgtaagcatcttgttgttgatgggtatatcacctactactgaaaaaaaataattagtcataattgcgaccattcgtgtgtgtatgacattgaacttgggtggacaggtttacccaatcagttgaattatgcttactttgcaatttgtttgaagaagtttatagcttctttaaaacacatgattaaaaagaaggtaagaataggaaaaacacaggatttggataggatgcaaatggcaaaatataggattacttaatacataaaaaacacatgaatgatcgtctgattagatcgaaaaaaaggaatcaaatgagagagatttaaaggaatttttttaactggttggagctatcactaacttttcttcaaaatttttatagtgttgttcattgcataggaatttcaaatagtttcatagaattcaattcttgtttcaaatgtctttgcagaaaatttttctttaggactaaaattctctaaattttctatgtaattgtttttttttcacaaacaaggggcttgacagaatggtaagagtatacaaatcctgggaaaatgcagagcgcggcgctgcgcacggtggccactgtgcccccgattcatttggactcatacgcaagctgcctcgccggcgacgcgacagggcgggccaccgtggtgctccgggccttaatctctggagctccgggcccactgtttaagagcaagtttaacagtatactccaatttttttttcactactcgtacgcacaagacggtgcgaagttctattgatagagcaggaaaaaattacaagattataaccccgaagggtcgtaaccaggaaaaagaaaaaaaataccaccacccacacaccgacatcaccaacacacaagcccagaagaaggctagcaccgaccgaccaccgctaagcgtgagcggccgccactagacctactagctccaattcatccttagccaatctaatagccaattcatacaatagttgcttactataatattaatatattgtctcatctgtcatacacacattgtgtattagagtccgtaatgcggctggctacgggtctgtagcccgctgctcttctctcttatctttttatctcattaaaatatgtttgcagctagctaatagtctgctattgtatatgctctaagcaattttaattagtgcacttttggtttggatatgagccgctcgtgatctgcaccacccggtagatgtcctgtttctgtttttctgctagattttgttggaatcatgtgaatgattttgctttttgctccccttctggtgtaaagcgcggttttgggttgccacgtctctttcgtgcgtggctgactggtgatcgatcttgaacggttcaggtgtgacgaactggactcgtgtggttagaaggttgtgcatgagcatcatctaaaatctgcccaaaagataatctcactcagtctcataaatggtatctgcatgtgtatatttataggaataattgtgcgtgcgcatgtgagcatatgcttgttttttttttaaaaaaaaacgatgcactcacgacacgacatgctatatcaatttttgtaaaaactaagataaaaaaaattgtaaaaactttataaggattttttatgtgtatcattttccctaacggccatttcccaactaaacgggcaaaattaatggagatctgaatcacgcaatttgtggcacgtattcctggttgccggcgactaatcgagtggagcagcgcgattacagtatcatcatcatcagctttgcgccttgtggctgcgcattgactcggatcgaactccggctttatgccaaattgccaaggccaccaccccttgcacaagtgtctccgcattaagccttttccatatccgcacggatgcatcataaaaaggagcgaatctcagatgcacacgcatttgatgccgtggttaattactacgaggcacaaagcacagtatagcatataatctctctcttagcgacaaggaataagggcatgtacaaagttagagtcaggtatgagctctatgctatatagagactagcattctataatagttggagacaatatggtctttaatcattaatgtatcaaaatattttttttcttactattgtttcctttctttcaccaccatgcaacaaaatatgctctaataaatgctaagagtcgactctaagccgttgttatgtataacaaccatatttctctttcctcctttctctttcttccatattatcaaatttacttgcatggcaatagaaagaccactaataaataccgttgcacatgcctaaaaggcagatcatatatatactcttaaaaaccttcattatggaaggctaccaaccaacgattgattacacgctgcaaaaaccgaaaggtgtatccttgcatcgtatcctactctcatctgagcagttcactccaccaacattggaaagatgagtgcaagctgcggtatatagaagggaaaaaatccagattattctataccatatagcgttaaggttttatttggtacaattctcgttctcagatcatgctgaaattagaatttgtaagttaaattatagtggtttaaaattttatattgttctatgaaacaaaaacaaagcaatacattcaaatattatcactgtaatcgcatatccaaattcgtggatttctagagttaaaaacgcctagctcatacaaatcttcgatatgaagctgctagccctaaattaatcgttgaggcatgcacctggcactttggcagccgagttggactccactaaaaattagagaagaaatcttcccaatggctgccgaacaagtaccacaatctttgtgatttagctttcccccgtgcacatttggtacacgagcaccatcaatcaatcgagccagccgagtcggtttctctttctcccccgtgccaagctaccaaagcggcttcacgcaagaaaggaataacctgatgtggtgtggctccgatcacggcgccggcgccgccccagtcaccggtggttgttaaacctgtttttttaagcactaccacacctactaaattttttttactaaatttatactaacaatcatctcaaccgtttaatttagatagataaaagttataaaaactctaaagacactcatagcatgccaatgtcagtattagtaagaactaagctctgtcttaaattataagtcttatattttttaacacggtcttcaataccatataacagatataaaattagtataacatgaaagtacttcaaaatatgatatagtgatataacatgcataagtaaacttagtatagacatagtttatatggttattagccaaaagttattaagtttgatattttttagaaatgggacgccctataatttagaaatgggacgccctataatttggaatgcagacttttctcctttttcctttttttttctttttttgccgagtcatcagccagccagcctccccctccgcgtgagacccccaacctcagcgacgcgaccggcggtctcacgcgaaagcggactcgccaccacccgatccgatcccccgcgcgcaccgcgagagccgctcgtgcgtggcgttcgtcggttggttgggttcctttctttttgttggttttttcgcggtgttttcactgcgtttttcgccccgtggcgcacgtctttgctgcaacggcgaagggcgtgtgttttgtttttgtttttgtttagttttgccgcgttcgtcagaggagaggtttaggtgcgaccaaccagacctgaggctgcggctgcgcgctacgatacacgacggacgcggtctttctttgaagccctgcccagaggggagtacagagactctagtagcagtcgctctcgtcgtcgtcgtctcttccgtttttctcccgtcctaccttcatccacacctcggatcggtggatcgaccgatcgatcgacgggtggtggcacgttgttttcttctccatccatccatccatccactcggtggctatggcgtagggaggaaaatcacgaaaaagaggatcactcggacggattcttttctctctctctctcttttcttcttcttgttctacttctttgatcttcttcttctctgctgctctgccgtccatggtggtatggtggtgatgtggtggcgtgcaaggtgaggtaaagggggtgtggtggtggtcggctcggctgtttatccatccatccatggatgccggtgagggtggcggcgcgcccgccgccgccgccgccgtgtcgaatgggtttgttcacgccgtcgtgcggtggtgcttctctccgctcttcttctggctgttcaccgtcgctctcgtcgccgccatccacctcgcctccacctacatctctccctccaggtatgaatcgatgataagcgatttcaccagaatcatcgatgataattttgcgggaattctgaatttcttgatgtttttgttttaaattttgtcagagacgaagaggacaaggagaagaaggcgcggcgcggcggcgatttcgccggagccggggaggagaggaaggaggagaaggtgggaaggaacgacgacaagattctggagatgatgcggagcttcagcttcatgcatgcgagcgaggaggatttcatggaggggatggctacgtacgaccacgtcgtcgccaggatggcgccggagccgctgccgctgacgccgccggccgcgccgccgccgtcgacgttcagcttcaggttccagcaccagttgcccgagattctccgggagacggccgtggtctcgggtgaaatacctgtgcaagtattggaagaacacgagccggagaagaagccggcgattgcgatggaatcgaagcaagaacgnnnnnnnnnnnnnnnnnnnnnnnnnnnnnnnnnnnnnnnnnnaagggacaatcaatccagc

SEQ ID NO: 122 - DNA, 13071 bp, Oryza sativa
  unsure (1)..(13071): unsure at all n locations
cgaagcaagaacccgagcgcgatgcagagaagaaagaggtggtcatggagnagaaggaagaagaggagcacagtananaggtcgtgaagncgncgncgncggccccgatgatcgtgtcgaccacgcacaactaccggttcttgacggagcgtgacttccgagggttcgtcaaggagccggaggccatcacggtgcgcgtccaggaatccttcgtgccatcgccggagctggagcggtggcggtggcggcaaccgcgcaaccggaggagcggcgagtggtcgacggggcgccacggcgcggcttcctcacgaccaacgacttccgcccggcgaacgagccggatagcgcgcgccagagcgtggcgtcgcagctggggcggaagccggcggcgagctccccgtccgccgcgtcgaggggcagcgccgccgccgccgtgagcgggaggacgagcttcgcgtcggagttctccggcttcggcggcgactccgactcggagtcaaccgccagcgacgggtactcggtgaaggacctcgtcgtcgactccgacagcgactggttcctctcggagaaggacttcccggcggcggcggtggccgggcacgacgccggcagcctcaggggctattacaaggccaaggtgctcaaggccctggaagccctcgacgcgtcggcctccaacctggaacgttcgttccaggactcggcgacgacggtgtcgccgggctcggtcgtcggccaggcctcgccggacatcatcggcgccgccgacgaccccgccaagtaccccgaggacatgtggtcccggagcccctcgccggacgtcgagtacaacgaagacgagcacaagggaaacgaggcgacgaacatggcggaggaggtgagcttcgacatgagcgacgacgagcggccgcccgcctccggcggcaagaagacgacggcgatggcagcatcatcatcatcatcatcaccggtgcacgacgccgaatctgaagatgagaacagcttggatcattcggagaaggaaaccatcacgatacatgatcattcgtacgaatctgtctccgatgtcaagaggaggagcccagaagcaatctctgacgcagaattggatgatgcctcgtctcgccatgctgctgttcttgatgccaaggtaagaagcccggacgttcattcatctgaacccatctttgacaattacgaagaacatgaggtctcaaatgatcaatcacaagcggcagtttctgatgagaagagaagcacaccgcattcggagagagaatttgctggtacagacgatcgctcacacgaactcatttctgatgtttggaaagatattgtcggtgcaaatgatcagtcattagcatcagctcacgatgaagaaagaagtcctgatcaatcggttgcgattatttctgatgatcacaaagcaattgtcagtgctacgaatgattcctcaaatggagaagtttctgatcataagagcaccccagagactgcagagcaggaattcagtggaaatgatgatccatatgaactagttgccgatgcaaggatcatttcagagcgtgcagaagaagatgatatcccaaatgagcgtccagggaacgccactcggcatgtcaccttctccgtcgccgagaaggggaaggtgttggacgtggtggaggaggatcaagaggacaagtggaaggatttgacggaagaggaggaggacgagctggagtcactgtgggagcaccaggatctgatcgagcagctgaagctggagctgaagaaggtgcggtcgatcgggctaccgacgatcttggaggagtcggagacgccgaaggcaccgatggaggatctcaagccatggaggatcgacgccaagttccttcgcgaggacccaatggacgagctgaataagttcttcaagagttatagggagagaatgaggaagtttgacatattgtgctatcagaagatgtatgcaataggtatgcacatttttaccattaccagtttacccttatttatctcagattctagtactaatatttagcactagagtacagttgctacttttgtaactatcaagcatagcatccactagctttttaaagctagttaaggacaagatgcagctttatgatgctttccctagcaaattttttgttcaactcaatgtcctaaaagatatatttttttggttgcttgaaattctgttgtgctaatatggtaccgcaattggatttgccgcagattttcttcagttcagagggcctcaacaatcggcaaattctctaaaatccttatcaccaacggtgacatccatcctgtctcacaatttccggtcgtcacgtcgaaaatcacccgaggacccgtcagaaaggtttctcaaggagctccggtatgacttggagacagtttacgtcggccaaatgtgcctatcatgggagttccttcggtggcagtatgagcaggcccatgacctgccggaatccgatccttaccacagccatcagtacaannnnnnnnnnnnnnnnnnnnnnnnnnntcaggtagttgtgcagaggtttgtggaggatgagtccttcaagggccctaggttgccaaactacatcaataaccgatgtgttcttcgaaatctcttgcaagtaccagtaataaaaggttataatcagatttcagaaccaaataatcagatagttcatccattgtatttctttatatcatgtgctagatgatttatttgaatgtgaatgttggattgcagaggacagcttgaaggacaggatggaggatcagcgtaaggggaactatgtcataacgagcgaggagctggaggagatcatggaggaatgcatgcgcgtcttttgggagttcatcaggtccgacagagtcgagacgacgtcggtgctcaagggcttgtcgagcactcatgttgagctccaggaccctttagaccatgatcttatgatgcacatcgactccacgttacagaaggtaaatcaccaaattttcgccagtaccgacaaaattgtggatttgctacagtaagtactagtagtgaaaatacttgctgcagtacatgacactgataagtgattaactctgaaatggatgcagaaagagaagaggctgaaggatctcctgaggaccggcaactgcatagtgaagaagttcaagaagcccaaggaggacaccttgaaccagagcctcttcttctcgcaggtcgacatgcggctcgtggcacgggtcctgcggatgccgaggatcaccagcgagcagctgcagtggtgcaaggcgaagctggacaagatcgcacttgtagataggaggatccacagggaggcttcatttttgttgttcccctgttgagaatacatatataaatacacatgcttcttttgttcatttttcccccctccataaatcatctccaccatgtaatccacggcttgtagatttttcttaaccttttagtaatccaggtctctttacacatgtccagtaaattacaaattgtaacatggtaaaacagctcataaaccacagagtccacacggtacagtacttacagtaccctagctagaaaatcagagtgtaataaatcagcatttcctctcaagaggaaacatctacctcagaatgcacagatttctactacatctgaagatgaactgtgttcatgtaactttgcctctgtctgtcaccacatggatgcaactgctgaagttgtagtactacggtatgcgaataaagaagcaataagggctttgcccgagcaaagatgagctgaatgcatcatcctcagttcttgctggattgtttgtgtgtgtatgtaccagatggtccatccactgcactgagatccacagttattgatcacttgtgtcctcttggtgaagatgaacagtgtgccctgtgctcctcttttttctgattgccacatgaggcaaactaatggcggccataaccggtcctaacaaccaaagtactgactgcaaacgctgcattctgctgctgcgtactataccacagctgagagagagagagagagacaaatcataactcgcaaagcgataagaaggaaactgctgctggggacctgggtgtttgctggccgccgccattatcagcaggaaatgcgagagtgaggctcagcatcgcagcagacaaaggtggatgcagatggaacaagatgcaaacaggctgtgcggggtatgcgagtttagagctcaacagcgaaagcttggatgtattatcgcttacaccatatgtctcaaaatatagcaatctagtatgaaatatgacacatcctactattgccaatatgtgtacatgtctcgtatccggattcgtaggactgggatgatctagtacaagattactacattttaggatggatgtagtatcattttatcaactttttgtgagcggtgagttgagtaagatgatgataacaaaccgtgtcaatcttgtttccggagaaaatcgattcgagaaatccaaaaactggttggatggcaaacaacttgtcaccgatcagtccaacttaacgatgttgacaacgaaatttctatccaggttactactatactatacgtctataccatgcccgattttacacggaaatatcacttaactaaaagcgatcacgatattcacataaagaagaagccaaatttcccgtccaactttgcattggacaaaattattcagatcaggtttcagtgcaagtgttcaactggacgtgacatttgccatcttttttcaaaaaaaataaattaatttgacttcttgttcagcagcctagatgaaatttgcgacacttgacatttgcagtgggatttgaagtgacacgacagcagccagacggcccacgtagatcctgggccatcccgatccggcccattaccgcatcaagcgaatcttagccgtccgtgctaggtcaagcctcccccggaggcagccatttatacccccatccgcgccgccacgcgctctctaccatttcctcctcctcctcctcctcctcctctagggtttatccatcggcgactacgcggcggcggcggcggcggcgacggcgagatggtgcagcgcctgacgtaccgcaaaaggcacagctatgccacgaagtctaatcagacgcgggtcgtcaagactccaggtctggatcttctctcttcttggggcactttttcttttggggttgggttcttgatctgttgaggtggaagatttttcgcctggttgagcgagcttttgtggcgttgtggttgcaggtggcaagctcgtgtaccagtacaccaagaagagggcgagcgggcccaagtgccccgtgaccgggaagaagatccagggagtgagtgcctgctttatcttgtctacaatgcatctttttttgtttgtttatttgttttggtaggatgatttcttgagtggtttggtgcagtggcttggtagaaatttgggataggccgatgagtatttctgttaaatgtagatgaattagtagcatttgttgctcgatcttagcgtatcaccgtgttggagtgctgatttatgatgcttaactatttatttagcctaggacctgataatgatcggacgttcttgtgtattgtgcatttagtctttttggcacctagaaatgattccttctggtggatttgattacctggcgattggtcaaccatttctgaaattttctggagaaatctacgcactgcatgattttcagcttggcatataaatgtagaacagctgacctgtgttttgtaaactgattgaattgcattatcaccattgttgtttactcatgtttcttttgctttgtttctgtgctcttaaatattgaacacacacacacacacacccctaatgcagtctaattattttttgctgatttgctttctgccacaagtatagtttgtaactatatcaattatatttctgtaatttctgtggggataacagtttttatgatagaacattaagatattattctactaatcagagtttgaacattgaactaagggtggtatatcaattttatcccttgtgaactaattccaataaaatgtgcaatgaaatcatcctatctaaatgcgtatgttcagctttaggctgtggcaatcactcataggcctcattgctgggtctatgaacagctttctcattcatactcttcgtcatggtttgtaacatgtactgtgctggaaaacatatatagttcctacacaaatctaatcactgaactttgtgtactatgtatgaaactgttggacttttgattgttgaatgtttgtcacgattagcattagataacacttgtgttgtgccatttttatcgtattattttactgtatgaggtgcattattttgactcaatactgtcgcttccattttcagattccccatctcaggcctgctgagtacaagagatccaggttgtctaggaaccgcagaactgtgaaccgtccctatggtggagtgctctctggaactgcagttagggaaaggtcagcataacatgctccaacatatccacatttgattataacatgtatcttctgtcacctcacatgattcatattgcctcgcaggatcattcgtgctttcttggttgaagagcagaagattgtgaagaaagtcttgaaaatacagaaaaccaaggacaagtcagcctcaaagtagacaactcttggaagtggaagcaaggcgatgtgctataaacaaggaaaacatttttgttgatggtgatgatcaatggtctagcctcttctagctgaatgttttagtataactgtctgagtttggagtacttgaaatccgtctaccattgtgatgcacttgatgtcaaatgttgctgagacatatttgatccgctcttttgttcacttctctgaattgcgaatgaattttacttacttgagctggtgttttgtttctactctgtctgtctgattgtttgtgcttctgtttcccctgaggacaatgaacgtatggtacgatatgatccatgcatttggataggcaaatctgcagtcgtaagccctcatattacgtttatcagccttctgtccttggtcagacttaagacgtatacagtactatatggtgtattttatagttgattaaactgatgtattgttgttgtcacagaagcgtcgattatttgattattttacgacttgggccgagtttagttacaaactttttctttaaacttctaattttttcatcgcattaaaatttttctacacacacaaacttttaactttttcgtcacatcgttccaatttcaatcaaacttctaatttttgcgtgaactaaacacacgtcaaaattaagtttgactaaaattgaaagtttgaagaaaaagttgaaagtttatgtgtaggaaagttttgatgtgatggaaaagttgaagtttgaagaaaaagttgggaactaaaccagccttgaaagtgaacatctacactaaattaatcaaaatttaaccttgtatttccaaaaaaaaatatttcattcactataataattcaaccctgtaaaaaaatatttcattcactatattaacaaactataataattcaaccctgtaaaaaaaatatttcattcactatattcaaaaaaaatatttatgtcaagaatgggattcgaacccatgccctttcggaccagtacctgaaactggcgccttagaccaactcggccatcttgactttgcatttatggcgtcatttaaatcttatgtaattcgttaaacttgaatccttaatccgacggacctcccccatgatttacggagtagtgctaccttcgtttccgaaccgggagttgattcattcgccagccatggcggatcgccgcgctctccagtaggttaccctcctccctctccgatccctttttctccccccctcgcgccatctacatgccgcctcgccttcttcggtccttcacccctatcgccgccggccacctttgngcgctctccgngttcgccccgcgcgcttgggagggcgcgccccacctgttcggcggaaatgcggnncggggcacccgaccttctcgcgcgccntcccgccgagctcgcgttattcgcccgcgcgcgcgccgcggggcgcgccgcgccgagccagttcgcctaccggaacgcgctcgccgcgtgcgcccgcgcccccgcccccgcgcttgccgagcaggtctactgcgccgcatggaaggacgggctctccgggaacgcgtacgtctgcaccggcatggtcgacctgctcgccaagagcgcccgcctcgggacgcgctcagggtgttcgcggacggggacccgagcagcgccgtgtgctggaacgcggccggctccggggcggtgcggaacggcgagggcgggctcgccgtcgagatgttccgtgatatggtgtggggctcgtgcgagcccaactcgttcacttactccggggctctcagcgcgtgcgcggcgggtgaagagctgagcgttgggcgggcggtgcatggtctggtgcttcggcgtgatcctgagtacgatgtgttcgttggaacgtcgcttgttaacatgtatgcgaaatgtggtgatatgggtgctgccatgagggagttctggagaatgccagtccggaatgtggtttcgtggaccaccgcgatagccggtttcgttcaggatgatgagccagtcagtgcaatgctgctacttagggaaatggtgcggaatggcgtggcgatcaacaaatacacagccacaagtatcttgcttgcttgcgctcagatgtctatggtaagagaggctagccagatacatggtatggttttgaagacagagatgtacttggattgcgttgtcaaggaggcattgatttcgacgtacactaactttgggtttattgagttgtcggagaaagtgtttgaagaagctggcacagtaagcaatagaagtatttggtcagccttcatatctggggtcagtaaccatagccttctgagatcagttcagttgttaaggaggatgtttcatcaaggtctaagaccgaatgacaaatgctatgcttctgttttcagctctgtaaattcaattgaatttggtggacaacttcattcatcagccataaaagaggggttcattcatggtattcttgttggcagtgcactctccaccatgtactctagatgtgataatgttcaggatagctacaaggtttttgaagagatgcaggaacgagatggagtctcatggacagcaatggttgctggttttgctacacatggtcattcagttgaggcattcctaacattcaggaatatgattcttgatggatttaagccagatcatgtgtcgttaactgccattctttcagcttgtaatagaccagagtgtttactcaaagggaaggaagttcatggtcacacacttcgtgtctatggagaaaccacattcataaacgattgttttatttccatgtattcaaaatgtcaaggggtacaaacagctagaagaatttttgatgcaactccacgcaaagatcaggtcatgtggtcctcaatgatatctggatatgctacaaatggttgcggtgaggaagcaatctcattatttcagcttatggtggcagcaagcattcgaatagatagttatatatgctcgtctattcttagcctatgtgctgatatagcaagaccattctattgtaaaccattacatggatatgcaattaaagcaggcatattgtctgatcagtcagtaagcagttcacttgtgaaggtgtactccagaagtggcaatatggatgattctcgtaaagtttttgatgaaataagtgtcccagacttagttgcatggaccactataattgatgggtatgctcagcatggaagtagtcagaatgcattggcaatgtttgatttgatggttcagcttggggtaagaccagatactgttgtattagtgagtgttttgtctgcatgcagccgtaatggtttagttgagcaaggttttaactattttaattcaatgagaactgcatatggggttgagccagagttacagcactactgttgcatggttgatttacttggtcgatctgggaggcttgcagaggcaaaatattttgttgatagcatgcctatgaaaccagacttgatggtatggagcaccctacttgctgcttgcagagttcatgatgacactgtacttggacggtttgtagaaaataagatccgtgaaggaaattatgattcaggttcctttgcaactctgtcgaacattcttgcgaattctggagattgggaggaagtagctagaatcagaaaaacaatgaagggtgtaaataaagaacctggatggagtatggtgtaaaaaccgaaatgcttgaggagatcagttataaacatatatttcatgagcagagatcggctataaagagagaagcacctttgccaaatatttctattttatgaccaagacattgcagagtatgttcatgattaaaacttctacaaaaattcttttttgaatgtccctaagctattctttattagcacatgtgctaaattttgattgagttggagtgataatattggggaaattggaaatgaacacccgttggttttatgtggtcctgctcatggaaaggacgttacagttatcaaaagttcccactgttgggagaactgggtttgtgattcctcttgctgtactttatcaactattcactttatgagaattttcatataatcatactcggcatatagagcacacccctaattctcagagtaagcataagatctttatagtacagtggaactcaatttatataactaagctattctttcctcagttaatcttcctttaatatgagtaactttcaggtataaatctgacttgatatatatagcatggtagttcttttgctaacaactgaaggcttctcttggtcttagtgtctatatgactatgtaacattttcctataaaatgctattgcacatgactgtaggagttgggagttaaggggaattcacatggcatattgatattgcttgtccagttatctgaaggatcacccaataaatcaaatggaaactttattttctgccggattccacattcactgcctgtactgtattcagtaccagttcttgtatatggatcctcatcactattttcaatgcctccatttgtgcctataacccaatcaacttcatatccattgcatggttcagtctgtccaaaccgtatgtttggcgaggcttcatatatgctattgattattccaggggttatgctgagaagcagcgatgtggcacctgacatatgctgcagggtttgtgttttgaatggtaaggtgactggacaattatggttgtctttgtctgattgatgagttaaagatggactgcacttgaagtttatgactttactagaagagccatcttgtctattgttgggcttctgctgcctcccctgcaggcactgctgactgttcaactgagttatcggtattgcaacttcttctgagcaagaggaactctctgaagcaaattgcgagcttgttgttgcagttgattgaggaccccaggggtgagataacgctctttgtgccatagagttaggctttttaaatatcttacaaatagcccagatatcctgtttggtgcagaaaaatattagaatgatattatatagttattttattttatttttttgctataactatatagtaattccagtaaaatactcactttggctggttttttatctattggtattttagaaagtgaaggctccgtgagtgaaggaagtctgaactcatgcatcatccaatcagtcttgaacccttttgctgctctccctttgtaaaagacaagagacttcttcaggcttatgcatttggttccctcggaagagtagatgggcctctaatacaagaagttaaaagaggaagagaggatgaactgtatccgagcttcatgaaacttccctaaatcgtcatgctttatgccgatacatgagaaagggagtttaatatatgctttaaaatgaaattacaactgcttgaacatgacaatgcgacccacaggtatgcatttacctccttgtattgagtagttctttattccttctctttctgaacgcacttgacttgtttgacaagagactttagtccctttcaatttgcacctagataaatgatctaggagtctagaacaccatgagcgaacattcgataatactcacgcatattatttttccactgtcatctcagtatccaaatgaaatactagtaatttatgttagtatatagtgcaagttaagcactcatcaacaattgtactaggcaccaatatttacaacctcaagattcttaaattctagatccagtggcaatgcactgatataagatggggaaaatcagcgggggcctcccctgctgtgttcctttcaaaaaaaaaaagatggggaaaattgttgacggtgtaaaaaagtactccttccgttttttaatagatgacgccnnccnnntnnnnntacatgcatgtcgactttgaaatatttattgactctcattcatcggaatttaccacaaggcctcggtgggttctggcattccatccggttaatttgacgaaccctgtacatcccccctttcacttatcggatttaccttccaaatgacctagctgcgccctacaaaccgccatcttaaatgaacaaaagctcggtccaatgtttatagtctttattagaactccctcttatgcgactcggggaattaatctcacgacgtccaagtggtcttttaggtacacatcttccggcctcccatgcgctgtacgacaccttccacttcacaatgggcacccgcccaatttatttgtcaaccccttggttacggttaaaccttaccctatccccaaggaacgccccctaatctttttttcctatggtaaaacatgtaatttgcaagcgcttttcaaaagcttcccctttttttttataccttctatgaacatccactgtaaactttgatacctatctatggttcgacaaaacattgtgtttgtttcg

SEQ ID NO: 123 - DNA, 21241 bp, Oryza sativa
  unsure (1)..(21241): unsure at all n locations
ntttggtatggtcaggacataatatctttcccttgtacttccaataaatttgattttgggcaaagagtacatcgtcattccttttcagaaaatattttctccactgtgaaaaatttcaaccaatctttagtgcaattggattcccccctatacttaagtgcgtgccaatagcttcatttccatccggcacctcccttccagctttaagtcataatgaataattttgtttaaaacctcctgcttttcttaataaaaattagcattttttacctacaactttttgttgaattccaggacattaaagacccatccaagtttcaaattgcctggtttttgtggatggagtaggtttcttggcgccaaaaattttatcgcttaagtgggggtcatcatcactttttttaaatatcaacctccaaaaacaactttcagccctttcacaaacaancacaaaaaacttttccacaagccaanccnncnnacnncccannannnncaacggcgtcatctattaaaaaacggatgtagtataagacagggaaaagtgtcaagggtgtaataaatgttttgtttgcattactgaagtggataataactatggaccatgatttacattcacatgtgtataatacagacattcaattagctaatatgtttcatactttggcatcacttctttatccatacacactaacagactttacactcccccaaatcttacaggcatgactgcatctaatgactgttacaacgatgtgaatggacccagaaagcaaacgtttagcatctcagtaatataatggagtcatcaacatcatttgtttgattgtttctcattgaatttaccagagaagtcagtaaggcagacagcagatcaatcatatcgaaaggaaaggacaatcagcgaatcagtatcatctgttgacacagatgatgtatgaacagccactgatagggaaaaaaaatcattgagccgacctgaaagctactcgcaacgattcaggaaagtacaaatgcatttgttatggcaattattgttctgttagtaacaatagatctatagcaatttgcatttgtgtagccgccatttagtctgtgaggtacaatagaaatttgagaactacaataccttctagagacaaagaaatatagcaatacggcaatgaagagagaagtttcagaccatattatctgaagcgtgtttccattagatttcataggtagaaacaaatgacacaagtcttgtaaactccattttcactagctctagaagtttccaaactactatctgaagaacttacagatagagctgtggatgttttttttatatttctacagaattgaggaccaaattcaacttaattggacagatacaagaaaggcaaagtcagatagaaagctgtttgtgcttccttttgtagattaaagttagatcattgcagatgagtacaaacacaatatatttcgctcgtaatttacttctgggagttacgggaaacatgaaattacagagaacagtaaaataaaggagaacccattgttcttttcaagtatctttgatcaagttactaaagcatatgcacaaagccgtaggctgatcagtcaaagccttcaagatgctcccaaaagctccttgatatcatacccttgcagctgaagcaattgaaagttatacatgtcagttacatctcatagttactactgcatgaaattaatatgccagtacatgccatctaaattctgaaataaccaagtaacataaatagacaatcatcagataactaccctattcatatgcaattctctgcaagttatacaactcaaccctatcttgatcaagaatgaatatgctgacaaattggagtataagacatacctgaagaaaggttaacagtaatattactcccgagttccaaaatgcatgtattgtgataggagttagaagattatgggtttgagcatatgaaaaacccaacgcaacacctgcataccaatcagaaatgttatggaaatggaataataatctcacaatgtaataaatacttcgatagtttccaaaagaaaatcactggtcataaattgatcatagtatcacactgagggtttgcatctatcatctttctaacaagaggtcacaaatgcaagacaccacgaggcagctacactttagtgtgatcaactttgttgataaccaaatgcattcatgcacttcgccaaaacacggaattcacagggtttttatatcttatttctaaattgacatataaaattaccaagtataaacaactgtgggaattgtccaggtgtcagatgagcaaaggcaaatagagcagcactgacaagtatgcaaactggagtaggaaacctgtatacaaagcaaactgttaaaaacaagcaaaactgcaaactgtacataccaatttgctatatgcaagcatgtgaaaggaagctactaaaaagagctaaatagtatatgtttgtttaccacttagtcaaggacaccattaaaaatcctcgaaacacagtctcctccagaattggtgctagaactccagtaatgcccaccagaaaagcagtgctaataatatattaaaaagttgaagacaaagtcaggttatgactgccaggtataaaggcataaacccactgaaaactggatggatgatacctggcacttgatgagccgattaatggcaataaaagaactaacgagtcagtctgaaaaaaaaagtccagagaaatagatcagcaatcaggactcaagaaacagcacactgaaaaaaggtaatcagtataacaggaggtaagtacacaaaacatgttgagattcaatttggaaaagcgtaagcccctatcaatgtaaagtgaggccttaccacataagcttgtcagtcaaagcattgaataaaccttgtgtatgaagcttcactttatcaaagggtgcattccatcttaattatgccgcaaactgttcctaattatgctgtctcatctcaaaccaaagagaataggcatatttgctaattcctatgctactcatggaaaacctatctttctggcttccctaccatctgaatcttgcacaagtgaccatatgatagccttgagttgtcattgtttaatcacaatcagcttaatccagtccatacatgagaagattgtgattagataagacctagggtcatgcaaggcaagccaaaagggttgggtaatcaaagacaatggtctaatacaaattgcatgaattgctccatttggcatattgttataggttattgtttaatgaatattaagcggtccaagatgtgttttttttcttgctgaacaaattgaattagaggttaatgatgaatgggattaaaacaatgtgagttaaaaactaaagattgagaggtaataattaattaaatgggaataaaattgtatggcctgagaaaaatctatatagtacagtatgtaaaaggcctgacctctctttctggaggttcaccattcagataagtcatagcaaccccaactaaagcaatagaaattatagcgccaaagagaccaactccagcccacagaagccagccattttgaagcttgaatggttctttaatatctgcaaattcagcaaaagttgctagttagatatgcttatttcttattcagaaaaagcagaagttgtaaaacaaaattatccatcatgacttaagcatgaaaggcagtgccgaatgaaaatgaggctatgccacgcacttagttatagggtgaatccaattgcactaaagaattgtagaaaattttccacagtagagaaaatattttctgaaaaagaatgcacgatgtactcttcgcacaagatcaaatctattgtaagtaacatggaaagaatatcatgtcctgaccataacgaaatatatcatctggcagtggtcggaaggtattggtgatgccatatacaacacccagcacaactgctgtcacgctactgcttaagacagtgaaaagaaaatgataaatactttggcaactgtcaaagtatccattgtttgaagaatgcaaaaaaaaaaaaaaacagcaagtgcttggattcgtacagttgtccaaggaaaagtatttctgccttctgatctaccgttgcctcgacagctctaaaccccacatacgtcaaaaccgattgctcaaccaatcctgtcagaacaaagctgtctaaagaacattcagaaaaagctttcttcaatagagctgtcgatgattgaatacactaaaatactgtaaagagcaataaatttgagcattatgtatctgccaattctaagttatgaacatatggaattttcttttcataattagctccaaatccaatactatgtgcagcattgcaatagcagatagacatcactaaaacactaaccagcatagggtacaaaagtttaggagtaccttactccacagcccaccatggtgagcaccaccgtctgccactcccacggcacatcccatcggcgaaggattggccattcgtctgaattctgctcacatccaaattatgtcacaaaatcttcagcaagagaaaccatcgcaaaagagaggaatacttacatccaactaaactagacatgttttccatcataataagatactcctatcaaatgcacatttgccattctaccgatgcatccgtaaaaaaaaaagaaaaaaaagaagaaagaaagaaagaaagaaagatcttagaggtgtgttcttccaagaagctactagtatttaaattcctcaaaatctgaagcggcggcggcggcgtagagtcacctcactggaaggcggaggcggcttattgccggagttgaaggagaggcaggcgtagcccccgcgcctcctccaccggccgatctccggcgaccggagccaccgccgctgagctcttaccgccgccaggcagccagctcttggcgatggaaatggcctccgttgcctggacaggagtacggctctgcacgggagcggccggagcaggtgaagagagatcgccggcgacaacgccgccgccgccgccgacgacgaggaggccgccatgagaaggatgcgcttctttgctctcagctcgagtgctcgctggctcaccgaagaagtcgcacgtgtccttcgggataaggtgagggaccaatttgtaaaactgtaaaagtacaaggactaaaataaaaatcgaagtgataagccttctccggaattgtgtataggttcagggtggaatttgcaaaagtgaaccacaccgcttcttctccatagtagagagggctcttgcggcggcggcgatggcggcgacggcgagcacgtccggcgagtggctgaagggcgcgctgcaggagctgcgggagcggatgggtggcgcgctggagctcgacgcggacctcatctcgggcctcgtctccttctgcgagctcgcgcctccgcccgacgccgctgactacctcgcggtccgtacccatactatccatcatcccccctacgatgatgcgcagctatgcaggggttactctatttaggttctgatcggagatggttgtgcgattgttagtttgtttggtgtgtcgcgggtggcctgatctgtgcgtgcgcctttgtcgggttagggtttgtgagatttgatttagcgatttctagggttaattttgaaagtctgatcgtcggtgtgtcgcgatttttggtgcgaagtttgatgcgttgtgctgcttccctctttggttttgggatttctgcgagttattattgcaaagggaggataacatgaatacttaagcggggttagaaaaacaatgtatggctcatggatttgttagagaatagagaagggggatttgcaattatgatactattagaatatgatgatactattatgaattataccgtgatgaatgaaactctataacctgatgcgtcactttaagtttaagcacgatgagtgcattagaacagtcttttacctaagaggtgtatctgcaatctcggagcagcatggtgcttgaattgttgagttagctgtgtttctgttcagttgttagtttgtatccatgtctatttatgcggctgcaacttttcatcaaagacataattgcagaacttgtgtgcaatgatacctttttttttcctagcaaacatgtcactttgaattgaaatttgaaactctaggcttgatcacgaatttacatacccctgatgtgcatctgcaatgaagttgaaaggactatgaccaggaatttacatatccctgatacacatctgcaataaagttgaaaggactatcttgtgtgttcagtccaaaaataagatgttcctatctattcctcctagctttctgttctcaactggacatttggtgttcgcgaggatttttagttctattttctttatttgtttcatattgctcatcttcgagtgacagtgcttgccattaggtaaatattatgcatgaatgcatctgaaattactgttgcttagtcctttgtcctttgtctttattcttcatcattgatcatggtcagtgtaatggtgcagaatattattggagtagaagctgctcaggaccttattcaggagtacttgcagaggaggggttacattgatccattgaagggcaatgaaaacctacaatcatcaaatcttcagccttatgtgaagccttctgctgaagctgggcctacccaaaccaagaagcagacacgcacacaaaaagatgcagcagcatcttcttctggccagagttccaagaatcaaccagagactactgaaccccgagttgcctccaagagaggttcaaaaaagaaagcagtaaaggccatctcccttgctgaggcagcgaagggttctattgtcttcaagcaggggaaaccttgttcatgccaagcacgccagcacaaccttgtcagcaactgcttatcatgtggcaaaattgtgtgtgaacaagagggtgagggaccatgcagtttctgtggtgcacttgttctaatggaaggaagcacatatgctggtttaagtgatgttgaaattcctctttcggaagcagaagctgaagctgaagcatatgcaaagaggcttgttgactatgacagaaactctgcagcaaggactaaagtttatgatgatcaaagtgactactttgaaatggaaggaaatagttggctttcttcaaaggtaaattttatatttgcattcctatcctaatgactcatttaaacacctttttactgattcattgtgctaaacagccttatagaatgttcctgttgtttatttatatgtgcacacttcacccaatcctgcctgcaaattgttttttcaatcagaattgctggttgcctttttggaggacactaatgaacatatactacaaaccttggagaaaacagcggcactcttaattacatcttacgcttgaaattgcttgcacaattggcatttgatatatcatcatatttatatgataagaacatataacttgacgggatcagacagcaatttactgtgcaactatttgagatactagcaaatttgtccaaccaaaccatttggaacaatgttaagtaagttctcaatctttcttgcttcaggaaaagtcagacctaaagaagcagcacggggaagctcaggaagcagctgaaaaggataaagggaaagtggtcgtcacatttgatttggtgggccgcaaggtaatacaatgtcgttcctgtcgcacagcatctaatttgcttaaagctctaggcaaaacatttggaagaggacgtaattttgcaactgtttccgacaggtaattttgaacaaggatggagccaccgtgttggaatccgagcaccggatcttgggaccacctgaagagaaggatcagatccaccgcatacaagccaaccccacaatcagagagcagcccgtgttcatcgaaacagggccagtgaagccaaaaactgacagagctcgacagagcaagagactcaccaagaatggcctgtgcctggaggtaactgggaggctgcagcacgatgacaaggacccccagagcttcctgggtggcaagatgaagaagggtgatcatctggcgtacagttctttcggccaaccccgtgaaggggacgacttcgactgctcccaagattttgattgagcctaatttgcttgtggatggtgatggtcgatgggtgccttccattgtaggtatgtcatccccgattttggttcatactggttgttgagttctcagcttttacccagaggaggcaaaatacagaccaggctgtagaaatgctatcatacacatgaacacatccatatatacccatctccttttttgtaaggataccttggaacctattgaaaatgtgagaatggcacatttggttatctcttgttgcccttacagttccttctatcttttcttttgggaataattgctgggtagttgctgttaacccgtcagaaaaatcatagtactacataggaagaacagagagatggaaacaaagtcgagctagcaatttggcctttctcatctggaaagtagctatcaaactgttgttttcagcccattcgatctttgaaatgggtcttcaagacagtggttgatcaggcatagcccatccatgaaaggaaaaggtccctttgtactccctcaatcatcagctgaatccaattattatccttcaaccacaaaactggtatatcaactctcacaagatcgggttgagagacaaatccgagattgaagatcagattcgagcaatggtagaaaggagcgaaaatggacattttctttcatgaagcaaatcgcatacaattgttgcgatcaggcccaaaacattaggccatgctctttgatgagccaaaacgaggattggccagaaatttggcaaaccaaatttggccatgtgccagcaacacacaccggatattatatagcaccttcagtataactgctgcccattttgttacaagtcctactccttccgtcctgaaaggatatcttcgtttgggaataaattaaattaatctagtataggacatgacatatactaacactacaaatctgcaataagttaatatggtacaagataagacatcctaatacatcaggtacattcagattcatattactaagatatatcgcagattcataatactaagatatatcgcatcctgtatcatattaacttattttgagacagagataataccatttttctcaacaaagttttgcactagcatcagatgacatgagcaagtagacaacgagatgggcagagaagaaactgcacttgtagagtgcccgttccatcttggaacaattacagaacacttaatcaaagtagcgttgttgctttatatacacaccacgttactcccgggccgacaagcaaaacgcacaagcgaaatccggagcgcaaactgggagagagacaccaaaccaaatgcgcctttacactctctactactagtacactggcacacacacgcgaacaaatgtatctgtggtttctgcacttgacagtagcagcagccgtcgatgaattctagccttgggcgattcgagcactgcccggctgcagccgaccaagccactccttcaaggctgtggctcgtgctgcggtgtggtcggcgaatccggtgcaatggtgaaatgcactccggttccttgcccagactgaagaatgaatgccacctcagttgctgctaaggcagccgcctcctgaacaaacatacattgaaacaaacacttgaaaacaagataccccgtgaattaactacaatccagaagctaacaaatattattgaaactaatgatgctcaaatatccattgcattatgcaaaaactatgttaatgaaagcagttcaaaattttccgtcctaagatattcgaatatcccccaggatcagtagcctaactagttctatgatctcacatatggagaggaagagagcagataaaaactaaaaattcaaacagccaagtagatcaactcgaatgcaaatatctgaagaacaaggcaataacaaataaaattatcacacattccaagttctaacaaatttaaaatagtagaaaataatgtaaatcacctgtatgataacatactgacctgtcgctgtctgcggcgctgcaagatactcactgcccaagccattatatagaatggtagcagaaatccagcagcacgcaatagaaaaagctgtcaagtaatagagcatcaataccaacttctaatgatgatgtacaacaaaacaatgataaccagatagttaaagagcattctttcactcactgaaaacattgcagaagtatcatcgtcatcttcatcagttagagtcagcgcatgtctcaataataacagagccattaactgaacataagcaaaggtaaataaacaagaccttccattacatgtgcaatcaatataaatacatctgttgtctcaaaaaatatataaatacatttgtggcgcagaaattaggaactcacaactagagcagcagagcgacaaaaagcagcagtgctggcatttgtggcagagtaatcatcgtattcagcttccataatgtggttctgtgcaactgcaaggatcctaggatcacgcaagtcaaatgcagtaccagtaatggtccagccaccactgtgcattccaaaagaaataggttgcaattagcctggaatactacaaatgacaccacgatataatatcaacaagaacccatgtcttcaatatagaaaagcatgatgccctacctgatgtcaatggtagtttcatcaggatgaggcctagtaggtgcagtgtaaccgtgttcatatggctgcagtaatgtcattccaacaggtcaaattcaggattgctcctgtggaggaaggaaagatgaatcatttgaacataaattcacctcatgacaaatttcacacgttacatctcctttctcattgcaccatcgttgcacacaagcccgatgagcatactgtatcacaaaactaaaaatgtatgagcaatatccacatgcggtatctagggatcataaattcggaaacttatagttacataaaaaaaatcaggagcgccacagcaagaacttcagttgcagttgtggatatagccaggataaaaacaggtgtggatacaggtggaacagaataggtattgcttccaccttttacacattatataatacacaatgcaaatatttgccaacatactgggatatggttaaaaaagaaccattagtagcatcaggaaacttgtgagctgtttctcatcataaatgagattttagaagacatgctgagatgccgcaactaaatcatgttattaaggtgagacttttttcctagtagactatgacttgttgcctacataaccagaagaatctggcttgagacactgcacatttcatgaaaagcatgtcaaatatttgatacatgctaaaaatgtgaaacagttcatagattgctgcaaatttgagtctccatcttgtcagcatatatcaacattcagttttcatcccctaaaaaagattcagttttcaaaaacaacccatctaggttaaacattcacaattgcatattatccatgaatctatcttcaattttccatgcacgcggtctgtggatagaaaagaaaataagatcctaagcatggcactgaatttacaaagcctgtcaagaaatttggtgccaaaagatatttatactatgaaagataaacagtataatgtacagttccggtgcagaaattaggaaaaaaaatcttaatgggtatttatatgatgattggtgaaacaatacatattaactgaaaaaccaaataattgaagcattccgaaatgggtggtttatatgtatctcctgttggatatttaattattttcttcaagaggaagaagtcaaattgcatttgactactagttggtcaagttggttgcttgttgctgcttgaagtttctagcacaaatgagtgataataggttcaacaatacacaagtgattgtatgctttgttgtgttggcatggaaggatacagagcaaattttactagctagcaccctgtattagtagtttcattgctgcttgagcttggtaagcagacaagcagcatgtctgtcttggtagcaagccagttttgagctattagatgaggtgtaacatgagctgtaagtagcagcccgattactgtagaaaccgacctgtgtaaatggtgtcttggcttgtgcaatatatgaagaatactatagttcatgcacctattcttttatcctagtattagggccaacatctcctagagacctagaccgagtcaaatcaagggcatactaacacccaatctgccaatctgggaaacaaaaaggcaagaacgacaacaataatatccagccaaccacactttgctgtgaacacgaaaatacaacaaacagaacctaacgagacgagttaatcttgcctaatttcatatgttgccctttaaacagagatacttgaataaacacttgcaactaaaactggagttcatgggataatgtttgaacctttagactgccagtacaggcacatgggctctccagattttttatactgtcttcctcctgacaaatgcgacattccaccaactgcagaagaggttcttcttcaggggccatgctttctccaactgccaaaaaggtatgcactgtagtgggtgcctgcgcagcggcttcccctgatgaattcttggctgccccagtggtctcaaagcattcaggcgccattagatcatcaacatttaccattagatgatccttcattgtttcaaataaaaaaaactactccaacaaaagaattctttacaaatcctatgagatccgctcaaagttcataatcttagttgctagatcaggtgtagccccctgctgaaaaagtgaaaagaaaacaaaagggttcaacaaatgacatgattaattagaaaaacctacacagaacgaatacaagaacatgaaacctacagtaggacagttgcgaagcagctcacagaaatttcttattttcacaaaatgaggcaccaaagtccttggtacgagataaatggggcactaatgatttgagctccacctttctgcatgcaagttcctcaatcagcaaatgttgcagcagaaacaggaattattcatagttcatatgtcataactctcagttgaatagtaaaaagatatataaacgatgtttccataacatcaaaagcaatgcaatgctaaatcagtacagataagataagtccaagaccacacataatggtattgctcagcttatgcaaatggtaacacatgtcccagcattttaatgcgatgagtcacaagtgtgcttacaaaaagaacactaaactataatccttataattccctaaagatttgataacaaaagaataacaagaacgagagtccaccctacatttcgtgcctttgttattgtctctattgtggtataattgctcgggaatggaaaccagtgttctgcagctcagaacattatgcaaatgcaggattataaatgcaatttacaataattacatctcagaaatcatctcaatcctaaatttatatggaccgaaaccgaagataactcagtataaggttacatgaaaagcatatccatgacaaattaatatgaggtttccaagaaaaagggtacccttcttgcctcaggattgatgaaatggaggtttccttccgccaccaccctcaattttatcaaaccagaggaaggaggcaaaaattaaaataaattgttgccatcgtacatcgcgctaccaagaaattacaaatagaaaaatagtcccaaatttcatggtaaacctcgagccaaccttcctaccaatcttgctccacgataaatgcacatgggcgtgcccacccaaatccaaaataccaaatccctcaccgcgaagcaccgaaaagcataataaaccgacgaaattaccctctcccaggggcggatccggacatgggggttcaatccagttgaatccccatacttttgggggtggaaatcaaacttttacttgtaagtactaaggttaatgctctgaaattaagaggaaaagcttcttccagatctagaagaggaagctgtagggttaacgcacgcaaagcaaattcgagacgaaagcgggtgggggagagagagagaggatttggatgctcaccaggatgcaggaacccctcccctgctccggtcgcgagattgaggatcggcgccctgctctgccctcctcgcgagatggagatcagcgctggcgcatggagcggagacgagacgggagtttttcttctttttttttttcttggcacgcgacgggagtttttcttttctttccttttttttatttacgcataagggacagcgacgaaagatttcctttttatattttaaaaaaaagtctgtgtattgcaacgggtgaatgctattttaatcttattattgttgtacggtttagctaagatgaaattcactttgggaatttgcttagattttttttagaaaatcatgaacatcaattagtagtccaactttcatatcaagtaagcatgcggattttttaaagggatttcttatatgactccttttatattttcaaaagcaaacgaatttaaaatccgactcaaacacgaatgatgtaccaaaatattaacaaaaacatcttcaaattttataatagtagagatactaatgtaatactatctcatccgaattaatatctaaagtgtttgttttttggatgtaggaagtaaataaattataggtttgtctaaactattgcttattgcttatgtttggtaggcttggctacggtgcaactgtagccagccgctacagtccctgtgtgtttgttacaaacttatagtgcccgctaaaaatgttacgtacagcgtgacggtggtcaagcctactaaacagcacattattatgtactccctttatctaaaaatatagcaacctataattgattcatagtaataaaatatgtctcatcgggtactaggttactacattttataacggaggtagtaggtgttattttgaacaaccttatttcaaacttttcatttaaaaccaactgttctttataatttggactaggggcccacctttcggtggaattcggttggggatgggtgcagacaacaaactcctccgccacggatgccagcgacacccactggctaccactcttcacatccacgcaccaccaccgccgctccttctccatgagccatcgtcattcctcctctgcacccaatcgcacacattagccaccgacatgtcttctcttgcctcccatcgtaatgcacgcggctattatagtcattgttgagatcggtagcaccgggctagtgaggatttagagaggcaggaactgacctagtggagagtggggacgctgattcatgatcctctttattggattcaatggttcccccagttgctggagagaagaaagaaagatgagagatagctagtgtgtggagcgatgacagtcattggacttaggtggatggattagatgagggtggtctaagttgaaataaaatgtaaagttagctggtgttaagtaaaaagaatggttgaagaatggtctaatttgaaaacttgtaagaatacctagcccaaatagcaatttacacttttttttcagcacaactaaagggcatgttcaatttgatgcatttttaaccataccattttttagtaaagttgtcaaaaaaaatgtctacatttagtttgttgtcaaatttggttaatacataagaaatcatgtcaaaattttagcaatattggcatcttgccaaagttttggtaatattggcatcttgctaaaattttggcattgcaaaacttggtaaggtttattttggctacaatctgaacaggcccaaaattgggttgtccatgagccgacgggcccatgctttgctataccaactatagttttatcgtgtctagatggcatggttgggctagcctatttaaacagaatccaccaaatcccacctccgaaaatcaacgtcggcataccgcttcttgcatagaatgccatcatcctcaaccctaaggaacccaatcgcgcgaccacaaatccaacatccctacaacaatccaatacccaaatcgcaccacgcgctgcaagaaatcggtggaaacgaaatatggtggggagggggggagaagagaggaaatgaaggggaggataatttttacccaaggtacaactttagtgcgactccggagcatagtaaaaaaagagatcggcccgacggttgaaccgggaaaaaccagaaccagtccctagcatggttcaatttgtagaaaagatcgtctatgcatatgaaccagcgaaaaccggttagaccggatggttttatggtgaaccgtcttaaaaaccaaagcgagtcatatcgtaaactgtactagctacatagaaaaaaaattaaattcttggttgggcaattaagagtcaaccccaaaccttttgagaaaggatctgcatgcctatagagtatctccaacatgttatctaaatttgactctttacatgttcatttggccaacttgccaaaaatttggagagccaaatttatctttcaattcaacatgctctccatcatagcaatgggacccacttgtcagtgtctatctccttctcccttcttttctctgcacaatgctcccctcctcattcctcccacctaccaccgccgatagaggcggcgaacattgaaaccgctattccctcatcgattcctacgtgtcgatagcaggcgagcggatctgacggcggcagaggtgtcggtgaaaaacagtggtgacgaaaatgggcagtgacgacgaaaattggcgatggcgatggcaacattggaagggctagagatggggacgggggcacagggaggagctgcgtcaaggaggaggggcggcagaacaaccgtcgagccgccatcgttgtgccctgttcgtcgattcaaatcccatcgtgggggaaggattaggatgagaggcggcgacgcttgtcagctctgtccggtggggttgctattgaggaaaaggaggtggggtcgctgccgctaccattgcacccctctccaccgatcgacggacgcggtggacagagaggagaggcggctccgatgactgcataattgtggcggtggtggcggcggtggggggagaaggatctgaatatgtgacccacctttggcaagccaagaaggcttgctagatttagccagtcggggggttgatttggcaagcaggacgacaaaatctgttggagggtgttttttctcttcacttactaaattttagcttggagagtcaaatggccactctcttggagatgctgctcccacctaaccaactatgcaagaggatcttgtaggtgaggatagaaaaaactactttgagagtggattacaacttaaaaaataattaacaataaatcggcggttcgactggtggaccgatgaaccgacatgctcaccaggtgagtccctggtccatgtttttccaccaagttctggaggcctcatccacaatcttgctcatgggcgtcactaggcccggcgacatccggatgatagtagggtacactagccagtggaggtcacctggcggtgtacctgtctctagcagatatttaaaaattaaataaataaaacgccattttggagtgttacagttcaaacgcaatttaggcccggacagttcaatgtggcattactcctatggtagaacaacatcatggttttcactaagcaagtaaaatgcccgttctttcttttctttctaactcacaaaggaacttggcttttatttaagcctccttgaagcaaaggtcttctgaaggattttcataagaattgaactaaccccatgaaaatcctgtaaaattcatgagttccaaaggagccttctcatgacgaaatacaggatagacaaataaaaaatgaagagtgaccaataaaacatagtcatcttcattttacaagggcaatgcttggttggatagaatagagcaaaactatatgacaggctctagaccgtttcacacaaccaaacgcatcatcaaggaaaagaatgcacgaaatttgaaagctagtcagcatcatcagtaaataagattgggtcaataggttcacattttctcatgttgagattcaattcatggagaatcctacaagccccatgaaattcagggcaagaatcatccccgaagatgaaccgatgcacccgtcctcccacctcaacacaactctctcccgcaaccttcttcatccctccttccctcatcaccctccttgccttcgctgcctcgtcccatgatccaatttcgcagtagatgtttgaaaccatgacgtagttcccgcttctccggggctctagctccagcagtttgccctgcaccttgtcaatgatctcaatacagtccttggagctatgcagctggcaggctgccaataatgtcctccacacaactgggtcagcctcgactggcattcctacaacaaagtcataagcttcctggagaagaccgttgcggcctaggacatcaaccatggcgctgtagtgcgtcatcatcggcacaataccataaacatgctgcatttcgtggaagaaccggcgcccctcatcaaccaggccagcatggctacatgcacaaagcagaccaagaaatgtgacataattgggtatgatctttgagagtttcatcctgtcaaacagctccagcgcttcctgagccaaaccattctgcgcaaaccctacgatcatggcagtccatgtccagacattcctcgcgggcatcctctcgaacaagcgcagggcataactcaccgtggcacacttggagtacatgttcactgccgccgtcccaagctgaagcgtcatgtccagcctccgggaaacaacctgtccatgcgcccacttgccgagcgccaggttgcccagctcggccgcggcggacagcatgaccacgaacgtggtcgggtccggcacggaaccagcctctagcatctccgcgaacagctcgacgcacagctcgtggcggccgttgcccgcgcaggcggtgagcgcggtgttccaggacacgacggtccggcgcggcatttcgtcgaacacctgcacggcgcgctccagttgcccacaggccgagtacgcggccatgagcgcgttcgggacgtacaccaccgcggaggcgaggccgtccttgacggcctccgagtgcacggatccgacaacggggagggatcccggggcgaggcgcgcgagcgccttgaggacgtgcgggagcgtgtgcgcgtcggggcggagacccccgcggcggaggcgaaggaagagggcggcggcggtggaggggtccggcgaggaggcgagcgggggaaggaggaggttgaagaggtcgagggatggggaggggagggagaggaggagacggtgggcgaggtggaggtggggattgggcagcgaaatgaggcggcggaggaggacggggccgagggaggggaagcggccggaggtgaggagatgggcgtggatctgccggagatgggggacggtggtggcgccgccgccgccggcgatgagggcgtggaggtggagagcggccattccatggaggttgcgcggcggcgcgcgacggccgacggcgatttggtcgtgggggaaagcacacgctgcggttgctgttgggcctaacgggcccggcccgctcgatacttgcatctgcatcttttggaaaaagtacagcgaaggtccctcaacttgtcatcaagttacaaaatcgtccttgaactgcaaaaccggatatgacgtatcccccaacttataaaaccagtgtaaaataggtcccttggcagtttaacttcggttttatccgatgtggtagctgaatcagcgtgggacccacgtgtcagcctcttcttcccctcccctctccacctctcttcctctctccttccctctccacgggcagcgcccggcgaagaggagctaggcgcgggcgcgcggcaggccagtgcggcgggcgcgagcaacggccgacgggagaggagttgggccacggggtagcgggtgctcatcaggcggaggacgtcgatcgatggggatggccgcgccatggcctccttggctatggcggtccccatgaggccacaaacgacgatgactagaagggtagaacctgggaggaggtcgagcgcgggtctcctcaagcgatggcggcaggggctcctctctctctctcttcctctcgttcccttcaagcccatgacttcctcggcaagctcctccagccaccagccctcgacgggcacggcagcggtctcaatgggtggactcggcggagggtgtggtgtggacactgctcactctcctccagcggacggggattgtggcggcgagcggggtggaattgaaggcccttcaaagcttgtttggtaactcgagggaaggggattgagagtttacacgagagaattgataatgagattaagatgggaatttgatttttaatcccaatatcttgtttggtagaggttatggaaattgatagggagtttagttggagattagatcattaataaaaatggatgactgagatttgcttagattaagtaaaggaggaattccctcccaattacctgctcctacccacgtattgaaaaggagggagttccttcctcaattccccatccccatccccatcccaccaaaattcccatgtctcccaaccaaacaaaacacttaatagcctcatccctctaaactcccaatccctcctaaaaactccctccaaccaaactataggcgatgtgtttggtgggtcaactaggcggaggagacgatggggaagagaggaagggatggccaccaccttcccgcgcgctgatccgccgcccgccggtcgcgcccagctgctccccccgccgcctgcgcctgcccacgcgctgctctgccgcgcccagctgctcccccaccggccaccacccatgcagctgctcacccgccgccgctcgtggagaagagaggtgagaggaagagaggtagagatgggaggggaagaacaggctgacgtgtggggcccacgtgggttccacgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 124 - DNA, 2268 bp, Oryza sativa
  unsure (1)..(2268): unsure at all n locations
cgcgtgnnatgtanncactaagaacnnnnnnnnnnnnnnnnnnnnnnnnnnnnnnnnnnnnnnnnnnnnnnnnnnnnnnnnnnnnnnttggagatgttctgtaatatgtgatgatttggatatgggaggggatggtgtgaaatcaatattcaatattaaaagcagaaaaaaaaagaaaaaatatctttagtcccggattcttagtcccggttgaaaaaccgggactacaggggggttacgaaccgggactaaaaagcatttctccaccaatgtacggttcaaagatgattttgtaactcgatgataagttgagtgaccttcagcgtactttttctgcattttttttgtcacgttaggtgatgaacatgggccctatttttctattctcaataattaataatcctgaaactgaataagtggtaattacttgtactttctccgtttaatctggattcattaacatcaatatgaatatgagaaatgctagaatgacttacattgtgaaatggagggagtagttgctaagatttcgtaaaatataaggtggacgctgtagccaaaagcgtccagctgcggatgctgttgcggagtggtgcgagctagctgctgccagcgtgctcgccggccggtgagcccatacgaaccagatctgaggatgttgttgcatgaatgcctttatactgctgttgaattgttgatgattactcgactcaaaagaatccaatctagttcaaatccgttgtattaattgtgttccatccaagtgctaggttagattttttgaaacagagggagtatgatgctagctattgctgtccgtgttttgtttgctgttgatgcatgcatgctagtgctgttgttgatgaatccgaggaaaaaaaatcatttctaaaccattctatttatgtcggtggaacggcttttatgcgggtaattttctttttcttttgaaaaaaaaatattttttagccgggtgacataaggacaccgcttatgaaaaacctatttccacatgcggccgtcttcatctatccgtttgcaaaaatagctttttctaggtgagcggccatcctcctgtgaagatataatattttcgcatgcctttgcttacaagcggcgtgtgtgaccacctgcaaagagcaattttggccgcctgcgaaaattgcttttctagtagtaacaatagcaaaagggagactccaaattgtatttggatctaccaaaattaaccctttcattcattattgagtactctctccgtcccattttaagtgcaaccataagtttccgcgtctaactttgaccgtccgtattatttaaaatttttttagaattagtattattattattattatgagatgataaaacacgaatattactttatacgtaacttatgtttttaaattttttcaaaaaaatttcaaataaaacagactgtcaaagttgtgcacggaaaatcatgtctgcacttaaaatgggaaaagggagtagtaatttaaggttatatttatgaatttatgataaaaaagtatgctattaaaaatatgtactcagtataggtaaaatgcgctactaataatacaaataaaatatcatttccagtatgatgtctaattaagatgaatgaacaatgtttttttttcaaaaaaaacttatgtactttctttaaagtaaaggtacacaacgtacatgagagaggaagtcgacacatataacttccagattgtagaaaagaccctaagaaatgggcaaattaaccttataacacaaaatatgtaaaagaggacttaaaaaacttaaaaagcaatcggatcctactttttccacaggaacggcgagccatcttgtgccgacgtcgatggggaggatgattccatggcgagctgcaaaggagagagccgaggagcaaacccagtcggggcctccgcagtggaggttgaagctaccttggccaaacaagaaaaccacagctgcccccagaagacgaaaaaccgaataccaaggaaagaacaccgttcttctgtgttggtcaccagagaaaagttggacggccgacataacctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttcgaaatcgatgggttggatcgtagncatcccncgcggtgatgttaattgggtactaatccgct

SEQ ID NO: 125 - DNA, 748 bp, Oryza sativa
  unsure (1)..(748): unsure at all n locations
gcgggtncnnattgagttcgcccgcgtncgnnnnnnnnnnnnnnnnnnnnnnnnnnnnnnnntataaaattaccaagtataaacaactgtgggaattgttcaggtgtcagatgagcaaaggcaaatagagcagcactgacaagtgtgcaaacgcgggtcccataaatcggtgcgcacgctgaagtcatcgaatcaaagtgggttcgctatcttgggactgcagtagtcaaacacacaatggagctgctctaagggctttcgcagtatgcctaggtggtgtttgtcccgatttctcacgtcggagattctagtctgcctctccgttaccaaatgaagatccacggatcccttgaggcacgttcctcgttaggtttgtcgcaacaagacagggcatggctcgcacgttgcattagaagagggcgttgccctatgctgatgaggacatactccactattacccgctggcaaagacgcaaaaatcgggcggcgaccgtttgagcctctgaataatcccaccttgctttgtttagcttgggaggaggaagccaccttaaaagggagagccaccctttcccctatcggactagtcttttagggagattggacctttttccgagtgggtgtgcctatgaactgttggggtccgggcaaccttaagttattgggcctcggcaaaccccacctgggccggattgttatcctttggtatcagagcttggccctttgttaaggnggtgggaantgatgn

SEQ ID NO: 126 - DNA, 698 bp, Oryza sativa
  unsure (1)..(698): unsure at all n locations
gcgggaatttgatttgtatttgtanaacnnnnnnnnnnnnnnnnnnnnnnnnnnnnnnnnnnnnnnnnnnnnnnnnnnnnnnnnnnnnnncggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagccaccggggaaacgcctttcttcctcgtctacggcgcggaggcggtcctcccatctgagctcaccctgaggtcccctcgggtcaccccatttcgcaatgcggccaacaacgtctttgtttctcacaacttcaccaagaggaaaagaggagacaactgtgactctgtgggcttgaaaatagtggcgtagcttccttgatgtcatgatgactgcgtaaagcagcttttggatctgtgggtatcttgtctttgcgtcgtggagagcttcgctgacgtaataaactga

SEQ ID NO: 127 - DNA, 1497 bp, Oryza sativa
  unsure (1)..(1497): unsure at all n locations
agcggnnatgtanttcnnatgatataacactcaagctatgcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttatgtgacgggtggtgacaatgagtccgtgtcgagcgctgattttttcggcctttacagcgagatttatacaatagaatttggcatgagattggattgcttttagtcagactcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaccagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaaaagagtcgtgtaaaatatcgagttcgcacatcttgttgtctgattattgatttttcgcgaacccatttgatcatatgacaagatgtgtatccaccttaacttaatgatttttaccaaaatcattaggggattcatcagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 128 - DNA, 845 bp, Oryza sativa
  unsure (1)..(845): unsure at all n locations
ncgcccgtnnttgttgtanaacnnnnnnnnnnnnnnnnnnnnnnnnnnnnnnnnnnnnnnnnnnnnnnnnnnnnnnnnnnnnnnaaataggtttttagtcccggttggtgttactaaccgggactaaagatcatagggccctgacacagcctgacatggaatcaaccgggactaaaaatcatctttagtcccggctagagttaccaaccgggactaaagatgatttttagtcccgggtggtaacaacaaccgggactaaagatcttcctcttattaaccgggactaaaaatcatttttagtcccggtttttaatggaaccgggactattatggatatgggtcgaccgaccaaagatggtttctctaccagtggtaaaatcggatatgacgtatcccccaatttacaaaaccagtgcaaattatatccctcggtggttttgaccccggttttgtcagatgtggtagctgactcagcgtggaacccacgtgggccccacacgtcagcctgttcttcccctcccatctctacctctcttactctcacctctcttctccacgagcggcggcgggtgagcagctgcatgggtggtggccggtgggggagcagctgggcgcggcagagcagcgcgtgggcaggcgcaggcggcggggggagcatatgggcgcgaccggccggcggcggatcagcgcgcgggaaggtggtggccattcctttcctctcttccccatcgtctcctccgcctagttgacccaccaaacacatcgcctatagtttgggtggagggaagttttaggagggattgggagtttagagggatgaggcttataaagggtttggttgggtg

SEQ ID NO: 129 - DNA, 967 bp, Oryza sativa
  unsure (1)..(967): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccatctccgccgcccgtgcctctcgcgccgagccggcctccactgccatcggctgcacttctctgtgccaagccggtctccgacccctccaccgaacggggccgcgccgaccagatgcggccgtctcccacgccctcggctagtcaaccgaggccgctatgcctccggtgaccgcgaacacggtcaccaccaccacagccgctgctgccgaacacccaaccacctcgccgtcatcatccccacctcgcacccgactccttccccgccgccgacatcaccaccgcctccgcaaaacctttgctgcaccgtcgccctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 130 - DNA, 1002 bp, Oryza sativa
  unsure (1)..(1002): unsure at all n locations
nttagcccgtgaggattgacnttctnnnnnnnnnnnnnnnnnnnnnnnnnnnnnnnnnnnnnnnnnnnnnnnnnnnnnnnnncctccttttcccctttccttcctttttcccctctcgccggcgtcacctcctgtcgccgctttggacgctagccggagcgccagctcgccggcttgaccgcccatgtcggttcccctctctcaaaccgacattgccgcccatttaaacccgtcttccccctcccttcctttcctctcccattcgcctcctcaccgttgccgccgctcccgtgctctgcctcgcctctgccgtccatcgccaagcgccgggtgagccggtgcgttcgtggacgcggaaggggactccgggcgcgccctcttcttcctcttcctcagcccgaggccggagagatcactcccgcgccgtcggcctctcgtcactgcgccccgtcccgcacggtagtgtctctctccgttcttcctcctcgctccatctcctccccctagctttcggtagtagctcgagtagactccccgtagctagccggcgccgccccgaccgttgccgtcgttcgccatgtgctcgccgccgtcgccgcccgagctccgtagcacccgctcgtcgccagcctcgctcggcgtagctccgtccaatccgacgctagcatcggattcccgtggtcgcgtagatgctctcaccgccgggaatcgacctctcgtgacctcgtcgccgtttccctcttctcccgccgctggttgccgacgccgcaatccgccgccgtcgagctaccttcggcgaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 131 - DNA, 875 bp, Oryza sativa
  unsure (1)..(875): unsure at all n locations
caacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgacctagtgtagagtggggacgctgattcatgaacctctttattggattcaatggttcccccagttgctggagagaagaaagaaagatgagagatagctagtgtgtggagcgatgacagtcattggacttaggtggatggattagatgagggtggtctaagttgaaataaaatgtaaagttagctggtgttaagtaaaaagaatggttcaagaatggtctaatttgaaaacttgtaagaatacctagcccaaatagcaatttacacttttttttcagcacaactaaagggcatgttcaatttgatgcatttttaaccataccattttttagtaaagttgtcaaaaaaaatgtctacatttagtttgttgtcaaatttggttaatacataagaaatcatgtcaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcn

SEQ ID NO: 132 - DNA, 918 bp, Oryza sativa
  unsure (1)..(918): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccgtggcgccccgtcgaccactcgccgctcctccggctgcgccgctgccgccaccgccaccgcctccagctccggcgatggcacgaaggattcctggacgcgcaccgtgatggcctccggctccttgacgaaccctcggaagtcacgctccgtcaagaaccggtagttgtgcgtggtcgacacgatcatcggcgccgccgccgccgcctccacgacctctctactctgctcctcttcttcctcctcctccatgaccacctctctctcctctgcatcgcgctcgcgttcttgcttcgattccatcgcaatcgccggcttcttctccggctcgtgttcttccaatacttgcacaggtatttcacccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 133 - DNA, 984 bp, Oryza sativa
  unsure (1)..(984): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataaaaatcgaagtgataagccttctccggaattgtgtataggttcagggtggaatttgcaaaagtgaaccacaccgcttcttctccatagtagagagggctcttgcggcggcggcgatggcggcgacggcgagcacgtccggcgagtggctgaagggcgcgctgcaggagctgcgggagcggatgggtggcgcgctggagctcgacgcggacctcatctcgggcctcgtctccttctgcgagctcgcgcctccgcccgacgccgctgactacctcgcggtccgtacccatactatccatcatcccccctacgatgatgcgcagctatgcaggggttactctatttaggttctgatcggagatggttgtgcgattgttagtttgtttggtgtgtcgcgggtggcctgatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctactt

SEQ ID NO: 134 - DNA, 850 bp, Oryza sativa
  unsure (1)..(850): unsure at all n locations
ccggtggcggccgcggacgttggggcgcatggttggtaagaaagagtgggaaggtttggtgggagcaacggtgaagttgaagtggagaggaaccgaacgacgtggtgctgccgtcgactcgggactccaacgttcgctgccgtcgttttgtcgcgtccatttcctctcctctggtgcaggtttcacctcgttttttcgtctctttcgaattttttttctcaaaccactatggttccttttttttctcttgattaagatacatgttttatctggtgttaacacgtttttccaaaccattaaattgtatattttatacgaaaactttatattgtatataaaaattactttaataattaaaacttaattgattatgatctaatgattttcttattttatatgtcagtactcaatctcatctaaacgcaaatggctgataggccacgtatatgtacttgtatccgtatcactatagtacgtatccatatctaatacggatacgtggcctatcagtcatatccgggtacttaaaaaaaacgtgcgccagtcgtctgtggtttcgatgtcggcaacggcgcgttctgcctcggtgacctccgagctaatgtcgggggtgttcgggctgaataaaaaaaataacctctttcactgatggctttgtcaggatatcgagaaaagtgccgggggtgccgaattcccaagtctggnggggctgctaagcagtgactaaaatnggggcgcactgggnggnngnnnnagcactacgacatacaaacaacgtactcaaactatggaacaagataccaaagcaaaacagaactaagtacgcaacgagatagcaagggtgggagga

SEQ ID NO: 135 - DNA, 1081 bp, Oryza sativa
  unsure (1)..(1081): unsure at all n locations
atnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttcttcgtaattgtcaaagatgggttcagatgaatgaacgtccgggcttcttaccttggcatcaagaacagcagcatggcgagacgaggcatcatccaattctgcgtcagagattgcttctgggctcctcctcttgacatcggagacagattcgtacgaatgatcatgtatcgggatggtttccttctccgaatgatccaagctgttctcatcttcagattcggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 136 - DNA, 984 bp, Oryza sativa
  unsure (1)..(984): unsure at all n locations
caaagggtgggggatagggaaagtgtccgactcaaacggcctgactaaagtcgttaactgagaacgccctcttcaccatgacatccagagtaagaggcatttgtcaaagatagatttctttaatcacaaaatactccttacagttttttcccaaatatttcgctacattacatcttttcctaagatatttgttatagggtacgagtactaccaagaaggccaacgtcagtccatagactggaagatcttcttggccagcggcgacattgaccttgccagatagtctatctccgccggagtcctccgagaacgagcaaaaccctcacgaagatattcgaggtccaagtgtgggcgatgatcttgtaggcaagccaacacgtgccccccggcatatcggctcgatcgacgacactcctgcttcaaggcctcgtcgatacgcttgccgattccatcgagttgggcataggccctattaagccacgagatgtacccggccaccgactcctcgggatctccgcggactactcgaagctccctgcatactctggccatggatgtgcagcaactcttcaagtacgagttaaaccatacctcacggcctcggagcgtttccacagcctgctctttcttcacggccagcatggttctctcgagctccgccacttcaaacttcgtcttccagtattgagttttacacattatctaggaaatacaagaagtcctactcttcaaaaagggggagaacagactccccagatcaccgacttcttcatcacctcttacgcgtgttgctggccggcccctagtccaagatctcgcgcagatgagtttcaggacgcacagccttacacacacgaggacatgacacgccccggtgtagaattcgtttgacgtcttcttcgcaattcttcccgcatgctttggaggggattttccccatcgctgtcggcaggttccgcgagagaagaggtcagcgaaaactcn

SEQ ID NO: 137 - DNA, 1051 bp, Oryza sativa
  unsure (1)..(1051): unsure at all n locations
nnnnnnnnnnnnnnnnnnnnnnnnnnnnnnnnnnnnnnnnnnnnnnnnnnnnnnnnnnnnnnnnnnnnnnnnnnnaggcgcactgtctcatccgtgtcgtttgagaagcactcacttaaactttttagaaaagagttcaaataaaataaattgcgaaaacaacagcctctccttgaagcctgcattaaacacttatttccctggctttgctgagtacttccgtactcacccttgctctatataaatgatccccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattagcaggttaatttggagcgtcacgggctagttccggtcgggactagttcggggcgtgacattgaggagataccatgaggtaccaaattttacactaattttgagtacctcatggtacctcatagtacctagatactaagaggtaccaaatttacaataagaggtaccaaatttacaataagaaaagtggtaccttatggtacctccttaagtnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 138 - DNA, 799 bp, Oryza sativa
  unsure (1)..(799): unsure at all n locations
cattttgcctccggaatccagctatggcattgggtccgccaatgttatataggtgccgctatgggaatcctcagcgttatgcatccacgggcgttgtgagctccccggaatccaaccttataagattccgaacccctcttgttagaaagatgatagatgcaaaccctcagtgtgatactatgatcaatttatgaccagtgattttcttttggaaactatcgaagtatttattacattgtgagattattattccatttccataacatttctgattggtatgcaggtgttgcgttgggtttttcatagtccatgaaaccaaagcggggttcttggtggtttggaacgtactggcaaaggaagtcgtttatgacagcgacacggtcttcaaaacataactttaatttcttgtttctataaaactatttatttaaaaatgatatatgtatacttttatgaaagtatttttcaagataaatctattcgtataatttttaccttttcaaactcaataacttgagagttatttatgatttatattcctaaggttcgacttaaacattgccctaaacgacttcctttacgagtatagagggagtacaaactctagaggattttgggtggcgtgagggcaggttcattaaacacttttacccagtttgatgggtcaccacttgaatggagccatttgggtgatcgaatcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttan

SEQ ID NO: 139 - DNA, 829 bp, Oryza sativa
  unsure (1)..(829): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatttcctccaaactttttttatgcgggtcccataaatcggtgcgcacgctgaagtcatcgaatcaaagtgtgttcgctatcttggtactgcagtagtcaaacacacaatggagctgctctaagggctttcgcagtatgcctaggtggcgtttgccccgatttctcacgtcggagattctagtctgcctctccgttaccaaatgaagatccacggatcccttgaggcacgttcctcgttaggtttgtcgcaacaagacagggcatggctcgcacgttgcattagaagagggcgttgccctatgctgatgaggacatcctccactattacccgctggcaaagacgcaaaaatcgggcggcgaccgtgtgagcctctgaataatcccaccttgctttgtttagcttgggaggaggaagccaccttaaaagggagagccaccctttcccctatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 140 - DNA, 722 bp, Oryza sativa
  unsure (1)..(722): unsure at all n locations
ttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaaggttagcggcgaagtcagcccgaacacccccgacattagctcggaggtcaccgaggcagaacgcgccgttgccgacatcgaaaccacagacgactggcgcaccccactaatcaaattcatcagcagcgaggagttgcccgaggacgatacagaggccgagaaaataacccgtaaagcaaagatctactgtatggtcggcaacgatctatacaagaaagcgccaaacggggtacttctcaaatgcatctcgaccgacgacggtagacaccttgtaacatcctgaaaattcctgacattaaaaatcactaaaatttcgaactttttaaaactttttgcatcatgctggaagttatggttgttattgcttgccaaaccataaataagaaacaatggaagngtttctttctaaagatttacacccgagcaatagttannnnnnnnnnnnnnnnnnnnnnnnnnnnnnnnnnnnnnnncggtgtccaatcaatttcagtttctt

SEQ ID NO: 141 - DNA, 736 bp, Oryza sativa
  unsure (1)..(736): unsure at all n locations
cgctgtcaggatgaacacatcttgctnnnnnnnnnnnnnnnnnnnnnnnnnnnnnnnnnnnnnnnnnnnnnnnnnnnnnnctgcaggatggggaggccgccgtgctgcgacaaggtcggggtgaagaaggggccatggacgccggaggaggacctgatgctggtctcctacatccaggagcacggcgccggcaactggcgcgccgtgccgacgaacaccggtgcgtgttcttgcgttcttgatcgatcgatcggcgagagatccgagatttttgttttcatctgtgcgcgtcgcgtgtgcaggtataaggattatagtttagtgttctttttgtaagcacacttgtgactcatcgcattaaaatgctgggacatgtgttaccatttgcataagctgagcaataccattatgtgtggacttggacttatcttatctgtactgatttagcattgcattgcttttgatgttatggaaacatcgtttatatatctttttactattcaactgagagttatgacatatgaactatgaataattcctgtttctgctgcaacatttgctgattgaggaacttgcatgcagaaaggtggagcttaaatcattagtgccccatttatctcgtaccaaggactttggtgcctcattttgtgaaaataagaaatttctgtgagctgcttcgaaactgtcctactgtaggtttcatggtcttgaattcgtctgcgtanggttttctaat

SEQ ID NO: 142 - DNA, 740 bp, Oryza sativa
  unsure (1)..(740): unsure at all n locations
cgtgtcnttangatgactaacctatagcnnnnnnnnnnnnnnnnnnnnnnnnnnnnnnnnnnnnnnnnnnnnnnnnnnnnnnnttcttttgtcggatggatttaggatcaatcaaataattacagtgaatcatttgtattattatgaacatattttatttgtcacaataaattatgaaaggttaataattatccagccccgatcttgacggtcttgtcggggttggcactggagagtggaacaatcttgatggcaccgtctggtttcggcgtcttgtttgtcttggtcactttcttgggtggctcagtcgtggcgggtgggctgggcgtttgctcgaccatgtcgaggctccgcttgtcgcattgcaccgccagctttgcgttcccctgaatagtgattgttcccttcggtcccggcatcttaagcacttgatatgcgtagtgagatgcggccatgaacttcgcaagtgcagttctcccgatgatggcgttgtaagctgtatcgaattcagcaacatcaaaggtgatctgttctgttaggaagttgttggcttggccgaaagtcacgggcaacgtaatcttgcccaaaggtctggacgatgattggggagtaattccatggaagggttgatcagttggtgtcaacttgttttgcgaaattcccatcgcgtccaaagtgctggcaaaaaagaagattgattgagctgccaccatcaatgagaactcgcgctaccttgatgt

SEQ ID NO: 143 - DNA, 725 bp, Oryza sativa
  unsure (1)..(725): unsure at all n locations
agagactgaaattgaatgcacctgacacaaaccnnnnnnnnnnnnnnnnnnnnnnnnnnnnnnnnatctatttcaaaatttaacaccgtcatgtgacccaataagatagcttgagacaagccagcttgtggagattatggataccccatatctacatgacggttgtaatttagtcggatatacggtatcaaatatagatggaatatctctatgaagactcgggttaggttctaaacttgtatgtcaaggaaatacccgggatcttagtcggttacgattgtattttatctataatcccatattccgttaggatatggactgtattttgtaaagcggactccttcccctatataaggagggtccgcgtgcctcttgggaggtgattctttttcccagtctatacaattaataacacactcggcggaattatccccggacaggagtagggtattacttctttaataagaaggcctgaacctgtataaaatttcttgtctccaaacccatccattttcctagcttgacagccacccccttttattattgccgaaatcttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 144 - DNA, 900 bp, Oryza sativa
  unsure (1)..(900): unsure at all n locations
cctcatcttgtctatatctattttatgtttctttgtttagattcagatttttcttattatttttaccnacccccccccccagatgcncnntttgatgattgtagctcctccgnnnccagcnncnnnagacncgaggaaaacggcaccccaatcttaaacgnngaaaattatggtaagtgtgttgtgtctgacaactaaaacatgtcaatagcgtggacattagctttctgttctcaactggacatttggtgttcgcgaggatttttagttctattttctttatttgtttcatattgctcatcttcgagtgacagtgcttgccattaggtaaatattatgcatgaatgcatctgaaattactgttgcttagtcctttgtcctttgtctttattcttcatcattgatcatggtcagtgtaatggtgcagaatattattggagtagaagctgctcaagaccttattcaggagtacttgcagaggaggggttacattgatccattgaagggcaatgaaaacctacaatcatcaaatcttcagccttatgtgaagccttctgctgaagctgggcctacccaaaccaagaagcagacacgcacacaaaaagatgcagcagcatcttcttctggccagagttccaaggatcaaccagagactactgaaccccgagttgcttcaagagaggttcaaaaaagaaagcagtaaaggccatctcccttgctgagcagcgaaggttctattgtcttcaagcaagggaaaccttgttcatgccaagcacgccaacacaaccttgttagcaactggttattatgtggcaaaaatgtgtgtgaacaagaggntgaaggaccatgcaatttttgtgtgcacttgttctatggaagcagcacatattgctgtttaaa

SEQ ID NO: 145 - DNA, 721 bp, Oryza sativa
  unsure (1)..(721): unsure at all n locations
gatggcgaccnccttttgattagcacatgcgcctgaggannnnnnnnnnnnnnnnnnnnnnnnnnnnnnnnnnnnnncattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctggtttatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggccttcagaagtcgcgccacctcttcgcggatgaaggcttgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 146 - DNA, 731 bp, Oryza sativa
  unsure (1)..(731): unsure at all n locations
gtgggtnnnnnnnattgaaccattctnnnnnnnnnnnnnnnnnnnnnnnnnnnnnnnnnnnnnnnnnnnnnnnnnnnnnnnnnnncttctgctttacgggatagaggcccaacagtagtttggttggctgcgtgttcacttcaccatacggacttcattttcgtcgattggtgatccttttggactttggagcgtccacgttttcgtatggctcccacgaaaaactggttttggtcgcagaccattctgtttcgtacaatagtattatcttttttttattacgtacacgggcgacggcacagagctgcctaacccgtggaacatcgaacaccttcgtcgcttctacccctagtggggatcgggcatcatgtctcgggctcgggccaaccccgcaccccccccgggcgtgcaggattggccgggggctaccacatgcatatacttaccttttttctcttccgtatttcaataaaagcatttttgatttcctgaggactgtgtctgtgccatcatttccttttgaagaatcttggcttgaattagcacgctcgtgctcgaccttgccctcggcggcccgggccggctaaaatcgccaaacggggcccagaaccgagccgtgccctggggcatggtgaactccgagggggaatcggcaaaggcccacaatccggtcatccataaccctcgtcaccgcgctcccggccttgccagtctcgacacgaggatctccc

SEQ ID NO: 147 - DNA, 763 bp, Oryza sativa
  unsure (1)..(763): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttctctgttagtgttacttcagatatatggagtagtggagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgaatgaaagaggttttgcaatgcggccggtgtgaaagctcgtaagtttgccaccgatgcagagcatcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 148 - DNA, 914 bp, Oryza sativa
  unsure (1)..(914): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtactctcatctccctatatcacttacaccaaactaacttgcagctattaattgttctctcattacatttactcaatttgttgtaatataatcttattattctttatgcaacattatcttttcatgttgtgatgaagaagcattaatttggtacctcctaatgattgcagtaggagaatttcatcacgaatagctcgattcagtctcacaaagaatggacaaccagcaacatccagaccaaaaccaaaggatactgctccgaagactccaagtatgtactataagccactaatttacttcaacagattggtaactattactgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntat

SEQ ID NO: 149 - DNA, 1702 bp, Oryza sativa
  unsure (1)..(1702): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccttaacttataaattgttgtttaaaaggaataattagaaatgattttaaaagcctaaaagagaagatctaattttaatttgctaaatctcaatataaaaaggggccagataaaatttcattaaatactttgcttaattctataattcctagatttttctgggatttatttgagctaaggaagtatttttaataaatggaattgcatttaagaaataatttaattgaaaaaggttttaaaaagtcttcttttggctttgggccgaaagccggcccaaaacccttctctctctttccctcggcccagccggcccagtccgccgagccgccgctctcctctctctcagccgctgacaggtgggccccacctgtcaagttcgtctttctcgagccgccgctgccgcccgaaaccctagcgcgccgccgtcgcccgttccttccaaatccggccgctcctttccttctccggccgaattgattgaggggaaacaatctgggggatctggtctaccttttctcctttggaaacatcggctaaatcgttttggaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgtcgtcggtcgccgtcgccaccatcgggttcgccaagtcatcgccgtccccgtccaccgcttcgccgccgccgaagaccgtcggagcgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatcttaactcagtttaatgtggttcaagttgcaaaagttgtttaaaatnnnnnnnnnnnnnnnnnnnnnnnnnnnnnnnnnnnnnnnnnnnnnnnnnnnnnagcgagaggataatcaatcaatncgcg

SEQ ID NO: 150 - DNA, 3500 bp, Oryza sativa
  unsure (1)..(3500): unsure at all n locations
cgcgctctttgatagcnactgcgcntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcgaacggaccagcatgtggcacgcgtatggggtatccgaggagcagatgagcgccagcggaaacttctcgtactttctctcagacgacgatgaggagctgagaggaaaaaaaagaagaagataagaggaaaaatgaagttgatgaatttgacagatgggtcctatgtgtatatgaggatgaagactgagatggatggaaaacatgacagtagtgcatggcccaaattttgtaacattttaatatcacggttataaatataatagacgaattatagtggtatttatctaaatcagcatatttatatggcatggatccaattaaacctaaatctatttgtcttatagtgcaagtggctcagtcatcacatgttttcaaattatgaagtggtccaatttttacactcaacagcctaaaattcaaaaacaaatataaaattttccacctctccctttccctacgcctctcctcatcacttcgtcggcatccctacaccttccatcaacccatcaccagcgatgtgctccttggcggtgctgcctctcccctctatctcccaggcgccacaacctctaccctctcccagcgatgcctcgatccatacgggcgacaagctccctgaggtggtgacgagcgggtggccgcgataggcacgatccctggtggcggaggaggcagccccccggcactcccccaatagcgatgaaccgagagcaggttgtggattgactgagtgacaaataattgagcttgcaacagccatcatcatacccttctcttctccttcgctgttcgccgcgacgctcaacatctctgtggtagattgaagcggtcgatgacggatccgtcctcatcttcctcccttccacacttccatgccatctctgcaatgaggtcggtgtagcgtggtccggtggacaagtggatatggctgctctttgagtcatcatgtccagcggcgcagcatatcgggccggcgagcccctccatttccccgttgacttcactcgtcaaggtggcttcaaccgctgtcgattccttccacagctttcatacacacacacacactctatctctctctctctcctcttcccagtcatttgtgcatgtgctttttacaggtttttcaagctaaagaacgggcgatcagttttgactacacgatcgatcttcacgggttttcctgtgtggagaacatggtgttgattattcagttcgaacaccatgaaggcgcgctgggaacgccctactagcgttcgtactctcttcgtgttggtgtcttggtagtgtttggggtatatgagtatcctctaccataatgtcactagcgtaggtgtgtgggtcccacacttctactctcctattgcctcacatgttggtgtctataataacagtgtcattatagtacatgatataaacccatttgggatactagtaggctgtgtttagttcacgcaaagtttggattttggttgaaattgaagatgatgtgactgaaaagttatgtgtgtatgacaggttgatgtgatgaaaaaggactgaagtttggatccaaactttggatccaaactttggatctcaacacagccatagtataccagtatcttggtaccctactactcctttgccacctctgtagctacgccgattagaagcatatacgatggagtgggacccacgggtcagtgcaacagatactcattctttttttttttccgttttcgttttcgacggatctgctactacggaggagtacatgctctgcactgtcgaaaggacggccatgccctgtcgaaaccgtgttccacgacgggaggatggcgtcacgcagagcggcagcctcgagaagcgtgccaattcgtatgagaaatttttcccttcagcatccgtaccactctcctcccataaaatttcttgcgtgcacgccgcttgcgtcacgcgtgcgtctccagcgggggccatcggctgtgtattttgaacagtaaataaatttgtgatcttctactactgaaccgggggaatatggaccacaacgcaaggcaaggcatgtgcattcccgtcatggttgataattaacgcttagcacctctggagttacagatgcacaacccgttaattaagccatctttacatttggtgttccattttctgccatctttacatttggtgttccattttctcaagcttgttgccgtgagttataacactatacacattacagagtcgaagtatacagtatacgagcggttcaacttccatgccaacgatggttaggccgtgtttagatctaaaatttttctttgaacttttaacttttttatcacatcaaaactttcctgcacacataaatttttaaattttttattacatcgttacaatttcgactaaactttcaattttagcgtgaactaaacacagccttaaccaattcacgttcggacgttcccactgtggtccagaggcctagaatccgtatccctacacaaggcgataaacaaaggcacaaacatttatttgaccggatcagtgagcgctcgtgctccctccataaaaaaaaaagagacaaactctgggttttttttgccaattttaactgtctctcttatatgaaatttttttataatttatatttttattgttgttagatgataaaatatgattaatattttatacgtgacttgtctttttaatttacgttggacacgaaaacatggtttgtcttttttttaagaacggagggagggagtacatgctacagcgtactaccacatccatccgcgtcacacacttccgtcgttgcgctggtgtggagtgtggaaggggttagccgagctgctaccatcgcgggtggggtgggcgtgcgtcactgctcgtactacgtttgtttttagccggttgccggatcggatcttggcgtgagttctcggccagactcgggctccaaaagccgtgccgcggagtgggaggcgagagacgcgagcccccccccccccnncnnncnnaantngtgacttggggttgcgcggctatatactgctattggccctcgccgcgctcaggcgggggcgaggttctttcgtgcgattgatttatttgcgcgagcgacgccgtttaaatcttgtggcaataagaattttcttttttttttttgatgtcctactccaggcttggtggtgaacccttcggggttgggaccaccttgcttcgtttgtgctaggcgttgcttagattttttgggcccg

SEQ ID NO: 151 - DNA, 2523 bp, Oryza sativa
  unsure (1)..(2523): unsure at all n locations
ngtttttgtgaaagagaaaaaagaaaaatgtgttttaggaaaatttttgttagggagaaatatttgatttataaaagaggaataaaggtaaaaaaaaagggggggaaattgtaaaaaaatttgtttaaaaaagatttataaatggtttttttgtaggggtaaagtttgtgttaataaaaaattttttttaagggaaaaaaattaaaggaatttttttggatgaggatttgnaatttgtggggggggttaaataattggtgagtaaaagtgtaaattggggaaatttggtgtgaaaaaaaatttttaaggggggaataaaatttttttattaaagttagggatggggtaatgagaagggaggggataaaaaaatagaaataaggcatatttttattaaaaattaaanaaagaggacngtaaaanccccccccccccccccccccaacttgtgacttgttgttgcgcggctatctcgggctctcggcccccgcgcgcgcgcggcgcggaggcgaggtgcgtccgtgcgaatgattgcatctgcgcgagcgacgccgtttggatcttgttgccatctcggtttttctttttttcttttgctgtctcgtgcggtgcgtggtggtgaaccctccggggtttgggtctttttttgcttcggttggtcttgcctctcgcttagcctttttgttgccttgtgctcggactcttaggcgagagggggcaagcagggggaatcttttcttttcccctgcgagcgtcgctgcggttgcggtggctgggctggctcgatagctcgctatctcacacttcgtcgccggctgcttccgctctgaatcgccggctggctcgctgcttcgcctgggagagttcaaccggctgggctggctgggctggtgggtactgggtttcactgatgaaaaggtccttttccgcatcagggagtcacgtttcgtgagctggaggggagcactgtgatctcccccaccaactcggctgtttttggcgctacattacacgtctttgccttctcctttttcagctaagcttcttgaggccttttcagttcggtttccatctctgttcggtcccatgtttctcggcagcagcccctctctgtaaaaaggtttcttccctgcttcaccatcgaaaaaagacccttttttcacccaagctttcttgcttccatgcttttttcttgtccactctgctatctggactctggagtatctcatttcaaatcgtggcgtctctgttttattgagctatagcggtatactatagccttctttcccctgttcgcctacagtttttcaactttcaacaactcccgagttgatctttgcgtctcctattagttccattgtttcagcactggagtaatagttctagctgctgttcttgaatccttttatccacgctctctacacattttttttgacgcctctgttcgtggcattcgtcgtgctgcagataggttgattcaccatgggccgcgcgatgaggtggttcaagaaggttctcaccggcaagaaggaaggaggagacagggatcggaaggagcacagcgccgccggaggcgccaatggtggcgtcgcgccgccgccgatggagaggaggaggtggagcttcgctaagccgaggagcagtttcgctgacggcagccgcaggccctcggtcaccgccgtcgtcgccggcgagctctcgcaggtccggccatgcagctgcggccagcaacgggaggtggaggcggccgtcatgatccagaaggccttcagaggatacctggtacgtctcccaagtactgttttggtgtcttgtttttcccctgaaaatgttgagttttgttctgcagctgctgcatgtgtttgaactttgaacattagcctagtattcgtaaatgacattttatttggttttccacgattcagttagcaatcaatgcaaggataggttcacgggattttagtagattcttctttttgaaaatactccctccgtcccacaatataagggattttcagtttttgcttgtaacgtctaacccgacaacactgctcaacaattgttgatgggtcccaaagtcatccgggatataggagtcctcatctcctggcccaaatctccctatagtgggtcgacttacaagtaaatgtcccctacttacagcggttggactggcaaaaacccttttagggccccacctatacccttttggcttgcatcgcgtttttttgcacgcggagataattataaaaagttccccacccatcttccttttcaaaaaattgcgcaaaactaaattggctaatggacccaccctcttaaacgtgccattttacaccccccttttggttggttatcgcctacaagtttccgttataattttccaaaaaccttgttacccccctctttaatattttttacaatttcctttttcaaccgttccaccgggtatttccccttgcacctctaaaaatgcgggccccccttattaggtggcgctttacacccttttccagaacctcn

SEQ ID NO: 152 - DNA, 710 bp, Oryza sativa
  unsure (1)..(710): unsure at all n locations
cgggcnnnnnnnnnattagatacactnnnnnnnnnnnnnnnnnnnnnnnnnnnnnnnnnnnnnnnnnnnnnnnnnnnnnnnnnnnnnnncgttatcatctgtgtgattctgtttgaaactctgaactcatgatcatgtcagttattttcagaattgaagattagttgctacttactatactccatgttgtgtgctgcaggaatgggtgtatttccttaacagaggatcggagatagaagtagcttacagcgtcaggagtgaaactgaatcgtctcgtccaatctgcatgatcattgcgcgaggtaagaaaggttcagatatatgaacaagtgtgtttaagtgtgattttttcatatcagtaacagagtttcactgacaccattaaaattcttgcgtgttggtgcttcactgcttcataggcaaagaaagcttcttgcaatgggctgagaatccatcagcaaatgagaccacattatcttggcacttggtgcacggtaagcatgatctcattgactaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaagcct

SEQ ID NO: 153 - DNA, 731 bp, Oryza sativa
  unsure (1)..(731): unsure at all n locations
cgcgcntttgtagacccngatatatcnnnnnnnnnnnnnnnnnnnnnnnnnnnnnnnnnnnnnnnnnnnnnnnnnnnnnnnnnnnnnnttcacatcaaaattaaaagtttagttgaaattgaaacgatgtaacggaaaagttaaaagtttgtgtgtagaaaagttttgatgtgattgaaaagttagaagtttgaagaaaaaatttataactaaggttgtgtttagttcctgaaattaggtagaagtttaaagttgagagtttatgtgtgtagaaaattttgaatataatgtgatgtgatggaaagttagaagttgagagaagtttggtgtgtaactaaacagggcctaaactcggccacagttacgggagtggagcgaggcgagtcgtgtcgaccgttggtatagcgctcgtgattcttggtgggacgacgacgatgagcgagcgagagagcgggcgggcgcacgggtccccatgggcaaatgcagtgccggcgccgcatgtggagaggagcctctggtggcgctgtccttcctgcgtgcggcagcagcagctgcttcctgcaaacggcagcctctgcggctctgacccacgcccgataaaagcgaggggaaagttgacgtgtgacgtttcactaccttggctcacttgcctacacgccccccttcttttccgcccattcaaccctccccctctacgagtagtatgccgtcaatataaagtttattgccan

SEQ ID NO: 154 - DNA, 724 bp, Oryza sativa
  unsure (1)..(724): unsure at all n locations
ccgcgcatttgannactttgtatatcnnnnnnnnnnnnnnnnnnnnnnnnnnnnnnnnnnnnnnnnnnnnnnnnnnnnnnnnnnnnnnnttgctacttactatactccatgttgtgtgctgcaggaatgggtgtatttccttaacagaggatcggagatagaagtagcttacagcgtcaggagtgaaactgaatcgtctcgtccaatctgcatgatcattgcgcgaggtaagaaaggttcagatatatgaacaagtgtgtttaagtgtgattttttcatatcagtaacagagtttcactgacaccattaaaattcttgcgtgttggtgcttcactgcttcataggcaaagaaagcttcttgcaatgggctgagaatccatcagcaaatgagaccacattatcttggcacttggtgcacggtaagcatgatctcattgactaagaatcagttgcagacttgcagtaccccgggagaatccgtatactaatgctatcaggatgtgtaatcacaggaaatggaacaatcaagcagactatcaatctctcttcagagtacttcattgccttgggaaactttaacaatcaggatgtaacggtaaattaccccgtgtcaagagcgacagagcttccaaaatgtttttgtggcatcttcagccttgttacagaggtttcatctggcaggtgctactggaattcagaatcaggaccttgttctacaacaccc

SEQ ID NO: 155 - DNA, 698 bp, Oryza sativa
  unsure (1)..(698): unsure at all n locations
atntgcaggaaaccatctgatatagatccgtctgggaaagactctgacccgactaacgtggacacaagtttttccaaagaaaccgagccaactgctgaggatcatctgagtgacaatcaaccggcaaccgataatgtagaatccggtgatcaacccccgactggaatccagtcgggcgaagccgaagccggagttaatcaggagcccccgactggaaaccagtcggacgcagggccaagccaagagattccagaagtcgaaacccaagcagacaaccctcgtggacaagacgccagcaatgaccggagatctggatcccctttaaaagtatccgaatccactcgtgctcgttcagaaatcattacaggtaaacactttgtgcgaaaccatgttgacccaaataactctgatcgatcgtgtaacctttgtcaatggatgcattaggaccaatgatcggtgatgaagaagaaattccccgtatacaaacagccgaagattcgggccctcctattctggtcaagtggtgggatgacaacttgcaacctcaaggaattgtaataaaccggcaaaaagaagacgaagaggtatgcctactgaaaaaggcactcaaccaagcgactcgcattgtaaaatgaaagttgcttgacgcctaacctcagccatctttgtttacagtctagcttcgagcgcttgataaa

SEQ ID NO: 156 - DNA, 1491 bp, Oryza sativa
  unsure (1)..(1491): unsure at all n locations
ccgccccntttgattgaaatacaatactcaagctatgcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagtgcataacccccaataaattcccgactgactgtcgaataaactccaactaaaatttttctaaagccctaggctgagctcattnnnnnnnnnnnnnnnnnnnnnnnnnnnnnnnnnnnnnnnng

SEQ ID NO: 157 - DNA, 851 bp, Oryza sativa
  unsure (1)..(851): unsure at all n locations
cgcgtgttgagaatcctagtgnnnnnnnnnnnnnnnnnnnnnnnnnnnnnnnnnnnnnnnnnnnnnnnnnnnnntggtgtatgacatcctccagaactgacgtggtgacggactcaacagcagtcgccttctcctcaacttgatgctccatgcgccagaacacatgaacgcgtggatcgtacatcacgcagctgtggccgatggcggcagcgaggcagtgttcgtcgtccggtggcgaagagagcgtcgcggccaccatgtccgtgagcgtctcgacgtcagcgaggggtaatttctcgtcgccgcggaggctgaggagcgcatagtccagggtgcggtagaagcagacgaagacccagccaccgtcgtaggcgccgaagtagcgcgcggcgcgtgcgtcggccgggagcgggtggccgaagccgtgggtggcgcagccggctagggcgcacgcgaaggacgtcctgtatgcgcgccggacgagtatcgacgggagcggcctcgtccccggcggcggctgcggctgcggcgcgacggcgacgcgccagttgtggcagactcgggccatgcggcggcggtcgacgaggcacgggaggcgcttgtggacgaggcggaggacgtcggcgttgaggtagaaccatggcgcgtccattggagagggctcgagaggcggaggcgcggcttgccggtggcgaggtgtgtgtgtgtggggaatgggttcctctgcttctggaaggaatttttttcggatttagatttttttttaaatatttacagaaataatctatcgnnnnnnnnnnnnnnnnnnnnnnnnnnnnggcgtntgaaacacgcgttcacctggacatgcg

SEQ ID NO: 158 - DNA, 799 bp, Oryza sativa
  unsure (1)..(799): unsure at all n locations
nattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccggtgatgttctggctatcagccatgcctacacaggcaaaaatgcagacaaacacagctagcgccgcaagctgaccagtgccaatctccatgaaccaagagatcccaaatggcttcttgactaaatgaactttagagtccggcaagaatattgtgttctctatgactttactctagcagtcattctcgataatcaagttcccatagttgaaaatgggggaacagagttcgcatgcatcaggtgagataatcatttgcttcagattcctagaaatgaccaccacaagttgcttcaagaaagagatcaatggccgaatctccttctcagcaatcaagaaaccccaaattgttggcaagtagccagttcataatcttgctccacaaaaaagtgcagtttttaccagcgcttgcctaccaactacttgatgaaatgctcaaatgacaaaatggcaagcacagctagccttcagggctgcaaacgcaaatagaaaggggaaaagatgccatcaaagtcataaacgtgctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 159 - DNA, 743 bp, Oryza sativa
  unsure (1)..(743): unsure at all n locations
gcgtgtttgannatcatanattcctaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaggagggactcggctttatagtggaggcgaggtcggttcgcgcgggaggtcggttcaaaccgaccttggggcggtcaaggcggcagctggcggtcgtgctcggagctagcggccaagcggcggcagaggcggtcacgggcgtgacgccggctaaggaaaaaggtgaaaagaggagagaaacgagctttgctcccttgctattttgggaggaaggaggatatgagaacgagagagaggagcacgagctctgtctcctggttttggaaggatgcggcatgggggcatcggaaccaggcgatgacagtggcgacgtcggcaaaaggcgagcggggctgggtggctgcgcggcgcaagcgcggcaaggcggacggcggcagcgaccggccggtcggncacgcgcgcgcgcgcgcgggaaagagcgaaagcggtggcgggtttgaacgacaaagtggcggcgcggagcgcgggcgatagagagcgagagaaaaccaaagagagagatctggggagagagagaggcgctttt

SEQ ID NO: 160 - DNA, 5873 bp, Oryza sativa
  unsure (1)..(5873): unsure at all n locations
gttttccgtctctctctttctcttctaatatttggacgtctttgtcttcgcctccttatctaaggtgtgtttccacttattccatgcctctctcatcactccccccccccctgttnttttagactgtgcttagagacccacnnnnnnnnnnnnnnnnnnnnnnnnnnnnnnttcaaggaatccgtttccggcgcctgatgggacggaggagcaccgatgttagccggcgacgagcggcggccttcgggagcggacggcaatggcggcgaggccatgccgggcggcggcggggctcggggtagcgtccacgcgcgtttgggaaagtataggctagcaatcgcgcaagctaagggggaggaagagtggggagggagaacaggagctaccgcgtcgggagatcgctgggaagagcgttcgacggcacaggcgggatcacctcggtctcgggccggggaaggggagggagagagggcgaccagagtcctctttggctccgcgcgcacgctggcttcccggcacacgcgatggcggaggaaggcgaggaccgcggcagcaaggcggcgatggcactgcagcggtggagactgaagcgggagggattgagaggagggactcggctttatagtggaggcgaggtcggttcgcgcgggaggtcggttcaaaccgaccttggggcggtcaaggcggcagctggcggtcgtgctcggagctagcggccaaacggcggcagaggcggtcacgggcgtgacgccggctaaggaaaaaggtgaaaagaggagagaaacgagctttgctcccttgctattttgggaggaaggaggatatgagaacgagagagaggagcacgagctctgtctcctggttttggaaggatgcggcatgggggcatcggaaccaggcgatgacagtggcgacgtcggcaaaaggcgagcggggctgggtggctgcgcggcgcaggcgcggcaaggcggacggcggcagcgaccggccggtcggccacgcgcgcgcgcgcgcgggaaagagcgaaggcggtggcgggtttgaacgacaaagtggcggcgcggagcgcgggcgagagagagcgagagaaaacgagagagagagatcgggggagagagagaggcgctttctctcaggtagggcacgtgcaacgcacatgaggaggggagcgggctgagaggagatgggccggggaagaagagtcggcccactgagccagagggaggtagaatagactttcacagagaaggctgatttggagagaattggagtttggatttggattcaaattcgatattcgaactcgagggttcagggaggaatcaaggaaggctcaagatagagtttggtatttttcggaattgggagcgagcgtttagcgaggattcaaaggatgcgactgaatttcggaatttgatttggagacttgaatcggaagaggaatttgaggtggaggattttgatttcgatgagagggaacaacgagatttgaaatgagatcttggcacgacttagactcgcacacaaagaacgaaaattttcgcaattaggattttaccgaattagtttttaacgtctcacgaaaagcggagcgttacatatgccatctcctttccctcgatcacacttggctccactcgcctgcatgcgctcctctccatcatctcggacgcgccggtccttcgctccaccacgctgtgttgactgtgcttcactccatcaccgtcccggccgccgctccaccccggcggcccggccccccaccccctcggccactccatctcaccgttccagtcgtgctccactcaaccactccatcaccgtcccggctgtgtcgctctaccaatccacctctctgtttagtcatcgttccccctggccgtggcggcagccgctcaccctcgcttgcaatgcgagatggatacaacagtaggactcatgtgtctgattcttgctagcatcgccatctccttcctgatttacgctccatactactggggtcttcgtctccatgtccgctctggacgatatctgcgtcgatcagatggcaagcgctaggtaattcctgatctttttctttggacagtcaatctgattaattagcacgtttatgactttgatggcatcttttcccctttctatttgcgtttgcagccctgaaggctagctgtgcttgccattttgtcatttgagcatttcatcaagtagttggtaggcaagcgctggtaaaaactgcacttttttgtggagcaagattatgaactggctacttgccaacaatttggggtttcttgattgctgagaaggagattcggccattgatctctttcttgaagcaacttgtggtggtcatttctaggaatctgaagcaaatgattatctcacctgatgcatgcgaactctgttcccccattttcaactatgggaacttgattatcgagaatgactgctagagtaaagtcatagagaacacaatattcttgccggactctaaagttcatttagtcaagaagccatttgggatctcttggttcatggagattggcactggtcagcttgcggcgctagctgtgtttgtctgcatttttgcctgtgtaggcatggctgatagccagaacatcaccggtgatggttcaaggctagctgaggtgtgcactgttcacatttgatttagttattgggagagcagtggtgtttcctattgagctctcaaataggtatcgacaaagatataggtgttcttcctggaacgaagctgagcattataaggcatgataccaattgcagtggttttctttgatccatgaaaggtttgggtttacttcttttccaccaagttttctttaatagaattgtccttaataatttacttgtaatttacacattaatctttcattttcagagacaaaagtaaagtttgtaaagttgaatggtatattggtatgcaattatgcatgtaactattcactgtgcatttgcaattaggaattttcccttttctctcctgcaaaattgtatgccaatttttttggaaactctttccaaatatgttagtcctttctagattatccatcgccaaatatactataaattctacaacttttgtattgatacaaattattcttaaattgaatttaactttacaaagtctggacttgggcttgcattgcccattaattggatttgaacatgctctactcatttttttttatttacctcagatttgtccattgggtcgcatcccacatatttgcatggtcttcagttgctaataatcttctgataattgataaatgttcacagactgcttatatcttagttttatatttattgtggatatatgaccagtgcatgctcacgttttgacatgcattatatactatgacatgcgacataatatggagcatattttcttttgttttgttcattttcatttttcttcaatgaacatcgagagcattgcacgagcatctcatgacaggaagatggttgaagtaattctcaactccattcaacatggttgaagtaattttcaagtccattcaaccagtctatctattttggatggcatgtccaaccagtcttataactaatcaattagatggagcaatacaatttgcgatcttttcatatctgaaagtttagacagaaactaaactgtcgtataagctaagagtcaatatggtaaaaatcttgtaattttgtatgaaattgtagaagttggtcacatacgtcctgctcgactgtctttcaataccgatgctacggtgcatcatctgagcttgtgctgctctgtgtactgcaaaactaatacggaattaacatgaggtagttagttgattcccaaatgaacctacatgttggagagagagagagagagagagagagagctatataattggaaaggtaggctctagcaatttgaaccatctgagattgagaaagtcattactgtcagaaatacttcaatagctgtctacaatgtttaactaggttaaataatctaggcaaactgtaggtaagtggttttttcatgtatgctttcattactatgcaaaataagaatcatgagtgtcatgatagtacctgtagctatatgacacgcatcaatgcagttctgcttatgattggcaatgatgaatatcgatttctgatattgtcatgcatgaataagcaatcaagaaatacagtactaaaattaggggactcataaggttaggaaaatgtatccaaacgggataccgttctgtatcatccccctaaggttactccatgcttaagaaaatatgcatgtagcactactgttttccttcaggcctgtaagctttctttgaaataaaaaatgatttgttggtgctatttgtttgtttaaatgtaagttttcttatgactcatttttcaggacgacaatgttatattttctcttctacaattggatgttaattacctagaaacatttctaaaaatatcgagaactaaaatgaaaatatgtaagcagttatttcttcgcaccaagatctattgcatttttttggtcgatccaagacaaataaaaaatggggctgtctatatagaaatcgaatgatttctgaagctccaatcatgcagattttatctaccataggatgcacatccaacaactcagaaaaagtgatacaaatagatattacacttaaaaacagatatattatttgattatttgaacgccatttttttaaagcccaaatctagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtccatatccagatccataaaagcccattagtaaaaagcaggcccaagatacaaaattagaagcaaaacacaaggaaataaagcccaaattataatccaacagcctatccaaaaaagtagtaggggccaaacttggaagccaagtagatgaaaaacatgtcacatgaatcaaccatgtatgggaccacacttttcaatcccctacttttcaacagcactattagttcacaaacagatctagcacgaatcaaacatggagctaggagaagagaaagaagagagaaaaagaggatccaaatcgcagatggaaggagagagtacaatgtcagaatcaaagagtagttctagaggaaagaagaaatcaaagacaacttctgaacagaaagttgagatccatacaaaggaaacacagaatctggcgaacacaaagaaaaaacaagaggaaggcaaaatcaagagaaacaagaaggctccagttcaaggttagttcaaggctccaattcttatcccctatatacaattcctgaaaaagatcaaagagagagtttaggtcaaatatacaattcaaaagaatacatgaaattgctgaatatgtcaaatgaaacaaggttaacaatccactttgctggataaatacaacaactcagaactgaaaatttcatatgtttgctctgtagatctgaactatgtaatgttagaagtaaaactacactgcattcagtactacgaaactgcattctggatgattgtattactgtgtactattgatgaataccaaactaactttataaaaaaacatgacagattgattaatcttccaaccttactgaatttcactctgaagatatcacagttatacagttatacagaaatataacaactaggccatatagcatatcctgnnnnnnnnnnnnnnnnnnnnnnnnnnnnnnnnnnnnnnnnnnnnnnnnnnnnnnnnnnnnnngatntataaaacagggtttcaatnnnnanccac

SEQ ID NO: 161 - DNA, 1360 bp, Oryza sativa
  unsure (1)..(1360): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctaattgaaatagaaagaaatagaaaagaaaaagtgccatcagatattataagaaaaagtgccatcagatagtttgttccataagtaaattttaactggaattacagtagcattatactcaaattgaaatacttatttactgtaatactacttatggaacatactcatacaggtttgaaaaacatttaaagactatcttgaatatttctttacaggtgtcatacaaaaggacaaagaatgcaaaagttctaaggaaatagaaggaaaaaatataggtaaacaagagttacagtaaattttaactggaattatagtagcattacactgtaattgaaatacatacttagtgtaatattaaaattattttgaaagaattatacaaactgattcatttgttcacttcagtatctataatcaagtatcaaattgattgtagttggatttttaagtagttacagtttctgtttactggaattatagtataatttctctgtaatacaaatatatgttcactgtaaatggacttatgaaaaagattgggaaatacactctatgtttcagaacttgctggtttagaaattcaaaagttctttgcaatattaatttattctttctatgcaggtggcatacaaaaggagaaacaaagcaagagttctatggaaatagaagaaaaagaatcaggtgaacaagataatttcaaattttattcacaaataagaagattaaaatgagtctgaaattttttttaaaaaatgccatcagatataaaaaagcacttcaaagctctgacagaaatggatacagagattataagtcaatcgaatctgacagaaattaacacagctatgttgagctcaggtaagaaacaaaaaattatgtagttcaatgtatttttaaaaaaatgacaaacatctaaatgatctgaactatatactttcaagtgggtactttttaaaatctaaaatattaacattaaaactagttacagagaagaagttataaaaatacatgtaacaataactgaaaatacaaggattattctaactttcttcataatgatttttattttgcagg

SEQ ID NO: 162 - DNA, 2960 bp, Oryza sativa
  unsure (1)..(2960): unsure at all n locations
ttgcgacattttccagtttatctggtgtaagtcggcgttacnagtttcgtttgacatattttattttttgttccgtagaaaancatttccctcccncccccccagtgtgatgtcagcgcntgacancnacgcnccnnnagacgcgaggaaancggnaccccaaactcangnaagaaccnacacaggtattcttattctatttcagaacaattttttcattacagttaatttgtataaaaattacataaaaaactgtaattccaatactaaaaatttcaaactggaatacaaatttactctaatttttaatgttgaatcaatcaatctattgcaggcataacaggtaatgaggtaggaataagcaatgctctggatgaaccaaacacaggtaacaattcaaaatggaattgaacaaatgcataattccttcagtaaaaaaacacaaaatgcaaaaattacagtcaatttgaaacagaataagaataattttaaacttcaacttgattgttatacagtttgactggaacctatatataatttgatcacaattactttaattgcaaatataacagatcatattggattaggagcagaagatgcaacagtagaaaagcaaagtatggataattcagcaagtgtgacagaagcatttgttgattacagcaacaaatattcatatgatgaattatctcttttcggatcaatgaattcagtaagttcatattacaaagtttttgctattaaaggaaaaatttgaaggtggtagtcaaaatactatatgaaaatttatttgcaggttgcaaatatgtcgtacacaagcttaatggaacaaatcatatcatcacagcctacgatttctgatatgcaggtaagaaaaacaatatttgaatatcatatataatttagttgtaatatttctgtttttattggaatttacaggaacaaaattcagcacactctacttttgttgcgagtccaagtgcatttcaggtatgaaatattaattatttaattgaatctaataattcaaattcaaaagcaaataagtattgatataaaaattttgttttgcagaattcaatgatattaacaacaaatcgtactaatgctaatattgaagaatggaataatgatgcggcaaatgaggcatgttgtcttggatgtattacttcctgttgtagtattaaaaattatgataattttagtaaattttaactttgtaatgtaattcaaattccaggaagatgagagtaatgaagaggatgcaatggataattggaatcttgatatattcaatttgttagatggtgaaaaggtaatttttgttgtttgtacctttttctctagataacaatgattgatgattgaagtttcatagtctgcaaaaaaagagtacaaacattaatatttcttaaaaaattaaattgaataattcagattagcaatgaataggctagaaaattaatttcagaaactaatggaactgctttttttttgcaggaaccaagttcaatggataatcatcgatgtacttcagttcaaggaacaagagatgatgacaataatccaaatgataactctgaaacaaatcaacaagagctgacagaagaagacataaatattttcgtagagaatgaacaggaagaagctacaaagggtaataatgcagcaattgatagcagatatataccaagagttggaacacaatttaagactattacaaaagcacatgaattctttaacttctatgctctgttggctggattttctattgtcagggctcacaactaccacacaacaagcaagaaaaggaatggagaagtgactagagtaacgttcagatgtaatagacaaggcaaaccaacttctcaatccaaatcagtaagcgcagaggaacaagtggtttcggaagaaaatacaaatgaaaatgatgcacaagattgcaagtgtgctctggttatttcagagaggaatgagatttggaatatttcaagggtacaattagaccacaatcatcaactaagtccaagagatgaagtgagatttctcaaatcacacaaacacatgactacagaagaaaaaatgctcataaggaccttgaaggaatgtaatatacctgacggagcgtggagctcctcaccgggagaccgcgcaggcccccctttgccggttcggccggggacgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggagttacagagagccggagagctagagagttcaggctccagaacccctctagcgtccttttttctttttttcccccctttttggtgggcaaggtcctccttttatatctcaaggggataccacatgcaccacttctacctacttttcttttgggtggggacctaccctatcttgaccaaaacttggcttgcaccttcgcctggaagctaaatcacaacttgtccttgagtgaggctcagcgccgtcactcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccgatcattcttgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 163 - DNA, 2503 bp, Oryza sativa
  unsure (1)..(2503): unsure at all n locations
agaagtatcttaatttcagaagtcaatttgcctagtaaaatataaaaaatgctaagatatataaaggactaaaataaagaaacctggataaaagaggaggactttataaaatattttacatgagcaaaccacacagtagtttttttgtaagtgcaccgacgaaggaattttctggatgcaaaaaaagtcggttgagatattaactaaaaatgttatgaatgtttttaaaaaaaaaatggttggcaaaataaaattttgaaccaaatagtttaatgtatttaagagtaaaatttgtgcaattaaaagtatgtaaaaaaaaagggagataagttaaataagattgttattatggagaaattgggctaaaataaaaaatttaaaatagataatagaaatatggtaaaggtattaattgtgtaattaaataatgagatttaatagattttaagtaaatgttgtaataanaggannnntacccccccccccccccgagggggtcaggccacatgggtgactgcagctgccccaaacctctagtcaagatacccccggtcccatgtccccgacaataccaacaaggcacatgattgtaattttatttgttctaagaggaggattgacttctttgccttatacgaagaaagatataagcaatgtgagacccccaattaacaaggagacaagcagcaatgatatgatgaaaactttggaatttttcagaaggaaaaaagaaaaagatccacatttcttttatgagtttgatttggatgagagcaagaaagtgaaaaatctgttttggacagacgggagatcgagggagtggtatgagaaatatggtgatgttgtgagttttgacacaacatatttcaccaacagatacaacctcccgtttgctccctttgttggaatttctggacatggaaacacaattgtttttggttgtgcatttttgcatgatgagacttcagaaacatttaaatggatgttcagaacttttttgaaagctatgtcacaaaaagaaccaaaaataatcattactgatcaggatggagcaatgagatcagcaattgctcaagtatttcaaaatgcaaagcacggaaattgcttctttcatattgtaaagaaagctttcaatctatctggaaatttgttcaaagcaaaagaagggttgtatgatgagtatgaagacatcataaataactcagttacagaagaagaatttgagtatttatggcaagaaatgattgacagctttgaagttcagcatatcaattttctaaagcacatgtggtcaattagaaaaagatttattccagtgtatttcaagggtgatttctgtccatttataaaaagcacagctctcagtgaagggactaactcaaggtttaagaataatgttggtccacagtacaacattacaaacttcatgatagagtatgaaagagtaatggatacaattcaaaacttggaacagtttgatgatcacatttcaagaacaaagaaaccaagcaaactttggtcccattactacattgagtaccaagcaatgagaatgtataatcgcaaaatcttcatcaagtttcaagttgagttgaaaagaacaactagatttcaaataaatgaagtagagaagttcaaaacttatgaagtttttttggcattgaatcaaaatattcaagtaatcagaagaaggaagtaccttgttattgtggacttggaaaaagaggatttcaactgcatttgctcaaagtttgagaaagatggacttctatgctgccatgtattgaaagtaatgctccacctcaatgcaatgaagataccagaaaaatatattattgaaagatggacaaaaaaagagtacaaaggtcttgggggaaaaggcaatggaaatatacctttagcatagagctcaatcctgagattcaacattttgtcaaggaaaagtgcagaaatagcatcaaatggatcgaaaagcaatgaaactttccagtttgcagtggaagagatggacaaaatcgctaaacaattggaattaatgtgttcaaataaagatgcagagcaggagatcaatgattcagatccaaatgcagaagacaatttgaactcacatgaacaaggcaatcaacaatctgaggaaaatacagaagaaatattgttggatccagatattgcaaaatccaaaggcaggccagctcaaagatacaagacaattagggaagaaatacagcaaaaagaactatatcattgcagtcattttcagaggacagatcacacatttccaacgtgccctctgaaacacgttgagtttgacttgccaaggaagaagagaagaaaggttaaaaatacaagagaacaggtaacaaaaattacaaatccatatgaattgatttttttaaaaaaagtaataaagaaagatattatttnnnnnnnnnnnnnnnnnnnnnnnnnnnnnnnnnnnnnnnnnnnnnnnnnnnnnnggtgaggatagatcatcaatncacgc

SEQ ID NO: 164 - DNA, 851 bp, Oryza sativa
  unsure (1)..(851): unsure at all n locations
gtgggtcnnnnaggtatagtctcagcnnnnnnnnnnnnnnnnnnnnnnnnnnnnnnnnnnnnnnnnnnnnnnnnnnnnnnnnaatttccctacaaataaaaagagagataaaaatataaggactaaataaaaaaaattgtgaaaaaaataatgattctaaaaaaaatttacctgagcaaagtcaatcactagtttctttgttcctgtaccgagaacagaattgtctggatggaagaaaagacggttgacatattgaatcctaatgttttgaatgtctttttgatagaaatggtttgtcagctgaactcttggaccccatagttccatgtattttagagtaaaaactccgcaatcaaaactaggaaaaagaaaaaggacataagtaaccacagttacttatcataaaaaataaaacaaacaaaaaaaattaaaaaaagctaatgcagttatggtcatactatttactctgtaaatttactaatgaaatctattgcagttctagtccatgttgtactaagaaacaggctcttatcccatctagtaattctgaatgaaacaattgacaaacaggaactaaattttttgaatgataatcataacaaacaaactaaaattgtgcattaacaacaaaacaaacaggttatgcaacaattagaaaaacagaacagtcaagaatttctgaatgaccaacaaaacatacaagattcctgtcaacaagagaacaattgggcatctgtacaactctaacaaaaaaaaaccaattaaaaatattattggacttaaagttacaggtaagaaaaacaacttacagattattttggcgaggtactggtggatatacaattttgaan

SEQ ID NO: 165 - DNA, 734 bp, Oryza sativa
  unsure (1)..(734): unsure at all n locations
cgctgttttgnanattggannttgatgaacctatnnnnnnnnnnnnnnnnnnnnnnnnnnnnnnnnnnnnnnnnnnnnnnnnnnnnnnnnntgcgtagggagcactccgcgcggttctagggtgggggatggacttggtgcactcacgcggttcgtgcgtgacccaggtgcattgggcctactcccagccttactgctcgtggtggaacgcgcgcacacagagggactgaccggagtacgcttgacccgccttaagctgagctggtgccgatgatgcgcctacctggcttgtacgcgggccggacagaggtagaccacgaccctgtcgcgaatggacagcgagccgcagcggcgagcggccgagcgatccaccgggatactgacaaaagctagcacaccgggcggttgttcctgatgaggggagactaaccaacggctaggatttgctggtggttgtttgacagctgcgtatttcggcagatgcaaccggttgccggagaaaggggaaacggcgacgatgtcactaggggctcaatcccgggggcgagagcatctacaccgatacaggaatccgatggtagcgtcggcattgacggaactacncccatcgaggaccggtacatgcgctcttacgagcttggccgttacttgagngagcacactggagcgaacgggaacgacggtgcagcctctgttactttgggtaggtactcgagcggatacgaaggttacga

SEQ ID NO: 166 - DNA, 851 bp, Oryza sativa
  unsure (1)..(851): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattatggatgttatacctgataataatttgcttagctcctggtttggagttagatctgttcagccgggtatggttgttcaggatggttgggcctgtgcagcatgggtgtgctgttcagtgttgattaaaatttctgattaattactccactgttttacttctcttaaatattttgctaaatgctgcttttgcaaatgagccaatattatgccattcctttgatatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgtgggagtggagccggagcttcgctagattttattttccgctgcaattttcttcttggtgaggactaagtgcctcttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 167 - DNA, 890 bp, Oryza sativa
aaacgatgaaaaagttaaaagttcatgtgtattgaaaaaattaaaaggttggaatcaacccgcgcccaaagaagataatcgtttataagcggttagggtgtttccaataaacggtggatttggtggtaatccataagtatgcgcaagggtttgtacccttttcccatcaaatataaaaaataaaaagttgtgcttaaagtactatagataataaagtaagtcacaaataaaataattaataatttcaaaaaattttgaataagacgagtggtcaaacgttacaagcaaaaactcaaaatgggacggagggagtaggtggtatggattctcctggttttatattggacaggagatttgacttcactttactaactgttgttaatggcagcagttgtttgatagtttcttgccgttgagtagctagccattgcacaatgcacattgtttaatctgcttcctactatagataaattccacattttaggatatttttgtttagtgatgatttgctgcaaacgcttaggtaactgcacagtggggacacaagcctagtcgtcatggcatatagttcaaaaacttccatattgtttctgttgatttgcttttcgaagcaactgtaaaaatttgaattttccaccgcaaatgcaggctaggagggcattgcgcgctctcaaggcgcttgtcaagatacaagctctggtacgtggctaccttgtgaggaagcaagcagcgacgactctgcagaggctgcaagcgctcatgaggctccaagcctcctctcgcgccatcaagatggcctcatcgcggaaatccgtcgaacaggtgagatttttcactgtgatgcctcctcggatcaccttgattttatcagatgaagttaaatttttgag

SEQ ID NO: 168 - DNA, 29404 bp, Oryza sativa
  unsure (1)..(29404): unsure at all n locations
gccggcnaacgttgacatcgcgtccgacgcgcatgcttctatagactggaggaattccgcaccccccgaggatcgtggagatggacacgtgccagctccggtgccggtcttcccggatcacgagccgctacgccgccgacccgccgccggacggcacgccggggtcggtgccgctgtcctcgccgcacctctactgctacaagccgccgccgtcgcgccacctccaggccgaggagcacgagcacgatgcgcgggcgcagccgaagacgacgcacaacacgccccggctcgccgccgcgctcccggcggggtaccacggcccggcgtcgccggcgaaggggcgcgtcgtgagcccgcggtacatggcggacacggcgtcgtccgtggcgcgtgcgcggtgccagagcgcgccgaggcagcggcacggcgccgccggcgagccgaggcctagcctggcccgcgccgggtcgaggaagtcgcggccggacagcgccatcagcttgaagagctcggagatgagccgccacgaggactcggagttcagcgacgacgtcactagagattattacctcgatcagctctggtgattactcacaaccggagcccgaatgctaatccaggagtgtgttttaattaactttcggtacatattagtgttaggactaagatggtaaatcttcgcaaagtaccaccagaatatgtagctcgagtatggcaaaagagcagggaataaaatctgttctaccgctacagctctaaccacattctctctcttcttattgacaaattttattccacgacaactaaatcttatgtaatttactgataaatatcctataaatgtgctataattgaaggataataaataattggtaatttatcgaacgacatttttacctatttggggccacaaaattctaacctagcgcttgagtgaaagctttgaaattatgcaactcttaaaatgccatcactctaaggtgtacattgttagtatatatcataatccgtcttcactcgtatgttaggttagaaacttgtagccataggacattcttgtttttcttttaagagtttctcttttaattggatcgaaaatatctttccataaacataacacgtttttagggtattctctagccatgatatgtttttacaatgtccactagttaattatataaacttttaagtgtcatagagtaaagtttgtcttcatggtataaaattgtaaatttaatttgggtttctcaattaccaaaacggtctaaattactgcacttacctatgagaaattggacgggtgaatccctgccaaaggaagggaaaaagaggaggaagaaacaaaagtacatacagttccgaaatgccattcctttgtttttctgacagtgtggcttatggtgtgtttaattcacgtcaaaattggaagtttaattgaaattggaacgatgtgatggaaaagttggaagtttgtgtgtgtaggaaagttttgatgtgatggaaaagttggaagcttgaagaaaaaattggtaactaaactcaggccttacggggtggtttggtgagagggactaaacctcacaaaaaaacaaaggcctgttcaccttgatgccattttcaaccttatcaaattttggtaaagttgtcaaaaagtgactacatttaatttactgccaaactttagtaaatatataagaaatcctgctaaaattttggcaataacaaaatttaataaggtttattttggctacaatctaaacagtcctaaatccctcccccttaaatgctgatgcggtatctgataccgacctgtataggttgatagctgaaatggcatggaagttaagggaaggaagaagtaaagagtacacggacgagttcctgccttcttggcactggcagatcctttgcactgaagacaaaattgtggttgtttgttgcagtgtaccacaactgcattgctttatggatggcttaaatgttgacgtgcatttgatgtgaagcatcaggcaaaaggacgctaaaatagtaccctccctacatggttgcaaacggtggttgtctgataacacgtccagagctggtttggctcggaaaaagagtggccaaattcattgcctgagcgtatttggacgccgagatgattataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccgccagcctgcagtgcacagtgtttttttttaaaaaaaagcaaaggaaatgtataaggaaaaaaaataaaaatagaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttctaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataatgtagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctctttcattcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctccactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaacggaggttctcgatctcttcgagccggtgtgtgtcgaaacacttccgctcgcggttccggaaaatccttccgaagctgtcgccgcctgaaccggtacctcctcaacgacagccgtatgaacaggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaagtagccgttagtgccacgtggcgccttcccattcgaccgccgcccgccctgtccgcgcctgacgggccgccggcgaaacgggccgtgccgtgccgcgggccgtgccgtgccggcctgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggctgcccgtttggccacctctagagatgatcccgtccttttcagtcttcagaatttcttcagagttaatgagcgctactgaccatttaacaatatcctgatacaacagcttacctaagacggggatgaatactatacagtactatacattaataagaacactgttccaacgagcactaaagtgatgtgcaagtcatgtgcacagcgtttttcctgtttggctgttgatgttgtctgtcatttctggtagtgactctagaaccagatttagatgtagataatcctgtctcttaagataaaaggcacacctgaaagtacaaagggacttgtgcgtgtctcccgagatgcatgagggaattgcttaaccgttactagtagcatcttggaccgtctgaaatgtgcagtgaccatattgttttcattaaccaagcacatgtcagcagctaaccactgaattctgttcaaactttttcgaactcgatacaatatgtcactcgtttgcagcatttggaggatcgctgcgcggaatttatttccatcagctattctcgaccgcggagctaggacagtgcgacaatgcacacatcgatttggactccattgaagaggacacgacctgcagctgtcaatcttgtttttgctgacggtgtgagtcggaacggatggacttgagatttgtttttatctgctgctgctactgctggtggatctagatcaacagtagatctgagttttgacagtttagtattggtccgaactctgattctgtgtaggagtagttatgatgcagaagcatacggtctacggtactgtagaagattgtttttgtcgcctcggtggctctccgtaacaggtcaaggcccgttatcagcacagattatgtatttcacgcttctaaaaagacattttcttttccccgcaaaaaaaaagacattttcttttaaaaaactttcttattacgttatttagataacctgttttaaactatatcagttaagacttataatataaaatactactgtttaattcaaatccatgataaagaaaatcatccgttagttttcatcaatcagcccctgaaaaatacgctgcctaatcttgatgttgtcagtggctcagttcaatgtaggacagtaggagtcgaatacctactacaactcgtagtaagtactacagtgcagtacttctaatcctagtggtatactatatgactagaaaatgccgtgccgcgtaattgaccagcttttatgaaataaatgaatgaaatgctctgataagtacacctaatatgttttacttcctccatttcacaacgtacttcctccgtttcacaatgtaagtcattctagcatttttcatattcatatttatgttaatgaatctagatatatatattcattaatatcaatatgaatgtaagaaatgctagaatgacttacactgtgaaacggagggagtaagactttctagcattacctacattcatttagatgttaatgaatctggacatatgtatgtgtttagattcattaacatctatatgtatgtggacaatgctagaaagtcttacattgtgaaacggagggagtatctatttaaaacctgaaattatttaaactttacccttttattcatattagttcaatgcagcaagacattgagttcatggttcctccacatcacttttctcaagctgacagttttaccggagattggaccgtgtggcactatttagaaattgataaattaaacagagtgaaaaggagaaaaactgagttatgttgggcgagaaacagagtgaaaaggttaaaggaaaaacctagaaccttctcaaatctaaactaaaatggagaaacacacagccttctaaaacatgaacaactcattttgatcattccaatcccaaccaactattggtacttgatagtgcaacatgtcactctgtcacaatgatctaataaacatgtacagaacaagtctgcgatgcgttccctgtcctccacctcctgtaaatccctcttgctcctcgggctatcaaccggttccatggccctcgatacctttgcccaccgcatcaggaagacatctcccaagctgatgtgattattggcacaaaaatctggtgctgaggtttggtgctggacaaagcaccagtgagtgtgagttgtgtgatacatcgttgcttgcgccccttcacttgctctctgcctctcttgctcatgtgcataaccatcttgtaccaccaaaaaactaactctgcatttggtgtttgctaatggattgcaacaaacttattcaactccatgtacgttgaggacttgaccgatgagtatgtgtcaaccgttgaggacgtcaatcagatatcagtcaaatgactttgatagcagtgatgctttacacctttggtcaggaagccgctacactaatctgcaatagaaaaaagaaagaaagaaaaagaaaacatagcaaggcatttggaacttaaatttagttagcattatgtgaataaaatttagcagttatataagctatttacatgattgttcgttaagatccaaaacttttttgcttgttttagctgcagatatgcactttagcaagtatattgtagttagtttcagtcgaatattgatgttgttcctgagctatcaatgccatgccataatattggaattgaataaaacaaaaccagagaaactaattgattaaaaaaaaaagagtagagcacatttattctgagaacgctccttcactttgaccacaactcttacttcttctaaattgagtaggggaacaaagaaattggaaatccagcagcttaggaatttcatcatggcagcacatacacagagtcacagatcatgaaattttttggcagcatgtagctaaaatttgcaactttgacagcatgtacaaagatcatgacattttattcagcatgtaacaaactgattaaagcaccagccaaacagcaccatgacatatagatgcactgtaactgcagcagcagctgatctatacaaattaatggccatttttgtcatatgaaagtttcagttcagtgatattacaactctgccaaagtatgacatagtgcctaatcaagttagaatttaaagatcgaggatgaaattgtaatagtatgtatatcacaagcattggaatatatatatgtatagataataggtagccataactttgttttacttaagtttagtagttagatttattgtagattatcaaagacatgaatatagattatctaagatatagacatacattgttgaggaaatgatcacagcttttgataaaggtcctttccaattttctgataagttaagctagctagtagatgagtataggttgtgaatcaccgcttttcttgacgatggaaatcagattcaaatcggacgatctgctttctattagctaatgaggatggaaattttaatagagcaagcatgatacaatgacatgactcaaaaaaaaaaagtaagctacatctcatagaagagttttatggattcagaccgacagcaaccatgaaaataagttccttgaacagaatggaatgaaagcccataaaccgcatcttgcaaatctgaacttctaatctgaaacgcgtccagtgcagagcaatcctttttcacttaataaagtgcgtttaaatatgtaactcataactatatgtaacaaaaactattttcacccttttcaaatcaaggttattggcaataaatactgcatacttttttttgagagacataatggtaattatttaaaagaaatatcatgattcctagctgcaagatatgcattgtagaatgaattgtagaatgaattgcacaaaccttgcagcagagccagccgccgtcgttttcacatatgtggagcctacacctcatggagcctttgcggagcacaaatttacatggccttcggcggcgcggcagttgctgccacattgggttcacatggccgtggccagtgcctagtgccccagccaccgctgccgccgtgttgatcccagatcgtcggtcctcgtccgccctgccctgccaccacattaggcccgcacgaccatcgccgacatcgctgccgccgcttggccgcagccctcgcgccgcgctccacatcgagcctgcacagcagccgcttgcgtacgttccctcaacctcggcgcgggcacgacggcgggggagaagacgagtcggcgcagcaccttgagggaagacacgagcgggtggttcatcacggcgtcattggccgcgacgcgcaggtggcgaaggatctgatgcgatgccacctctcaccagcgcacgccgcctcctctcctcctctgctagctagcgccccctcccttctttctctcgtgggctcaccggatctagccgaagtttgtatcggcgatggccaccgcctgttagagggtgactcttgccggcgaattgacggcggccctggcttcgaggaaaggcagcggcattgcggcagggaacgcaggggagggcaaggtggccgggcggcgttgaagaagacgagcctagcgtcttgaaggaggacacgagcgggtggtctactgcggcgctggccgcggcgcgcaggtggtggagaatccggtgggcggcggggggacggcggtgcgtgcgtccgggaggaagatgggtggattagggatggagcactttcatggaaaaaaaattccagttttctaacgaggtccaccagaccaccacagcgagctgtagcctttagccgtcgatactcgatcaaacaatgcgggaggagagccaaggagacacgtggcaaattcgcagggaggcaaacttgattttcagggcgccacgtggcccaatctctagccagggttagaaccatgaaatcggtattagagattggccactgggtctataatactactactactaaaagtttgcagaaatccattaaaatgtctgtctagaataatgtttgaaaaaaaaggaataatgttcgaaaaggctatacgtgttggaacatggaagcaacacacctgtgattgttgggctcacttctgctacactactctaacctttttctgggcctatttccccacttcaattctctatgggcttctaggctgagcagggagatcgcatcgattgctacctctctactgcctgggccagtgggcctaagttgatgttatactgtttgcagtccaaaacaaaaccgaggcgaaggccggacacagtataggactgtctcacaatgcaactgcaaagttgaaatctgcaatcgaatcaaatcagagtgtttatctgccacttcttctgttctattcttttctcttcacaagttaactaatagtcgagtgagctgtgtttctctcctacgtggtgctacaacttgacccactccaacccgtcgatgaagctgagggagatgaacggcttggcctcctggtccgtgagctccctcgaccacgccaccctcccggcgtagttcgaacccggccccgtgcacttgtactgcccgtagaacaccgtcctgccaccgccaccaaccacacacaaaacaccagcatcgttagcgaaaaaacacaagaacgagatggatgtgaggggtgaatggggttcacatcctctaccattatgacgctatcatcacaaatattgatgggtggggtatgataggatgagacccacatatcattataatagtagtgatatgatcgttcacgatgttcgattctgtactagtggtagctacttacatctcgcgggtgggatcgccccagttgtaccagccgcgggggatgatgatgttgtccatgtaggtgtaggcgaagacgacgcgggagaaggtgccccaggcgcggccgaggtagagggcgccggagcccgtcacgcggcagttgacgaacgagaaacccgtgtcctccaggatgctcatccggttctgagccgtcagggctccgtagttccgcgcgatcgcgtgcacgtgacatccctgcaatcgtgtcaccaacgtgagtactgagtacatacatgaccaaagtaatacacggcaaaggatttctgatcaaatatttgcgtaaaccctagtattctttacgatcacacactgtaacacacgttagaataaccactagtgtggtgtgtggagtattactgaatgtctgaaatacggtgaatactattacaaagtctagcattcgaaccatgctaggtgcgttgcgcacttgcacgacggatgagtattctctacagaactatcctttgatatgggtgaatgggtcattgacatgtggacatattagatgtgggatagtacacatatcaatcacttaaagttagagcacggtacagcagataatatgtttcccttggagcttggacgaccctatcgtcccaaaggtcaatttttgatttctgaccaaaaaaaaaagtcggttactactggtagtagtgttggactagtaccagattttaaagtgtacgaccaaagtgagcaggatttgcagaggagactggtggctatacacatacgctacggtttggggccatacgcacggcacgagacgtccagctatgggcgtcacgggccgtagcggtcacggcgcctggggccagggggaccagagaacctgccgggctccagaaaaccccatccggcaaccgtgccggcgccaacgacaagcgatgcaggttttaccacactcctcttaaaaaccgaaaggctgattactcactatgctattactagtgggctcatcaacattccatttgcgttggatttcgcattaaacgaagtgccacacgggcatgcacaacgcattggcaccatctggttcgtgtagctgtagtagggccagtcacaagatcggggggctaatgtggccgataatagtggtttgcctctactgtaaccctgtgagttttaacagtggtcgatagtagaattctttcttctgtgtgactccagtgtggtgcattgtagtaggtgccacagtaggccagtgccctgtcagaaagctgcgggccagtgtttactgacacggtgtatctgttgtgcatttgggctgtagcactggacactgacacacaggattgagcatagatttcctgtttgactcgatttcaggcgctaattaaattatctatcttggttagcaacaaaccttcaacctaatcacccgggttgcatgcaattccctgctataatgttcatggaggaaatgtgtatgcaaccaagagaaagaagcaatgtgtgtacctcgtagagagagagggcgttgccgaatatgaagtcgacggagccctcgatgtagcagtctctgtagtaatggcggccgaggtggtcgtacagcgtgtcctgcgcgccgaggaagttgcaccccaagaacgccgcgttgtccgccgatatccgcagcgccacaccctgcttccccagcgcccccggcctcggcaccggcgccgtgttctgcccacgcgacagacgaaacgaatgagccacgccacggcacaaatgatgccgcatttgtagtgtagtagtggtgctcaccttgaaggtgatgttcttggcgacgaagaactgcgcgttgacggcgaacgtggcggaggcgaaggtgccgaaggggcgcccgagcgggccgaccgtgtcggccgtgtcgccccactgcaccaccgtcttgtccgcgccggcgccctcgatggtcacgaacgcgcggagcggcgagatggtcaccttctcactgcacggtgcacggggagatcggtgtaggcattcggacgaacgctctggatacggtgggggtgtggaagaaaattacagagaccaaattaagtagccacgtgagtgacgtacgtgtatgtgccggcattgaccttgatgacgacgcgggcgaggttgatgagcgggatcgagtcgacggcggcctggatggacgtgaagttgccggcggcggggttcttgtcgacgacgagggtgcgcgtgggcagcagcccccggtagagcgcgcgctggaacgtgctgtggcgtcgcccgaccatggaccgcacccaccgcgtgaactgccgctcgatcgcctccaccgccgtcgcgttcaccggatagtacggcttcgccgccgccttccccggccgcaaccccttcgtgtgcccatggcgtcgcccgccgccgccggcggccgcaccgcccaaacccgacgtaacaagcaacaccgccaccgcgacgcaggccaagaaccgcggcgcccacgaccacgacacggacaccgccatggatggtggttggtggtgtggtcgtcttgctcgcggcaagaggtggcaggcctactaattatcgtgggggatagacgcatcgcgcacagggtgggggaatttatggagatcacggtcacgggcatggcagggagcggatcgagcaggaagccgcgatggaatgacacggctcacgagtcgcaggagaggatgtgcccgtggccgcgcccgcgcccgtgcgtgcatgcgcgggtggcgacgcgccggtgtttgccatgtcccatgtgcaatgcaattcagtgcacgcgttgttggtggtgctctttgcctctcagcttccccctgtcttattgggaacgatgacctgtacaggccggcgctgtgctctcctggggcaggaattttcttggggacagtttggaatttcttttttccttgcttggtctcatgcggaagtacgcttgtgctgttgttgcattagctttgtgatgatgattctcctctctctctgttttttttttaaacccgtgactggatttattctgagtagtgccttcttctgtcatggttccacactagcttcgtgattcggctgtctgactacaatgctggagtacatgtctacatctccttgttattaccatattatcgagataagtttgatccgttcatagttccatgccatccaatcatcaatcatacagcattactacgatcatgtgctactattgcaacaagaaaaaatagaacataaacaagactagcaactagagattagagaactactagtgtcaatattactatcacctgaacaatagactagtattttaaggtatttggcaacgtatttcattggtgcatcgcgaatgggtaggtagaggtgcatgcatatacaaaagcagagaagtgcattccttttcggtgttgttttcctcccgtctgatcgattcctcacctgtcattctaccatggccttactttctctgtcggcttcttgctgctcctttgcctttgctgccacccgtgaggtctctctctccctccctctcatcaaaggtggcaatggaataccggccaattgctactgtggctgaaacaaaaggacaatacgcagggaaaaaaaggatgccatatgcccatattgagttgctgctcgtcaggtgcaattggccccaatttcagtacagatagcaaaaacatggcactgccagtgctagctcactaccagtaccagtttaccaattaccactacagcacgagtatttgcctcaagtgaaggtatcaagcaccaacttctatgtgctcataagacatgtcaaaccattgcttgaaacatctgatcatatcatcattcatcttgtactatggatttctagtaacactacatttcagaaaattctgtgacggaactttagcataaggcaatggttgtgtaatacacacaggaggaagtggttattctatagcgatcgtcacaacgaccactactcaggtacggagaactaggcctatggaccagagaataaagtgttttccataacttcataagaaaaagggaggggcacacaaagtttactactgtacacggagcatcattcgtcctgatctagttcttgtgcatcatctgcaatttgggagctacggatcccccagaaggatctcggtcgcagattcttcttggttgctttgaacaaccagcctatgttggactcacagtccgtacatgatgcaatcgtccacgagtatctgcatagcagcagaaacaaagttggttacaagaagaaaatcatgcatgaacttagttttttacagttaaagggtgtatgatggacatgaagattacaaagaacaaggagaaactgtagatttaccctggaaaccagctgtgaaccgttgaaggattgccatcaagagcaagcccagttgccctgctaactgtgattgtttcatggacaaaaccgtgaggattgacatacgcaccaagaggaccatcagtagacatcactaccatgtcgctacgctttgctatgagagactgccatagttcaaatcatgtcaacacagagtgataaactttgtattgaaattctttgatgtaactacacgccatttccaaataatgtttatgatcaacgaaaaccaggttacatggagcattgttttcctagcagccaaatgagcctaatcagcaaatcaatatgaactatcaagtagtttgattttatgttagtgctaattcttccaatgctgcagctgcagcattctacaacgacaaactgtaccatgtcataccctgctgaaaaatgaaaatgggatgtacatacagataatttagcaggccatgacatggtaaatgaaattgctacgatacagatgacctagaatagttatccattttatatggaaaactagctaaatacttgtggttgataccaattaacagaattataacttcgctacagggagaacttgacagtgcttaaactccttgattatagaccaactcatatactgtgtgtctgtgtatgtgtattcagttagatatttaactactgtgcaattcaagaaaaattaaggggttgtccaaaaaattgcaatggtgagctgtcgggtgacagactcatatgattaacatacaacaccaccataaacaattcaccttcttttaaagtagtaacgaaatggccaacaataagtccattacttccaatcagaagctcgataaattagcaattccaaacatggtagatagttaccttgcagcatctacattttatgagattaaaggccttgagaagctgaatctcccttcgaagacgatacgagattccatcaatctccagtagcttttgtctcacagattctgatacaggaagtttgcttccaatggaaaatgacagaagatctggttttctcacgtaatcatccatgcttgggtgtgtgattatctgtctccagaggtctgcagcaaatgacaatagtgtattttggttaaaataaacatacagagcgagatgctcaataacactcaaaacgatcaatcatccaataagaagttcttttttgatgggaaacactagtggagtggtatctataaaacataagaatttacaatcgttgggctaagaatccatgaatgacaagaatgcattgtaaggctcagtttgatgaatatgggagcactttacctgcagccctacgagcaagtgcatatgaatcgtacatttgataagcccaccgaggccaaaatgataatggtgcctgaaaatgttgctttggaagaatgtactgacgctgctccttagtatctcttgttcctgcacttgacaaggatctgagcgatgttaaacaaaaatcctcctcacccatgttggtattctcgcctgactgaactgctgcacttccttttaaaggatgtagctcctggctgtaaaactgctcatgcatgaaaatcccatcttcattagaagatctcattgaactgctggatcgtgaatctgaatggcacatccttgaatcaatcgctgaatgattgcttgcagtgcttttaggtgatggtgtaccacaatccaattctgaatccacatgatcccgttgtttgattggagagacatccaaactgataactggtgaggaggtatgctgccgtaaactgttacatgatgctagctgtgcaaatgcatcccttggggttcttaaaggagtatcttcttcaatgatttggacatcaccccacacctgttgagtgagaaaaaatgaacctaacttctctccagctcctaattcagaataatatatcttcaattaaatttatacttaccaccccatcaacatccatccaatgacgcttcagacgaaatctttgctgcccacgggctacaacatttaatgaaccatcatccatcctcccaagttgtcttatctgttaaagaaataacaaaataccagcttaccttgtgaggctgttcgaaaggaattatacatcactttatacataaatcatactaaggggctaatgaccgagcttgacatgtaaacaagacatcacagtgcatatcggcctcatcttttcacttatgcttatgcttatcagccaaaatttgaattttcaaccttaaatttgaagccgattttgaggttttctcatcgaagtttatttttcagcctttgcttttagatcactaaggacacgtatataaaagttttattcacaaattacttttcgtttgcaaatacgccgtttggcttattccgcagataagccaaacgatggggctttatatgttctgttggtcttctagatcttgtgaagtatcagaaaactagatgagtacatgattctccaaaagtttgatagagatattgtgaccaagtgaaggaaattctgaaatattggatatcagtctattctaaatgaatgattcaattgtcccatttacaagaaatattaaatgctaactgctaagactgggtcctgattcttgaatgatataaattaactccctcatgtttttatttattaagcagatcatcttaattacaaaatgtgacgagagggtaacttatgtgtcctgtagaaataataacaaatcacccaaggatgatggaactggctacggaaaagctcaattggcagcacagaaaacaaccaaaccacatgaagaatcggtgaaaatgactaactgataaacaaattctaacttgaagcacagcagagaaaatgtacaacacctcggctgttgttccaactgaagcattagcataatgtcgagtactgtgtcgcttgtacatgagaacctgaaaattaaactgcgtcattggaaaggaattcaacaaataaaattagttaatttcaacagactggcacctaccacaccaattgtgcatggagcatcgacctgcctcaaagctttctcaacagctgctacaaatctaccctgaattagtctgagaggcagggtagctccaggaaataggacaacacctgaaacaaattcatattataataaatttgatgcttgataacctaccagaaaaatcctgtcgcatttacactatcactgttatgcattagtcaggagagagacaggtaaggatttgtgcctgttcttatgttccagatttaaaattaagaatatatttcactgcccatggagttaatatccaattgtatcatgaacccgcaggactggaacagaaaaatgtcgacataacaacactgtttagggatgcttgtagccttttagattattggatgccacttctctagtcatatgcattaagaaattatcaattatcaaaagaaacctcaggtcctaaactcactacaaagtactccgtatattcacatggctgtataactgcaatataaaggaaatagtgactaaaaatggtatgtgcaattcctctgaaataataagtctatataaatagatagtagtattgctcaagctctttttaacattaacaataacagtggatacgttaatagaccaggttatgtcaagtgagttcaaaagaaaagaatgtaacttagaagggctggcatgcagacaaaataatatggagaaatgatggcatgaaaaaaaaattgtgatcactaattagtgtgtcttcaacgctggcatgataatcaagattgcggattaacgaaataaaatacaaacatacaagacctaccttgaagatatagcattggcaagctgaggattgtgccaccatctaagagagaaactcgaccccgtgtatcatcaacctctgagtgacacataaagagtcttattacactttcttttctatcagcatcaaacatcatatagcaaggatagcgaggacatttaccaccaagataggtgtgcaacgaggctagagatgtgttgaatgtgaattgtccagaagtgctagccactccttccctgtcggtatctctgataatcaggaattaggaaatgaacaatgtgaaatctctcaaaaccatagttaagactaacaaacaaaaattttccaggtatctggccatgagctacagatatatcgtggcacacagcacacccaccaataaattgaaaaaatcagagagtaaatcaatatgcccaaagtgaaactttggtcaaggctcaagggtacacactgacaaggatcgtggcttcccctagtaacccccttccctcaaatccctacgctctctagtctacccgagctgaaatcaccaatcctccacatgcgagatcagggaaacaaacatcaaatcataagctaacgcctcccatcctcactctctcggacaggaaatgctatcggttgaattgaattcttaggttgacgtatttcaatcctagtagaaatgcacagtaccaccacccctagcaggtaaccaagtacgctgcgacccagtttctacttagagaaccctaggtcgcatcagagagggtaaaaaaatggcgaaacgagggaggggcgtcgcccgacctgaggaaggcgtcggcgccgtcgtcgccgccgttcgcctcctcggaggaggagccgtcgtcgttgaccatctccacgttgagctcctccatatcgagctgcaggatctcctccatctgccgccgctccctcgccgggaccccgtcccagtccgccatctcgccgccggtgccggtgccggtgccggtgcgccgcgggacggggagaatcacggagacgccggcctgacgcgcaagcgagatttgggttggtttccccttccttcctttctgggccgggtcgaggcccagctttctgtagacgcttctcgtcttgtcgagtctcgacgacgcaaagcgaggcgtacttgacccacacagcccaatacataagagaaagtttaatagtacagttcactactacctccaattcatctataaccaaacctaatacctaattcataaaatagttacttactatactattaatatatggtctcacccatcatatccacattgcgtcttagagtccgtgctgcaactgactatatatctgtagcccattgctcttctctcttatcttttatttcattaaaatatgtttataattagttaatagtctgctattgtatctgctctaagcagcgttccacaccattggcgggtgtgcaacaccggcgtgttttgtaggaggcgattgaggaaaaaaaatgaacacctcgatcaagagaccatgggtgtaggactaggaggcgaggttttgatcgatggcttgtttcagtgagctaatgatttcctaccagtttgtttttaatattactcactatgtttcaaaatattttaggatgtctagcgtttaaattttattatgtagaagtactttttttttggcattctatgtagaagtatttggttgtaaccatccaattattagatatgaactaaccattccctcaatatatatatatacatatatatgtatatatatatatgtatatatgtatatatatatatgtatatgtatatatatatatatgtatgtatatgtatatacatatatatatgtatatgtatatgtatgtatatgtatatacatatatatatgtatatgtatatgtatgtatatatgtatatatgtatatatatgtatatatgcgcgagcgtgtaactattaaggtatagatagattagcccaccagtcaagatgggccgacaattaaaccgatcaagagtgatgccatctgccatgcctgttcaataaggggcatggtatgtttttgattgttgcttaaaagttggatcaccgtctcccattcatgatccctcaaaccaaacacaaacacaccctaaattgttctaaacttactaaaaattcttatattttgagatagacgaagtacttttagctgattgaaacttaaaaatgcaatttgtttgttctacttaaggtagagaattattttcatcagaggctttaatagaaatttcttcaaaatgttcattagaggtttttactctatttttaactcctgtgaaaggattcactatagaaagtttcgttaaaaaagatttctaaatttatagtaaaaatctctatctaaaattcctagataaagtcttcagatatttctatagaaagaaatttaattacagaagttctttatttctgtagggagcttttgtcagtgactttcttgactactaggaggagtattaggttcgcgtagggattaaaacggtcggaaacgatatgaaagatctgaaaacacctcaaccatttccataatcatttttttctcagaaatgatatcgaaaacggtaaagtcggaaatgaaaacgatattggaaatatcggaaaaccgaaaacggaataatacggacggaaacatgtcggtacaaatcggaaaccggtaacaaatatgaaaacattaaactatagaaaactttacataagtatgatatatgtacaaataaattcaagctatactatataaatcataaattaactccattttagccatgcactcaagttaggaatttgattgaagagtcattcaacctctaaactatgggtcaagtagagacatgccctataaatatcgacatatttagaactacggtaattatcatattataagaaacggtaatttccacaagaatacggtaaatacggaaacgatcggtaaaacaataaaaccatttccgtttccatttccatatattttaccattttcatatttttttcggtcgattaccattttcatatggctcggccggtagaaagtcagaaacaaacgccggtcagccgggaattaccgttaccgttctcaccccgttcgcccagtgttcccagctcatcaactgtgaatccatctagttatgacttgggctaaaggaaactctaatatttgactgctcgagacatgatgcactcgatctcaggcaatgaaacctcatcgttacacgagtatataatctacagcaccattctatcgcttattcttacaagccgaagtttaaattttaaaacttaactttcgagttaattttgtgaatttttcatcatggtttactttttaaaattgctaaggacagatatatagaagttttatacataaattattcttttattaataaatctcacggataagtataaatgtaagtgaaacaaggggcgttaaaatacgtagtacgagtgagaaagctgaaaataggaaatatcttgcatttgagtaggaagttgctttcacatccgcctttacattcttgcagtgatggagtaggaaataatgttaaggtctttgagctataaaagctgggcttgaaatgacaactacaatcagtggcgaagctatatagtgtttgggggggggatgcacatgaacccctaaattcctaatttctcacttaaaaaaattagaatatacagtgttgtactgaaattttgtagattctcaatgatagtgcaccccccttgttttgatgctagcttcacccctgactacaattttaacgggacataccacggcattttaacattataaaatcttagctactatatatgagcttcaactcttaaatttaatttcataagttggatttggagcgaaagcggcctaaacccaactctccacctatctaataattcattttatgagagcactccaactaatttcacttccttttgatagagctggaaccgtttagttactatagatggccatgtgggccgcccggcacggcacggcccaggcccggtcgtgcctgggccgaggcttgtcgggccagcacggcccgaccgatgcatcgggccatgccatgccagcccacgtgccgcactcacggcccaacacgcctcggaccgtgtcgggccggcccgaaggcacgatgggccatcgtgcttttcctcagaataagtataattttccttcctcctattgggctgtgacttatatatagctaaaaaagtctattttacgtccctcttctttgggctgtgatatgtaaataactaaaataagtctatttaaggtccctattctttggacagtgacatttatgtctatttttagtccctatattttgtctgccgggcctggcttgccggcccatcgtgccaggctggcccgaccgtgccgggccagcccagcgtgccgatggggaggcccaggcacagcccggcggtcgggccggccggcacgggcccgatccaagtcaggccgtgccgtgctttgggccgggccaaaaagccgtgccatgggccgggccttcaggcctcgggccttatggccatctatattagttacgctccagctataagagaggcagaacaagagccatgaaaaaggcccataatatgacaacacttcaatcgcacaatactctcaatttaggagttgtaggatagtaagctaaaccctcctcgtacaacataggaaccagaggcataattttttgactcacactatttagctccttagattggtctctggagtaaaatggattcttccctgatgaagcacttgaagggttagcaaacttctcgcacggagccaataatagtttccactgagagaacttcttaggaacatcttggcatctggcaatgtggaaatttctgttaactccagggttctgttgctgcgacgcctgatcaagtgcaagttttcgattgtttgctcacatggattatataaaccaagcttcctcccagtattcagtagaacctttccatctattgggtcaactgcgagaggcactacaacatttgtcgcaagggaataatctggccagaattttaaattgattgcatatgctatactccacagaccatgatcccacttccatatatctaacttatctgcaactggatttgaaaggacagcacacaacattccctgaagctcgaccacaaatgcgtgacatggatttctgctgtcccagattgcaatgcatgaagggcaagggataacatcaaaaatcttagcggcaatgttaaaaaagacaatggcccgctcataactctgacccaaccttggttcactcatccagtacagcacaccatccagagaaacaggtggcatgtcattcacaggcagaggtggatcggggagtggctggccttgggagctacaactccatataatgcatgttaagtaatactgatgagattcgtagtttttccagtaatagaaaattcccacaacggcatgactctgagtcacctggcaaaaccccataccaacattcttattgccaactacaaaaggattgtagtctttgcagcgatcactagacaaattggaccattcctggtacagctgatggtctctgttctagtagatcatgcggtaacctgtacacgggttgaacagatagtctttcatctcaatgctcaccagattcaacccatggcaaggcttggagcaaaccacctttttgtccagaaacattgtgcctagatttgcctcttggagccatttactcaagggaataaagttgaaaactgatttttcagagcccttacccacaagcatgatctttggcctcctgtccatgttcttatgctcaaagtatgcatgaacaaaaccttcattctttatcaatccacgccattgcttacaaacaagttccaatttcaagattgattcagctggtaatcggagtaggatctccttagtagccttagacaagggagtagagaaccctatctctttcctcgtcctatgcactggggtaaaactctttgtaaatgaactgaatctaatatcagatttctcgttttgataggcactgcaggtcaccatgattgagacaatggtttcaagagttctagaaactggatcataggcacacaccttgtgcttagatgtagcgatgattatcttcttgcttgatctgtagctaccaaaggaaccaataactttcacaattcgtggctcaagtaaatctcttggcaaattccctgtcaaaccaattcggtaatcaagcgaccaatcaccagagttatagtcattcagcctccaaatttcaaacatgctaccagtaggcaagccattacgaaggtctcggaccatacacaactgatcatcaagctcagccaagtgcactctggatacctcaaagggtggtgatcggatccatctgaaggtttcatcagtgagagaaaatgatatgatagcagctcttggtgctttgagtaaaaacgaggggttgatcaaccagtggagaaatccgttaacaaaaactggctgaagtttgttcgccactgcattgcggatagcagaaagagcaaaactacagaacctgaaaggtactccaccagcggtaggcctccaatgatccccttcctcacccccaagaatgaatatctcacactttacagaatggatctcatgcgattttcctcgaaaaagcctcaccaccttgaactccttcgtccgggcatcaaacccaacgccagcagtggcatgaatcacatcttggtaaggtggcaaccgtgtgattgcccgtgtagttgcattgaagacgtagtaagctggcgcaacagcattatacaggagggtgaggccatggcatggtgaaggtgccacttccacatagtttccacgcacatcatcgagtgtgaacagtaggtcatcaatgggcttcgatggcgagcacgtgtacaccgcagtggagttgaaatttgctgtaggcgagataaacagaagcttaggttgtggtggcattgcctcagttcttgtgatgtagagttgacaaaattcctgggaagacaacattgcatacctggagtggcaggcagcccggaaacgaaggatggatttaatgggcagtcgtaggaacacctccgtcagcatctcctcaggtagcaccgcaccttctccgaatggtacaaatttcctcctcttgcttcttggggtcatgtcctctgtcatttccagtggttctctgggtggtgcggacctcgtcctcttgctgtctcgcatcatgttaccctcaaagttgaggaccaatcaggttgatttggaacttgatctgcaccctgcaggaaacgatgaatactttggatcttatgtgcctaaatcaacaacacaaaaaattggtaacggcaaggcacttatttggtttgatacaaggaaaattgcaatgccaatattttggcaaggtttaaaaaaagctccaaatatattcacatcaaatcaaacaaacccacttcgccaaaattttggcaatggctaccatcccaacatgcccttagtctagtgaattttttttgggtctttccttttttttttaaaacaagggagtaacccccaatttctattactagaaatgtaagattcttacacagatctgactcagactgggaaaacaaaagaattagagacctcaagtggcctattagagggtgccatcccaccactctctaacatgaagctcgaaacacaagttctttccacaagcctatttcaagacatgcaaactaactagaaaaaacaggacataggtatgtcaccacagaacatcggcatatttctgggtctctagtaaattttgataacatgcatgatgggtcaaatttgaaagaagcatggaattgaaagataatgccaaacgacgctcggctaatatttactgtttgcgatcaaaataaactgacagcaaaatcggcagttccgcagtagcaggattgttggggaactacttggatcgaaacgaacgcacagaacaaaaatcaatggtgcgaggaaattagagcggaagggttttaataccgtgctggcggaagctagggttagtggcggcggcttggggaatttctccgtcctcgacttatctctctctctctctctcttttttttattcgtcctcgactaatctcttcttgggcccttgctccgatccgcatcggaccgtgcaaagagggccacgttgtgttcgtttccgttctttttttttttttttgtattttggctctctgatctccctctcccggggtcccgccgctcgtccggcgaagccgacagccgcctcgccgtcgcggcctcgccatgagcctcttccccaccggagtcgccgcatctcctcgctgctctctcttccgctggaagcgcaagctccctaatcgtatttttccatggcctattggctctaccattccaccagagtgtagagttggggagcgcgaaagcagtgagatccgtcggcgatgagtgctcaccgcgggtgatgcagtcttccgccgccgccgtcgagatgcgccggaacccggaaggtaaccaccacaacacacccaagtccccacccctgtaccctgtttaggccttgtttagttccaaactttttctttaaacttccaacttttctatcacatcgaaactttcctacacacataaacttttaacttttccatcgcatcgttccaatttcaaccaaacttccaattttggcgtgaactagttttgcatctgtcgcgctggtgcagttggctagtgattagccaagcgaactgttcagatattgttttggagtttacgatgtcatgtgattatatccgcgtccacgctgattttgtcttcaatcgaacggaaatcggctgctaggagactcttatccattgatcggtacctgccaaaactctcacttgtgtggttgtgttgtgcaggcatcattgcacctttgtccccaatttggatgccactaggaaagaatggattggctgccaccacatcagacaaggaatcaaaacatcgaaaaggaggtagcgtatcctcagcttgggacccgtttagttcgcgaaaagaaaatttttgggtgtcacatcgaatgttgactggatgtaggaaggggttttcggacgcgaatggaaaaactaatttcataactcgcctggaaactgcgagacgaatcttttgagcctaattaagccatcattagtacatgtggattactgtagcacttatgactaatcatagactaattaggctcaaaagattcgtctcacgatttcctccctaactgtgcaattagttcttgtttttatctatatttaatactatatgcatgagtttaaagattcgatatgatgtttttgggaaaaaaaatttgggaactaaacggggccttggatttattcttattctctactatgtagttatggattccgttgtgtcagcttttttatatcgttagcagcatgatatgtatgcattgctgagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 169 - DNA, 32510 bp, Oryza sativa
  unsure (1)..(32510): unsure at all n locations
ngggggcgtttgggggttaagaagcgttgtgtaaaagggtgagtgtttttaaggtataccaggtccgtgtcacggaagggattttttggaaaccgcgatgttttttggtcccctggccccagggtgcgtgacagtacgtgaaccgtcaccccatacaagtgtttttggataaggggagtatggaaccacacggtaaggtctttgtagaaccgccattctccgcggtaaaaccggctcgcgtgggtcggacactttaaaatctggtactagtccaacactactaccagtagtaaccggttgtatttatgtgcaataatcaaaatttgcccttggggacatagggtcgtccaagctccaagggaaacatattatctgttgcacggtgcgcaactttagagtaagtggtttgggggatgtcaccacatttaatatggccgcatgtcaatgccccattcgcccatatcaaagaatggtttgttaaaaaatactatccggngnnnnnnngnngnnnnnnnccctctctcccaaacaccccctgagtaaggctgtaagggctaagggttgcacccatcatctgtgtacttctgccgtagtgatgtttgcagtcactgttaatctgatgatgccaggtcattacaaagtgttaaaatggataacatcgagcattgttgcaaatcacggaatattttctggctatcaatcatacataatctattcatattcagaattgaaattatagtagcaaaagcaagcttgtgtgcatacaaagaaaataaaacaaacatgtttggaacacaatgtaaatgagagtttttaagtgtgtgctgtgctgatactatgaatattatatctaggaagttactgatttttgttgttatatatgttgaagagtattatgaatacctagcaacatgatatatatgccatgtttatggttcatcaattagagaatcttatcataccatggtgacccactataataaacatggtgtatgttgcaggtgtaaatcaacgtctgagaggaattgtgttcaggataatagcttcagagataagcattcattaaaattccaaccaaaacctgggcagtgattattgtttcaatgaacagtaagtaaattgataattctgtgtgctaaggtgctgtcgtgacattatatgtaaactattcatagcagaattcctgactcaatactccactgttgctttttgtttagaattgcaatacgtgaataatgtatttgtagtttttgtactatcttcaacatctttacaggaaatacaattattgctctctgcttgtgtggctggtcctgggagatgttttactgcttgctgcatatcgaggttgaaatgttttcgtttggggggtgggggggaaaggtcactggtgggaggttgaaatgttctgtagaaagatgtcgtcatgagaatgtcccgtagctaaagggagagcgatgccactgtaaggatgaatagtgagccatgccattgtccctttatttaaacacattacccgttatccaggggaggtagcaactgctagctttcatgtactctatttctgttccccattcatttatcattcgctgccatggcagtttgatctgcatagattagaatttgcttttgtgatatgtttgaaactttccttgtgtttgaacccacgtcagattctcttatcaagatgtgattgaatgtactctttcgaccaatcattgaatgaacttattttacaccttttggtaaatgatactctttgttttttctgcaagggcaaaggctactagtttgccacgtggcccactgatttgagagaattttgtttgtaacttcaaaggagctattgaaatcgctttctttctccaactttttttttgatgtgtacaaagtaagaatcttttcggcctattataatcctcccatcggtgtcaatgattttatcaccgcattatgcttgaactttgaggtgaaaaaaatgatagtatcatttccctatttgattgttcctgcaatgtgtcaccctagaaaatttcttattttaggagttattatgattcatatatttggactcaacatatgttatttgaatataagaggtacttactaactaaaacattatatcagatgaagtaattcatagttttcattttttttattttcccaaaaatgattattcttgttctaagccctgcatgtgtgaattcttatggccttgaaaataaattgtcaactggacggttatttgtttgtgcctgtgagatattaagtttgatgcatcaagtcttgaaagagttcttacgacatatcagaagttgtcgcttgcatgcttctacataattatgtgataccgagaggcactaattttgtcttttcattgaatgagaaactgagtgaactaaaagcaactacaaaggttagatactttcatcttggatctttattaaataaccgagattattaaggttggggttgatgtgggaaagatactttagtaatttgcaatataatttgttaaaaatctagttgaccattagaaaatggtgtgaatgtatttttcatcacaaatccttttgttagttttataatttttagtagaatttagctataaaatttaatgggcggattttataatactgggtcctatgtcaactgaaatactgacaatatttttgtactgtagcctctataaatgatcacttagttatagatgagcaattttgatttctgaacaccaaatatacaaaatagtatcctataaagtatctccagaatctgcagctattcaagtcactgtctaaaatgtggatagatattgcacaccctgggataactcacttgtatacgaactttaaaatatcttcacttatgttggtgaaggaatagtaacaggctcctgggctatataaatgaacctcatgttctactttctgtaacttaggtgatcggcaacctgtgtattcatttttgggattgactcctactttaaaggcttcacttcgcctcatttttttcctgactgttcaatacttgtgaatggagtacggtaatttgcgacgtcaagcagcttccttgaaaaagagcctcttcgatcaggcttgtgctctgttcatctcaaatttcaagcattatagttgaggcatatctgagactctgcaaatatatccatcagtccttttgctatatcttcttctgctatttatcattcagcaagacatagaatacagtgttttgatggacatcaccttacagtcatgccattttaattgccataccatggattgacactattgcacacagataatgaaaacaaagctaaggagaatcagattgaagcacattatattaatataagtgggttatcgatatttctgtagagttcattccatttcgtacttatccccaccccagttagcaaagaaatgctttaaaatcaacgcctttcaccatttcggaactctcttttctggtctttatcttagtttaacatgtgttaagtgtgctggtttaacaaatcgttttgtattgacagggttacttggatgagcaattttgtcaggttgaggatttgcaggatgaagcaaatccaaattttgcagaggaggttgtttccttgttttttaaggattcaaccagggtaatgttgaattttgagcaagctatgtaagtggtgacaatttcataaactagacctgtcttgattatcttttcacattcagcagcattattgttggttactaatatctaacatcacacagtgagaagcatccgaaagacttcgccagatgggacacacacatgcagcaattgaaaggcagctgttctaggtaagcctcagctcagtttcttgtgagatctccatgttgtcatttgacggaactggcactgatggacttttacagggtgtttgaattttattgcctttttaggaaagtgtatgcctagtgcaattacccatttgtctaggaaaaaataatcctgcctttttccaacaaaccacctaactttgtttagaaaaacattgcttggagaaggagagccacacatcgcaaggtcggtttgttgggtgaaaatgaacatgattagattttctatattttgagcatatgctgtaggtaaacttaatttgaaatcttaagtttttaactgcacacaattgtatctttcaaaaagactatgtatgtgataataattttatcactaaatctaatttagagtgtcaagaatctataaaaagctaactaacattaccctataaaaactatatggccttagtttttctcccttcagtcttcaagaaagtagcttaactttcctaactggcatagttctcaggtttttatattaagtttatccttttctcaatggaagcaaatatgacagtttcgaacacaagctgaaggagaacttccagaagcctgatgtacctgaactcccaccacacgcacacacaacaaagaaaagaccttcaaataatggcctgcttaatatcttgtgaaattctagtgaacggtcagggaatatgttaaacagagatatttacagagacccatattgctttgattggtgcagccttgcaggtgcacagctggtagatcatgagtacatgctcactccttatttcattatttgacatgataaaagaagctggcaatttgcttagttatacatatgtgataatcttttgtgtactttatcaatgcttgacatgatatggtttgtcacagcattggtgcctccagggtgaagaatgaatgcacttcattcaggaatttctgtggagaagaaaacgccgaagggtatctctctctctctctctccacttttatgacatgtggtatggcatggtaaaagttcatggcttgagcattgtgattttcccatgcccatggctgttactgggtgtgctcgtctgtgcttgcaggcttgcagccacagcggctgtggcagttgtaaatggctgccggctgcagctggtttcaactgccgcagctgcagtggctgtggcaaccagagcatccaatcggcctgatcattacggaaaaaccaacaaagtaaatggctaagtgccagtctgccaccttgtcaaacttggcatggctcagtcgaggcatgtagaagtgtcacctgtcagccctcactgttatgagtgttagtacctagttacacatgcatattctgatgggtgaaagttcctcctgctagtgaactggaattagcccttgccgtctatctttttttgttcaattcattggcttatttcgtatgatgatagatctctactactattgttatgcagttgcacgagatccttccagaaagtgaagagggagcatgccgtcctcaggcagaagtgggagtcctacttccaggtaatcttcaccagccacttcgtacccagctttcattaatggcaatatatgtttgttactaaggttgtgttcacctcgttaccattttcaagcttgccaaattctagcaagacaacatagcattaccaacataaccttaccaaaataaaattttgtaaggccttaaaccaaataccacctaatgttactatatactccctccatttctaaatatttgacgccgttgactatttcaaacatatttgaccattcgtcttattaaaaaaattaagtaattattaaatcttttcctatcatttgattcatcgttaaatatactttcatgtatacatatagttttacatatttcataaaaaaatttgaataaaacgaatggtcaaacatgtgctaaaaagtcaacggtgtcaaacatttagaaacggagggagtatttcaccaaaaaaaaaaagggtaatgccaaagtttggtaagttttctttctgcaacaaactgaacacacctatggctaataaaccattcatttctccacctatctcataataaacacaacgtggctttgtgcagctgttgcgacaagctggtcctgctgggaccgcgactaggcctgcgggcaagtaagctataagcagccggctattgaattggtctcgggctgctgctgccgtggatgcgactaggctggtacacaagagcagcctgccgttgttctagtatgccactacggtgaaaacccgtatatagacgtgctacgacttatgagttgtgacatgcatgtctgcttgtttatgacaaaaataaaaccgatcaagattactacatcatcatgagattgctctctttgcccttattttgtccatgctgttgtccagattgcgatgggtttatatacagctataaccacagatgaaactgtccggctgtgtcggtgaccattgctatgctggagatagtgtgatcggccgacaaaagtttatgaaggtaatcaggactgatagccctgatagtgtgataggtattactgaactaactggaatgacaggggtgtatctgatatctatgtgatggacatgactgagctaactactactaagataagtactcctatatgcaaaagcatgagctatgttctaatcttggcggttaagttgcaaccactcaagatgtacattttgtgtttggctccttttacagctctgttacagtgttactgacaccggagcaaactctgacgacggaaaatttgaaaaccacaacctaagggtgtgtttagttccacgttaaaattgaaagtttgactaaggctgtgtttagatccaaagtttggatccaaacttcagtcatttttcatcacatcaatctgtcatacacacacaactttccagtcacatcatctccaatttcaactaaaatccaaactttgcgctgaactaaacatagcctaaatttgaaagttcaaagaaaaaagttgaaagtttatgtatgtaggaaagttttgatgtgatagaaaagttagaattttgaagaaaaagttgggacctaaaaccggccgaaatatgcaagtagtagttcctactttcacacaaccaatatggttcattccatgatgggaattcagaaatatttcctgtcaagctctcgctgagcagtgagcaccagcacgatgggaaaaagtggagtagcatttcgccgccggctttcatagatctttttttatctttttgaactttttaattttttaattttaaaactaaatatttccaagacttattttcaagatttgaacggtgtgacagtgttatttggtcacactgttctaatatagacaaaatgtctagattttgtaaataagtttcagaagtgtttattttttaaaataaaaaaattaaaaagtacaaaaagtaatttaaaaaaaatcctttcacgataccggcttgcggcttcacggaccgaatcaatcggaggtagccagtttggccactttggcgggagtgcgattaaaacctgtttgacgacgtcaactctccggcgtgccggcttaaggtagggctcatgtgtaaaagaaaaagaaaaaaaaactcaggtcgcctgcacgatgggaaagggtatccttgtaattgatacaggattcggcgtttgagtttggactctgcactctgccgcgcacgtcgtatgaatattggagcttaatcaggtcccagggattcaaacgcgtaccactattggttccgataaagatgttctacccaattggctccttgaggattccaaaacaaagaaattgtttactggagtacttcttgcgttgttcaaattatgctagactatagtaggaacaaagaacaaagaacaaaaatatgtctatgaatagttccacgcttttcaatgcttcaaagtcaagcctcaatgaggttaaaattttctattatcaaaatccaaactaactggaaagcaccaccggtgatatggggagcatcgaaagcaaatcgaagtaatttggttggggtttttacccaccaaaatttaaatcttggtgcgcatacaagttagcaatattagaaatttggtcttgtttagtttcaaactttttcttcaaacttacaacttttttatcacataaaactttcctacacacaaactttcaacttttctatcacaccattccaatttcaataaacttttaattttagtgtgaactaaacatacctttatcgttggcttctctttttaaacgtgtgttacttttttttaagatcttgttgttcatattattagatctttaaacgtgtgttactgtgttaggggatttattcatgagtgtattagtgtgatattacatgtgtagtagtttgtgtacgttaattggaaaaaaaacgaaactattcttaaaacaaattcgaattgccggtaacggcgaccagagcaaaactcacgcaagcgaagtttcaaatttgaaaacgaaattaaaaaaaaaaactcacgcgaacaacaacaaacccgcgacctgcgcgagaggacaaaccaaaccaaaccaaaaccaaaagcgaaacacagaggacaacacaaagcacggccggggggcggcgcaccgcgcacgacggcgacgagacgcgtggcggagcaacaaaaccagcccccgcattgccccgaggcggcgccgcccgagctcgaatccgcccaatctcgccggcggcggcctcgatctgagccgaggccgccgtgcgccggcccgggcggcgaggaatggggagcgtggacggagatttcgaggggctccaggcaggtgaggcgccccgctgatccggatgctctcgggagtttgaattctagccctagctgctcgaggtttgggttgctgcgagtttttgtgattttgggggtaaatttgtggcgaggaggagtggtggtcggcgatgggcgaacccgctttttctgcgctctgatttagtggttttcgagttggaattcagctcagcgacctcagtgattcgtgcatattcttcctctggttctaggcttctagctatcgccagcccagctattgttcagttactatgttttagtgtttgaagttagctggcgaccgctggattttgaattttttgctgtttcgatagtaaaatgtttgccgaagaagaaccgtgtgttaacccgtttttgtgccggagggttcaaaagttttattattatcatttttgatctgagatatcagttccgagctgccgatctgagttgtgatttttaatttctcatacttgctttacatgatggtgcaaaaaacattgtagcggatcggcgtgcggaagtgattgaatggctcaatgcgttactcccggagtactgtttgccactggactcatcggatgacgagttgcgggagctgctcagtgatggcacggtcttgtgccatatcgtgaacgcactcattcctggtgttctcgaggtgtgtccttttgggcttgaagaattttggcttttttgttgaactgtggatgttgatattggtgctctctggatgtgagtttttgtttgtttaggagtcgtggggtgcttatgcatcgtcagatcaacatgcaggccatgtgaagaagttcctcgcagtggttgctgatatggggttgccaggcttcagtgttaaagatcttgaggaggtgaggttggtcttatcatactatgtagttggtttgcagaaatgagttctgaaatgcaaatggttgagattagttttcttaaatgtttgcgtgctagccttattgtgctagtcaatataatggtgcttggccttgttgctcatggtattgcgttgctgacaagttttagtcatgcatacacatataagtagaactatatttctagagttttttttcccattataatctgtgaggaataaatgaataacctcttaatatcgcctaaccataattgcactatagtaataactcaaattctgtgatagattgttgactgctagaaaaggaggttagattattagttctagatttattctatgccggatgctgtcatctaggaagcaaatctgcaaaaaggattgacaccgcatagttaaaatgacatgcttttaaatactcgcaattgacggaaacatgcaagcattggagcaaatccccccaatttcactatttgtggatgtaagatgttacagtttttcattaaaaaaaatgtttaccatttccaaagttcctgattgcttatgttaactcataacttgaccatggcagggttcaatgtctggggtagtggactgcctcttggttctgagggaaagtgtgagttctggattacgtgatggtacttccaaggctcctttgaggaaaaaatggcgagttccagaaactggtgaacctcttgtccctggtgtggcacaagggaagacatcccctggagaggacaagaggaatggccttccagaccctaagtctcagcagaaaactcccatctttaatggtatgcacattgttgactattttggtgcatagtttaaaaatattagttgaaaagaagtccctacatgtttacgctttggctctagaattctgtactatatagtcaaattctcaaagggaaaatgacatgggctatttgtgattgggcacttggccatgttgtggggggtcaacgatttattggttgaagctgtagattggacaactatgttcaacatagaatcttagtggacatacaaactttctgatgaagctagatttgatcatggtggggtggttactttaacgtttcttaaattcaacatggcttccaagctccaaactacaaacttgttaacgtgtatgcttgctgcaagttgtaactcaagctattgtgtataatctatatctgggtcactactgttccctaccttttagtttataatagctcgtcatatatgctgcaggacgaaagcttcgtgagattttccaattaaaacgtggatcctatgctgatcttccggctgccaagatttcagaaatgatgcattctaacagtttagatgtaactttccattgcttatgcttgttgaattgttctatcttgttgtttgctattcctttcctaacagtaattaccttctcacagaatgcaccaacccaatcccttcttagcgtcgttaatggcattttggacgaaagcattgaaaggaaaaagggagaaataccacatgtatgtctgtgtttctgaattgcatgctctctttttcattggtatcttttaaatctaataaatttatctacctcacctcagcgtgtagtgtacctactgaggaaagtagttcaagaaattgagcgtcgtctttgtattcaagcagagcacataagaagtgtaagagagtcttttttccctgaagcctatatatcctttagctaataaatgcaactcatgaatcagatgtctcttgttgcagcaaaatgtgatcattaagacaagggaagataaataccattcaaaaatcaaagcacttgaaatattagtaaatgggacaaatgaagaaaaccaggtaaatattcagtattttcattgttataataaattacataatttagaagttctcccccctaactgatgacattgtggacttcctttcttcagatggctataaaccggcttcagataattaaggttagacctacactgaaaagatttgatttcctacatttgctatctttatagtacatttgctatctttatattattgtaataatataaacaaatgaaatattaactatataatgtttgatcatatattattgctataaggatgatatttgatgttaattttgttaccgcctagaccggtagaaattatggcaactgttatatcaactatataacatattatatatttttttctgcattcaggaagagaagtcaaaaatagaagagaaaaggaaacttggtgagcaagatgttgctcggctaatgaaagaaaaagaaatttctgaaaacacaatagctagtcttaagaaagagatggaagtcatgactagcatgcatgagcaacaacttcagaaaatcgaactgaccgcaaagcaaatggaagaacatttaactaccaaaattaaggaggttgagtctcttttagtgcaatcaaacaagaaaattgaagaagttgaggctgcttccctgttaaaatcacagttgtggaataagaaggagggcatttttcagaaatacatgaatagtcaacaactatatgtcaaggtttgtttatctttaacttgctcttacttccttttgtttttcatcttatttatgggttattgcttgaaaatgacagggtttaaggatatcatcatggtctataaaaaatgagatgcatgcccttgaaatggagttgagagatgagatgtccaattttggtatgtgttgtataatctataaagtaaacatttacttgtatattttaacattgtgttgcttaaacttttgcaggctctggtttaaagtgtttggttgatgctgctgaaaactaccacaaagttcttgctgaaaatcaaaagttgttcaatgaagtgcaagaactaaaaggttttttactgctcaaattttttatagcttcagaatgcacctattgatgtccatttcaatatctgcctcttttaggtaatataagggtgtattgtcgtgtaagaccatttcttcctggtcaagataaaaaatcaaccactgttgattacattggtgaaaatggtgagcttttgatctcaaatccatttaaacaaggaaaggatggacatcggatgttcaagtttaacaaggtttttagtccattttcttctcaaggtatatttttttacaatggaaatctggtataagcttatctgtgtgcaaataaattctaatacttatctttcaatttacagctgaggttttctcggacattcaaccgctgattcgatcagttcttgatggattcaatgtttgtatttttgcttatggtcaaactggttcaggaaaaacttacacaatggtactaacttttaccgatattttactggctcagcattgttgttaacttatattgatcttttttattggtattgtactggttcagcatgatgcactgctactaacttttgatcacttatgttctattccaataattttgttcttagagtggacccagcacatcaaaacaagattggggtgtcaattacagggctttaaatgatttatttgatatctcactaagtaggagaaatgctttctcttatgaggtgggagttcagatggttgagatatacaatgaacaagtgcgggatcttctgtcaaatgatattgcacagaaacgatatcctttttcatacttaaattgtcatttctaattatatttctggtacctatgtttttagtttgtaagagaatggttgtgttctctttaacataaaaaaacacttggcatatggagcacctctcaacctaatggacttgtcgtcccagatgcgagcttacacccagttaaatcaacatcagatgttttagacttgatggaaattggacaggcaaatagagctgttggttcaacagctcttaatgaaaggagcagtcggtctcataggttgagtgactgataactgaagttaaactatatcttttttgctctcaatatgattttattttgaaacacattattctatgcagtattctgactgtacatgttcgagggttggatgtgaagaatggatccacttctagaggatgcctacatcttattgatcttgcagggagtgaaagggttgagcggtctgaagcaactggagatagattgaaagaggctcaacacattaataaatcactgtctgctttgggtgatgtgatttttgctttggcgcaaaagaatgctcatgtgccatacaggaacagcaagctaacacaagttcttcaaagctctttaggtaatcaattatttagttgaaaaatcatgcatgtggagttagatttatggtttttgtaactataatcttataaaataatctcttgcaggtggacaagcaaagacactaatgtttgttcaaataaatcctgatgttgagtcatattcagagactataagcactctaaagtttgctgaaagggtttctggagttgagttaggtgctgcaagaagtaataaagagggaaaggatataaaagagctgctggaacaggttcttgctttttatgttctgtctgactcatcattaactgaaatttctttgcttttgttttacataattgctgaactatttagttctaggaagaaggggaatccttatgtgtaaatttgatgttcatgcaacaaattttcttgcaaatactgaagtaatttctaattgaacttagagctctattttagaatgttgctgatgttttactcaaaagcatggccattgttctcaacttcatattttccacaaatttattcaaacattctaaagaatcagcagtaaaacaacagcaatttccaagctattcctgaacgaatgttctcccaatagtaatacaagttatcatcaatattaggcttgatcctgaacaaatgttctcccaatagtaatacaagttatcatcaatattaggcttgagatacagaaaacctgctgcaaacaacctttttttttgtctagtatgaaaaaaatataaacaaatcaaaatggtgacttgttgtgatgttctatgtaattattcaagtctatatgctgctagtggtgtaaatttctagttgaactcatgttatggtttgtgcttgccaatgagacatgtttctgttataatgacaattccttctttttactataaatattttgtcctcccaacttgaaaagtcacttcacatattttgtccaggttgcatctttgaaagacactattgtacgaaaagatacggaaattgagcagctccaactcatgaaagacaaagtcaaatcgccaagttttgcagtcgatataaatggtgctagcatgccaaaaaattctaactctgacctaagatcagtattgtcaatcacaacaaaccaacagagccaactatcagatcctcagagttatgctgaggtgaacagagatggtggacctacttcatacactgacattacaccaacatgcttggatgaagcagattttgaggacaatgcatcagaagatggtttctctggaggaaccgactattctgttggctgtgctgccggtgccagcgttttcccaaattcctgctcagatagaaccgcagatacctccatgtactctcatctccctatatcacttacaccaaactaacttgcagctattaattgttctctcattacatttactcaatttgttgtaatataatcttattattctttatgcaacattatcttttcatgttgtgatgaagaagcattaatttggtacctcctaatgattgcagtaggagaatttcatcacgaatagctcgattcagtctcacaaagaatggacaaccagcaacatccagaccaaaaccaaaggatactgctccgaagactccaagtatgtactataagccactaatttacttcaacagattggtaactattactgtactgcctacacagttttagtatatgtgctcaacgagttcaaattatcatgccaatatcagaagacacttgccaactttgtcttggttttcaaaaacaaatggtaattttttgggaatagaaaggtcatgttgctccgtgcaaataatttcatacacatgtggttgctattattgtaaaacttttagttttttttaaagatatttttcaaatttttagtgcactgtccaaatagtttcatacctgcacatgatgtaattaattatccttggttattaatgagaaatatattgattatcagatcaaacgagagttcaatcgagccaattgataggaggctcttcactgagggcatctaaaaggtggcagaagtagagcacgctccggttgctcagttgtattttgtatgtccagaatgtgaaaataggcgaagtagctgtaggagacaatgtacttgtaagttgtaactctacagatgtgagagcattctgctgacgaaggacgagcagctgatgactcatcctttgctcatacagatcaaatatccaggaaaggattcccttttctgttctccatgtttcccctgtacttcaatttttgtcatggttactgcatctctggaatcaaacgtttccaattttggaagaaacactggtattttttatttttattttgctctgagcttctgacgtacttcgagcatgctcgattctttgggcaagccaaatgttactgggcatggaagtctgcgtggtgtaatggaagagagacagtttggttctctctctctcgatcaatggatgcttgcatcaccctcggaatcaatggtgtaaagcttcgctttggtcgccctttggacctaagttttggagtttgtcgattctgatagcaaatcaggtctgaaaaaattataatcgcaactgttttaacaaaatcactgccgctgtttcttttttttcgaacacactgccgctgtttctgtaattactgtaacttgttcagatgagaacggtggcgatatcgaacttataaagagtagcacggaaataacgagttgtcgccgggcaaagtccaaatgtatatcgctggagcactgaagatcccttgaagaccagtgactactgaacacttgtgcaaaagagctaagcagaaaaactgaagaactgaagccttggtaaaaaaaaaaacttatgcaaaagagctaagcagaaatactgaagaactgaaccattggtaaaaaaaagaaaacacacaaaaacacttatgcaaaagagctaagcagaaaaactgaagaactgaagccttggtaaaaaaaaaaagaaaaagaaaaagaaaaagtgaagccttggtaaaaaaaaaagaaaaatgcaaaagagctaagcagaaaaactgaagaactaagccttggtaaaaaaaaaaaagaaaagaaaaagtgaagccttggtaaaacaaaaaaaaaaggaaaatgcggtgagcgtggatcgaacacgcgaccttcagatcttcagtctgacgctctcccaactgagctatccccgcccttggttaattaatgatctactacaaatatatctgtatccttaagctatctcatataaacacattttacatatatcttcaagtagattatgtttatgttgcaatgtaattttgtgtttaaaattttattttgagagattgaacaaatcctgccattctgcatgcataatgaccccgtaacttataaacaagaaaagggcaaatcatgtttgatctttttaaaggggaacttacaaaaaccacctcaaatatcacactgagttcgagggaagaggattatctgacttatttccctctgactttgagtcgcttacgtgtggacccactaagtagagggtccatatgtcagtgacacaagttagagggaagtaagttagaggatctcaatccgagttcgagatccctgtaaaaccatttgtagcaatatcctttcccaattgtcactgcttgcacatatgcgatatccatcaatacgatccgatgtctacgctcaagccgaacctgatatgcaaacaaacagggttagcggaatcaggaaatgtagtaattcgagtaagtccaaccttcaaggaagaaggaaggcaatccgtcgcttgtttgttgcaagttctttccttttctctttccttatgtgttatatgacttagcacatcttttgatatacatggactcatcttccggcgacccccatctctaagagctgagactcgtgattaccatcgcccaacaacatgctggatgccagatgccgcaatcgtgccatcgagcctacccaatattactggtgaccacggctccttggctagtactccctccatcccaaaatataataacttttagctctcaagatttgtcccaaaatataacaacttctccaccaacattctcttcccaaccaatcacaactctctaccattcacttttcccatctacttccactactcaactaatcacaaccctccatcattcatttctacccactttattaataactgtgtcctactataaaaatgcttatattttagaatggagggagtagtattcaggtgagcccatgtggggtttgcggctatgagaacgggtgggcataggtgaattaggaggagggagatttgtgataaatcatcttatcgggagtatcgaattgagggtgacatttgggatggttttttaaattttcctttttaaacaagaaatactacgttttaccgttgataagtgattgactctacgaactgctatcaacgaacattaactctacgaaataccattaccaaagtgttttttcttctgtttctgccatcttcattaagtctcccattagatacattccgttaacacgtcatacaaaaaatacattttacctatagaaccatatctcagagtctcagagtaggaagtgcttgatatatttgaaggggtaaaatggaaattttgcataaagttaactaggtgcatttgatactaatgctagtggagttggcatggagaaaaaggaaaaaaaattaaaacactcttatgtgatgttataccataaaactcccgttctcgagtatcaaacattttctcctcataaataggtctataataataatcttatcatctgcaatgcgtcatatgacatagtacaatgtatgccttttgtgcatttctcgaacaccaagcccgtctagctcagtcggtagagcgcaaggctcttaaccttgtggtcgtgggttcgagccccacggtgggcgtccattcctttttttttctctcgtctccactccactggttcggagaaaccccatgcttgagctcgcggacagctcagacggagaagatcctcctcactttcttcagtttcctccggcacaacgggcagctcccgtcctcctctgccaccctgcaaccacagcgtttgcaattttatggtgataaggtttacaaaccctgaggttatcgtaattatcacggacgataaccacggttcatggtaaccacgataaccgttaataacgataatctcacttaggccgagtttagtttcaaacttctaattttttccatacacatgaacttttaactttttcatcgtttcaattttaatcaaacttttaattttagcgtgaactaaacacacccttaaaacagtttagtacctcgtgccgcacgcgtggcaggtggcggagtgcccgcaggggaggaagaagcagtccctccgcgcgtcgcagcacaccacgcataggtgccgcccctcgccgccgccgccgccgccgcctttttcctctacgtcgtcgtcgtcgtcttccccgtcgccgtcgtgcgagacggagtcgtacgacgaccccaggctcgcgtcgtcttcctctttgctcgccgccgccgccgacgacgacgacagcagcgaggctctcgcgtctcctcctccaggcccgggaccgaacagcatgttcagtatatcgtacatgatcagcagtgcaacagccaacagaactgcaattcagagggattaataatttagtgtgcagtcaatcctaccattaatttgagaggttcttcttgtaggtgattattgagttggtacctaatccgatgatgtacactatccagcgaggtccatatgacagcttcacataatgaccatcagaattcagtccctgaatgaaattgtgcactagactagtcagtactgcatccggctaaagtgagcattgtacagtatacgagaggaatctgaagatgacagagaagacgctttttgtcacctctttggggccggatgacagaaccacaacgttttgtcctaaaaacggcagtttgtaagtgcaaagagagctggccggtgagcatgtataatctgctgcgctggtgttgtagaacaaggtcctgattctgaattccagtagcacctgccagatgaaacctctgtaacaaggctgaagatgccacaaaaacattttggaagctctgtcgctcttgacacggggtaatttaccgttacatcctgattgttaaagtttcccaaggcaatgaagtactctgaagagagattgatagtctgcttgattgttccatttcctgtgattacacatcctgatagcattagtatacggattctcccggggtactgcaagtctgcaactgattcttagtcaatgagatcatgcttaccgtgcaccaagtgccaagataatgtggtctcatttgctgatggattctcagcccattgcaagaagctttctttgcctatgaagcagtgaagcaccaacacgcaagaattttaatggtgtcagtgaaactctgttactgatatgaaaaaatcacacttaaacacacttgttcatatatctgaacctttcttacctcgcgcaatgatcatgcagattggacgagacgattcagtttcactcctgacgctgtaagctacttctatctccgatcctctgttaaggaaatacacccattcctgcagcacacaacatggagtatagtaagtagcaactaatcttcaattctgaaaataactgacatgatcatgagttcagagtttcaaacagaatcacacagatgataacgcagcattaccatgtgagaattggctggtacgacggcgcggcgagcctccgaccaagcggctgggacgccgagaggcggagcgaccggcatcccgtagagcaccaacccattctccggcgaccctccctccgtccttgcctgcaagagcgagtgcacacattaaaacactcgtcctgactgagctcgtgcagagctacgggaggatggtcaccttgatgtcctgcgcaaagaacgagttcgtctccacaagcctcgagcaacctgagccgatgacgactagctccggcgagccgtggtaataccccaacatcaacgccgccggcgctgttccatcaatgtaaaggatcaaagcgagttatagcactgagacataggccgtgttcaggtttcccagcacgcaaagtgaagctcgtattattgcatgattaattaagtattaaataatatttttttaaaaaatagattaatatgattttttaaaacaacttttatatagaaagttttttataaatcacaccatttatcaatttgaaaatcgtatgtgcggaaaacgagagaggtgggttagaaaaatgggaggaataacacagccatattatgtgttgtcgatcagagagattcggagtaactgacccaagaaacagaaggcgaggagggtgacaaagcagagcactgccgccgccatgactgtaaagtctgtacccgtcgccggcgctggacagcaagacgacgcgtgagagaagctgtgaatacctgaacggatcacggccgcgggggattttgtggaatcggtgtcttagctgatgtgtcctggttcggtagctggctcgtgctccaactaccattccacctagccgaaagaacagagcagtagttagttgagacttgagacagaactcacagaaggcaattcgacacgagttagcgattgacattaggcttattcattttattaccactttatttgggctttggaagtagagaatagaagtaacctttgacgattagaagtaactatacagtaacggaaaaataactttaaaaaataattacagtattacaagtacattactagaggaaaataactctaaaaaaatagaaataactttacatggtattaaaagtaactttaaaaaatagaagtaactcatgtaagaagtggctacactggtagaggaagtaactctcaagaaaaatataagtaacttttcatgtattaaaagtagctctttgaaaaaaaaatagaattaaacatcctgggaatacctatattgctagatgatttaaaaataagaataaaatttagaagtagttatgatttgtataagtcacttttaggtcttattgaatttactatcataaatatctgagaagtaaattaatcaaatctagaaataatttacaacaaaagtaatttgcgtatataaaaaagtaatttacaacatatatatttatttttatcaaaatataattatgtaagatcttgttataaagatttaattaaagaatacaatgatactatcagagtgtggatccagtatataatttgaaacaaaagtttatttgaggcttagctattatgactattttttctttgttgttgcatacttgcatactcggaaatacatgaatgctaattagacataactaatttcggaaagtgcactcggttaaacatcgtattaattatgaaagcacaagctttgtagtctcgtccatattttttactttgaaatttactttgtgatcacgatcacttgtcgagttgaccccctcatatttaaaatctggcttcaccactgtacatgaacagtgtattttcatgcttaggcatgatttagtttccaactttttctttaaacttttaacttttctatcacatcaaaacttttctacacacaaacttccaatttttccgtcacatcgtttcaatttcaatcaaactttcaattttgatgtgaagttaacacacccttatttcctttaagaagatcatctaacggcttcgatccttgatcctattcagcattgcttcaaatcatttgtgcagaactgctcagctaccactttttgatgaggccttcaaacaactcttgtctaaaagaaaaggagcagctgatggagccgccgtcgccggtgcccaacagtacatccttctaaaatccaggacgacgcatgaagaaatcgaggcaagtttccttagaacacggcaatcatgctgctccgcgagcgcgatgaccttccccactgtgaacgcatcaatgtcgtacctgtcgtcgccgtcgccggctgcttgttcctccatcttcttcttcgtcgtcgtcatcatctccggcaacgagtcggtgtacgcgaagaagagcaacgccttgaacacccgcgcctccatgccgtcgacgcggacgatgccggtgctttggccgacgacgacctccttcgcagtcgttgcgccgaagagctctaggtcgaagacggacgaccgggcgtcgagcacgcaccggtgcgcggcgaacctctcgccgccgacctcgaacaccacgtcggcgccagtttctccgcggaggaggtcgccgaggtgacggtgcaggtcggacggcggcccgtcgacatcgacgctgccgggcgccacttccgccgggcggaactcggtgacgacgacgtcgcatcggacgatgaaggaatcgttcttcagatgcctcctcctcgacctctccaagattctcctcttgacgaaccggctcggcccctcgccgcgctcccgctcgtgaagctcgtcaaagacgacgacggcggcggcggcggcgctggcgcttgctccgcctccttctccgcgtcgccggcgaaccggaaccggtgctgcgcgtacaccggcgcggcgacattctcgtcgaggatgaggtcgaaggagatgtagtcggcgcagccggagttcttgccgttggggtagtaactgatgcgccattgatggcctccgatggcgaacgcgctcgacgtcatgtacactccggtgggtatcggcgtggtggccatgtagccgtcgatcgtgaggaggttgtacccgctcgtgacgttggcttggacgatggaggcggatcgcgacgccatggccggcaaaccttggtgtgttggaaatgcaggtgccttcagtttactactccgtcatcgtatgctgatcggatcagatagttaattaggccctctgatcttgtccgaatctgggtctgtttgtgcatatcgttggatcacgcgtacacaaggacgaagggaagtttggctctgaacgaccaaatgggccgtggaggctaatgagccggatcaagaaacccacaccagcaaattctccctctgttttcgatggttttccctgcatctgtacaactacacatagcagtcaaagaatgactctaaaaaggtgataaaatacaggcggtttcatgcgcctatgaatataacaaaatataatactagctacgattttatccctctaattcatctctgaatatgttaaaaaatatgtaagcaacatccatatctcaaacatagagaaattgttggtagaaactaattaatcaagcacgcaatatgcacaatgataggtccaattcggagcccacatatataacacggctataacactgtacaacgagctgctatctctgtctcaggttataagatattttgactttggtcagaatcaaactacttaatgtattcaactattgattggatgaaactaatttagtactgtaaatattactatatttatctataaacttaatcaaacttaaaatagtttgactttgatcaaagttaaaatgttttataacctgaaacggagggagaagtaactttcagagcatgccaatcaactcctccgtgatgaacgggcagctcctactcaggtggtagaaaccatcagtggctaacaccgccattagattgtctggaaagctgacaaaatctaagcaagcctttatgaggccatgggccatggcaatggtactggtcaaccaacgccatgatggacgccactgtgcccacgtcaatgtacttgcacaacttgctctcgcatatcagcttgagcctctccatgccgtacacttcggctgcgacaagcagacgctggcatatggcttcttcctcctcctttctcatctccggcaacgagtcggtgtacacgaagaagagcagcgtcctgaacacctgcggctccatgtcgtcgatgcggacgacgcatgcggcgtcgccctctttcatcgcgccgaagagctccgccttgaaaaccttggaccgcgccgcgagcacgcaccggtgcgcggcgaatctcaccccgccgccgccgccgacctcgaacgccacatccgcgtccttccctgcacgaattaggatttaggagttcgccgaggtgatggtgcaggtcgggcaatcggggaggcttattagcgacgacaaggctttggggcgccgccgtgtcatcgttgacgacgacgacgacgacgtcgcagcggaggtgaaggaatcgttcttcatatacctcgacttctccaagacttccctctcgatgaacttgcagcaactccgccactccggtcagcgtagttcttgagacacgtcgacggacaaggcggcggcactgggtcagaaatgcccgacatattactacgaatatttggatcacataagtaaacaaagttcctttgtttctgtttcactattctgcttaggaaggtacatgtcatttgctagcacatgtttgcaatttatctcgtatggagcaaatagaaattaacccgaactcttgggttccagagcaccataaacttcattgcatatgtaccgcaatcaatcctccaaatgaaaaatcatatatgggaaattaattattcaaatgggcaaccagtttcatgcacaacataggctaggtccttccatctagtatttgtaaatctattttctaaagctgtgtcgaagcaagatttcagcaataataaaagggggtggctgtcaagctaggaaagtggatgggtttggagacaagaaattttatacaggttcaggccttcttattcaagaagtaataccctactcctgtccggggatgattccgccgagtgtgttattaattgtatagactgggaaaaagaatcgccttccaagaggcacacggaccctccttatataagggaaggagtccgctttacaaaatacagtccatatcctaacggaatatgggattatagataaaatacaatcgtaaccgactaagatcccgggtatttccttgacatacaagtttagaacctaacccgagtattcatagagatattccatctatatttggtaccgtatatccgactaaattacaaccgtcatgtcgatatgggatatccataatctccacagtagcccccgagaccttcgtagttgacaaaatagccttctcgaaacaaaaaacagtagtccgagtgcttcaattcaacttgctccagcttgccgagtactaaaaatcaaaaactgtgaagggcgaaaataaaacatggtgcatcgagtagatgcacctaattaggtgtagcccctgactatgtgattagttgaaaaactaaacatatagtcaagaaccgagtggttttatagcgaagcacgcatggtacttagtaagatacccagccgactgcttctcaacttgaatgtatcaaggacaaaaaatacaagaagggccgagtgataaacactcaaaggtccaaaaatagacatgtttgataggaatccgagtaaaaatctcataaaatgacccaccaaacaggatagaaaatcatggtaattaatgagtccaatagcctaggctgtgacccttaccataaccaaaataagcatataacatgctaaaagaatgactattaataaaccagtcatctcaaatcaacccaaacagcttttgcagcctaataaagcttacaaaaaaatggtataacacctttctgtcaggcacctttttatgcgcatcataataattccaaagaattattgaatcgcgttaaaaaggattttaacagcattaggccacaccatcgtaaacacaaattgccaaagcaaaaagtgcctaagtccctagagatcacaacagaccacgctgattatagcattgggctgaagtactgtacaggcccaggcccattagtgctcccgataccctaataataccgaagtaaaaaacgtctcttcgtcttccccgccgagactctcgccattttccccatttcctgctacagtgcaaaactacgccgggcaaactagggttcatcaatccgctccaatccacactcaaaaacttcacgaaatttctccctgcatccaccgctccaattccccatccctttccagccgtatctcgaactaaatcagaccatccatttcacattcatggcggaagaaagagaaagcttcgagagtcagtgggcgccctccgatgtgacggaagacaatctgaaggagatggtggcgcacggcgttcttccagcaaaagagatcatcgggtggcgaccggcatttggtgaggcattcccgacctccgatacacacgaaatcgtggtatttgctcatttcttctacggtggattttctcttccaacctcaagatttttccggggaattctgaacttctacgggattagcttgcatcatctgaatccaaactccatagtgcatattgccaattttattcatgcctgcgaagcttttctgggcattaggcctcatttcgccttgttccgctgcatcttcttcctcaagccccaaccaaacaagagtaaaccatgcatcgttgggggtgctggtttccaactcaggggaacactaagccaaaaatacttctccatgcccttcaagacctcaaataaaggctggcacgcaaattggttttatgttcaaaaccccgagcctgttcttctcgagtactcctgtcttcctccagtttatcgggatacttggaactcactgccaatgggagacgaagctgcacaagcagtagaactgatggagaggatgataaagctgaaagaacagggccttcaaggagaacagatcacccggcactttatcaagtgtcggttagctccaatcaaagaaagatctcgcacagccttcgaatttgacggcaagcatgacccaaaccgtgaagatccagattctcttgacttcaaggtcatgaaggaaaggatgtataagatcttctcaaacgccatcgttgtcagctacttacacttgttgccagtcgtaccgttcaatgcattcaatcctcctccaccggtacgtattcatacacttcaacctttctcaaaacatgatcttgctttcttgttgaatcagttaacaatgaaggatattacacccaggaatttgctttgatgaagtcggatcccccaatcgctcaacgccgatcgccccgccaccaaactgggcaagggagcggaggaccaagaattcggtctgaaactcaaccaagtgcttctgatccaatcggccagtcagattctcgaaagaggaagctggttctaagtgacgacgaagccgatgataccgccaggaggcctggagaccgagagacaaccaagaaactaccaaagcaggctactccaaggtagaaaacatccagtcgccctgtgccaaagatcaggaagtcttctaggtgcaactcatataacgatctcttttgcattgatgcgcacccattgcggcaataatactgataatcaaatttgcaggaaaccatctgatatagatccgtctgggaaagactctgacccgactaacgtggacacaagttcttccaaagaaaccgagccaactgctgaggatcatctgagtgacaatcaaccggcaaccgataatgtagaatccggtgatcaacccccgactggaatccagtcggccgaagccgaagccggagttaatcaggagcccccgactggaaaccagtcggacgcagggccaagccaagagattccagaagtcgaaacccaagcagacaaccctcgtggacaagacgccagcaatgaccggagatctggatcccctttaaaagtatccgaatccactcgtcctcgtccagaaatcattacaggtaaacactttgtccgaaaccatgttgacccaaataactctgatcgatcgtgtaacctttgtcaatggatgcattaggaccaatgatcggtgatgaagaagaaattccccgtatacaaacagccgaagattcgtgccctcctattctggtcaagtggtgggatgacaacttgcaacctcaaggaattgtaataaaccggcaaaaagaagacgaagaggtatgcctactgaaaaaggcactcaaccaagcgactcgcattgtaaatgtaagttccttgacgcctaacctcagccatcttgtttaccgtctggctcgagcgctgattaaactgctccgcagaggattcatcttaggaacgaggcgaaaaccgcaaccctagagagactagttcctcatcttggaaccctcgaagccaccaggagtcaactgcacgaggccagagaacttaccaagaagaatgaacacgatctgagggatcggattgctgagctccaggagtccaatttcgaactgagtggctcatcaaaaggttcgcgcaaactctgcccaactgatttgtgctgttatctctgtaatcttgattaaccgaagttaatgtagtgcaagctgccaagatatctcaactagagaagcagatccaaactctggaaaatgacaaggcagagctggcaagacagagggattcggctttaaaggaggttgaaggtaccaataatcaatacctcaaaagccattatcttctacatgctgattcattaatgtgaatctgttgacgcagaccgcaagatcaagtctcaagcacaatttgatgtcttagttgacaagatcaacaagcttgaaggagccaaggataaagtcgctaatgccgctactccacttatccaggccatgttcttcaataacgccggttcgagtacacttgatgctgccgaaatcttcgacaagctgagagtcgctacagatacttacttcaagaacatcaaagaagctggaagtatgggagcaagtctggcattggcgatgaccaaatccctttatccaagagttgacattgatgccattgatggctttgtagacgggacgagcgaagaagctgctcttgacctcatcagtgatgcgtagaaagcggctgacaagattgctgctgatgtagttgagagattccaagatgtcgaccttcggccaactgggtctgataagtctaatgatgaaaaaactgatactgattgatataacaatgattttgatgatcaatgatggtggaagctcaatttgtacaatactgatgaatttatgctatgcttggtgttccatacttagcttctgatttcttaaaagcctttgtcaagccttattgagcctaaaacccgcaaaagctattaaaaaccttcagtcctcattggctaagtcgaaagaccaaacagggcaatgataaatcaagtaagcaaattgaattgataaaaatcacactccattattatcataatggccccctgactgaaaacttcaaggaaaaacttgaagttagcagtcaaataggaaagatacaagcgaaatgcctaagcataaaatcgacgaaggtgttcaatattccaagaattgttgatgagagtactgtcttcgcgcttgagtcgataagaacctggccgagtgacttcagcaattatgaacggttcttcccataagagagataatttatgccgatcccgtgttgtttgaattttcctcagaaccaggtcgccgactaaaaaggctcgcgatcgaacattccgattatgataacggcgcaatccttgcaaatatcgagtcgactgaattaaaactgcttctcgggcttcttctagtcggttgatgtcgtctactcggccctcttcatagccctcctcgttgaagttccgaaatcgtagtgattcaaattccacttcactcggcaacattgcttctgcgccataaaccaaaaagaacggcgactggtcggtagcccactaggagtagtgcgtaaagaccaaagtacggacggcagctgatctacccacttgctagcatagggacgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaatgctccgccagtgaattgagtgccattgtcagtgatgatcctattaggtaccccaaaccgatgcacaatgttgatgaagaaatctctagctttatctgctgtgatcgtgatgaccggtttagcctcaatccacttggagaatttgtcgatagccacaaagagatgcgtgtaaccgccgactgcccttttaaacgggccgaccatgtcaatcccccagaccgcaaatggccaggacaacgggatggtttgcaactcttgggctggcaaatgaatttgtctggcaaaaaattgacaaccttcgcatgtccgcacaatcttgtcagcgtcggacaccgctgtaggccagaaaaaaccttgccggtaagctttgccgacaatggtccgtgcagcggcatggttaccacaaataccaaaatgtatatccttcaacaactatatcccttcttccaaagacacacagcgctgcagtattcctgacagacttttcttgtacagctcagtctcatgaataatataaagtctgctgcgcctggaaatccgctcagcttcatttttgtcttgaggtagttcttgtttgctcaaaaattttataaacggttctctccagtcggcttcgatcatgcttatgccttgaatatccatggcttcgactgtctcttttctgggcacggtcggttcgtaaaggtgttcgacaaacacatctgaaggagctgcttcccgttttgaaccaaaattagccagtctgtcggctgcctcattgttatgtcgaaggacatgggtgagctcgagtccatcgaatttattttccaacttgcgtacctcttgtcgataagcggtcatattatcatctagacatgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggatatcaaaggaatggcataatattggctcatttgcaaaagcagcatttagcaaaatatttaagagaagtaaaacagtggagtaattaatcagaaattttaatcaacactgaacagcacacccatgctgcacaggcccaaccatcttgaacaaccatacccggctgaacagatctaactccaaaccaggagctaagcaaattattatcaggtataacatccataattattgtgagaggtgtgagactaatcccgaaaaacattgctcaactcgcccataaccgcgggccgggctattcgaatagttttactctggccagaggtgtacccctgtacccccaagacccagcctcaccatcatgtctaccatgcgtcgcgatactggaaagtacccgaataaaggctnnnnnnnnnnnnnnnnnnnnnnnnnnnnnnnnnnnnnnnnnnnnnnnnnnnnnnnnnnnnnnnnnnnnnnnnnnnnnn

SEQ ID NO: 170 - DNA, 15415 bp, Oryza sativa
  unsure (1)..(15415): unsure at all n locations
gccgacggnnatttgaanngcgcccgacnttttgagnnnnnnnnnnnnnnnnnnnnnnnnnnnnnnnnnnnnnnnnnnnnnnnnnnnnctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaattattccttttaaacaacaatttataagttaaggatttttaaacaagaaaagctcttaacaattatacttagatcattaatgatcaaataattactgaactgttctttgtattatttaagaattgagctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaaactaccccccttacaaagaatctcgtcccgagattcggaacggctagaaagaaaagggcataggtaaactgcagtctatcttattccataactccgataattattctaaggctttaaagaaaactactgctgctttgaaactggtggctgagctgcaacacttgaagacacaactcttgaagacgcaactggcactgcattggctcctgtgacgacaatgttgttgacctgaccttgcggctgctgatgcttcggcttcggacactctcttgcaaagtggcctggcttgtaacagttgaaacatacctgctgcttccttccactactgttattctcctgagactgatcctgctgaactggcaccggctgattagcttgcttgatgttaacttcattgctttcattagtctctgatttgatctcaccaccgatattcaactgttgcgattgtccttggccagcggaaaaaggttcaccaatttggagtggcttgatacgctgcctctggctactaccttgtgcctcctggaaaacagtcattttccttttacggttatccatcctgttcttcttgtcttcaagtcgaattgctttgtcaaccaactcctgaaaatcctcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtacactggagcaattccaacttcttctcaatagcgtgtagccaatcacctgcttccactgggttggtagtgctagaaaaggtaggtggcctcacacgaagaaaatcagctagcttgttctgcggcggtggagcattgttgttcccttggttgagctggttctgcatctgctgtatcatcatgttcattaactgagtctgttgagccagaacttgagcaagagttgggttcccttcattgttattgtttccacttcgactggcgcgagtgttcaccatctattgcagattagagaagataggaggagaggggttacactaaagacaagaccttaaccatgttaccactgatctggtgtgtgtagaccattatattgttcaagttgattaagcaagcaacctagtatagttacacactcatcaatgaactactccaatgatggaaatgcaaccatacctacacacaagcaaacaacaaacgttctaccctactaactattcttcaaagacactttggcggcataggttctaaggtaggatccaaacttcattccatcttgaccacttggcacttcagatcgaccatcaccttcttattcatcgatccacttgactgacctccataagtagacctcactggcgtcttcaagtttcaacaactagtttcagaaccacttaagttgaaagcaggaggggagaggatgataaaatgatttatacagaattctagagaaggaagaaaggaaaattttcacaaatcatgttttcagaaaatttgtccttaaggtttgaccatttggcttatcctacagtcgagatggctctgataccaacttgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggaatggcataatattggctcatttgcaaaagcagcatttagcaaaatatttaagagaagtaaaacagtggagtaattaatcagaaattttaatcaacactgaacagcacacccatgctgcacaggcccaaccatcctgaacaaccatacccggctgaacagatctaactccaaaccaggagctaagcaaattattatcaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattaaataataatgaatcataagttatcccaatagtgtgctaatgtttctaagcatggctaagcaatcatatctaatatctagttgaaccaatatatataaagctcaactagtccaattataatcacccaaggtatcaaggaataaagtaatcgagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttaaacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcggctcggcggagcggacagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacagcgatgacttggcgaacccgatggtggcgacgtgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaagagagcaagactgagtactacccactgtactcagcaagtcataccggtagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcaatgtattttaattaactaataccattgcggtggcaccaatccaaagctatgctcatagtcaaagtctatgtaataaggtgatccccatttgtgtgctagttgaactaagcatggctaagcatttcctaaaccaacatctagtcattttgatacccaggttatcaatggcatatggtaaacaataaatggctgagtaataggacccattccacatgatattgtaaacgaatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcacggaggggtgcggcgccgacaggcggggcccaccggtcagcgaccgggagagagagaaagggggtggcggcgcgcgggcccactggtcagcggcacgggggaaaggaggggcggcggcgccacgtggcggccgaaccgacggccccgatctacccaagggtagatcgccccgatctacccaagggtagatcggacggcggcgggacctctcggccggggcgcgcgggcgcggcgcgagacggcggcgaccatggcgccggcggcgcggcgcccacacggcggcggcgcgcatgcggcagcggcgcaaggcggcgaccgaatgcgaccgaccggctgtggggagcggcggctaaaggaggagcggcggctacgcggctaagcggcgcgcacgcggctacacggtacggggaaaaggagaaaggggagggggaagcttcaccgacaacggtcgacgacggcggccgacggaggacgacgacgacggcgggacgagctccggaacctcctatcgaaccaaaaggagagggattagagagagagaaaagagcgtgggagggcgagagcgccggccgaaggcggcggccatggcgccgcttgccggcacacgacggggatgggtctccggcggcgaacctcgacggggaaggggcggccgaggtagatctcgaccccgcgaagctaacggcggcgacggcgcgagacggcgacgagcctagcggcggctagcggcggtcggagtagcaaaagcggcggcggcgggtggttgcacggcgcggaggcgatggggagctcgggagagatcggcgaaatggggaaaaagcgagagaggaggacggcgatgcttaaaaagggggagagggagccggacgtggccgggagcggcgggattcgacggccgacgtgggggagtggggaggagaaaaaggcgggattcggttttcgaatcccggccatctcgggcgcgggcgcgaacgggagggagaggggaaagggcgcgggagacgcggcgcacgcgcgggcgtggccgacgtggcccgggaaaaacggaggcgtgggcgcggcggcggtttcggctcggcggcgcgccgggatcggcgggaggtgggggaaggacccgacaggtgggccccacctgtcggcgaccccgagaaaggaggcgggcggcggctgccaggctgggccctcggcctgcggccggcccagcaaggaggagggggaggaaggaggggaatgggccggcggcccatccgaaaagaaaaaaggagggaaaaagggagggaaaagaaaaagaaaaaggaaaaggattttccctggaattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacacgacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacaggtggggcccacctgtcagcggctgagagagaggagagcggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaattattccttttaaacaacaatttataagttaaggatttttaaacaagaaaagctcttaacaattatacttagatcattaatgatcaaataattactgaactgttctttgtattatttaagaattgagctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaagacatgaccactctttcatgacttgattgacaaccatctgagagtctccacagacgattagtcggcgaatacctagagatattgcaatcctttgtccatgaagtagcgccttgtattccgccacgttatgggacgcagaaaaatgtatccacaatacgtagctcaatctttctccagtcggggagattaaaacaaccccagctccagtgcctgtaagcctcttcgacccatcaaaatacatagtccaatattccatcttttcctctggcatgtcttcttggcactcggtccactcggcaaggaaatcagctaaagcttgtgacttgatcgaagttcgtggcttgaacgatatgtccaaagacatcaattctaaggcccatttcgcgatccgtccgtttgcttcgcggttatgaagtatatccccgagtggaaacgatgtgactaccgtgactgggtgactttgaaagtagtgagataatttcctaacggtaattaagacaccatatagtaacttttgaacctgaggatatcttgtcttggagtcggctaaaacctcgctaacgaaataaattggacgttagactttttgaacatggccttcctcttcacgctcgacaaccaggaccgcactcacaacctgggaggtcgccaacacatataacagtagcggctcttgcggatgtggcgaggccaaaactggtggagtggtgagaagtttcttgaagtcttcaaaggctttctgtgcttcgggtccccactggaaattgtcagtcttctttagcagcttaaagaaaggcatcccccgcttgccgagtcgtgagacgaaccggctgagcgccgccatgcaaccagtcaacttttggacgtctttttgggagcttggcggtttcatgttgagaatggcgttgattttctccgggttggcctgtatgcctctttgagataccataaatccgagcaatttccctgacggtactccgaagatgcacttttccgggtttagtttcatcttgaaagcacgaatgcttgtaaaagtttcttctaaatccacaatcaggtcatccttctgcttggtcttgacgactacatcatcaacataagcttcaacattgcgaccgatctgagttgaaaaacatctttgaatcatgcgttgataggtcgctcctgcattcttcaatccaaagggcatggtgatgtagcagtaggccccaaagggcgtaataaacgaggtcttcaagcagtcggattcttttagtcggatctgatgatatcccgagtaacagtccaagaaactgagtaacttgtagccagccgttgagtcaaccacctggtcaatgtgaggtaacccaaaagggtctttgggacaagatttgttgaggtcggtataatcgacacacatgcgccattaccccgtctttttccgaaccaggactgggttagccagccagtcgagatgaaggacttccttaatgaagcctgctactaacagcttggttaattcctccttgatcgcatccttcctgtcctgtgcaaaacggcggagtcattgcttgatgggtttggcgtcttcgttaacaagtaaagagtgctcaatcacctctctggggataccaggcatatcggatggtttccacgcaaaaatatctttattattctgaagaaaggtgatgagcacgctttcctatttacaatctaactcagcacctattacaacagtcttatcaagatcggagggatctaagggaatcttttttgtcttggcatcactttcttcggtcttcgtcagcttggttgaaggcacttctccctcgcttgccgtggtcgcagccagtcggatctcttcgcgggcgagagtagtctcgtgagtttgggccatctcgcaactttctttgtcacatgtgacggcttgcttgatgtcgctccgttgtgatatgacccctcgaggaccaggcatcttcatcattatgtaggtgtagtatgggacggccatgaatttggctagagccggtcgtccaagtatagcatgatatgctgtctcgaaatcagcaacttcgaaacaaacattttctgtgcgaaaattctcccgagtgccgaaggtaactggaagagtgatctggcgagtggtatagctgacaatcctgggataacaccgtggaagggtgcattactcggctttaattccgtgcgaggaatctgcatatcgtccagggtcttagcgaaaaggatgttgagtgcgctgccaccgtcgatgagagtccgtcggagcttgacattgcgaaccactgggtctagtaccagggggtaccgccccgggtggaccactcggtcgggatgatccgagcggttgaacttaattgttatctctgaccaccgaagatattggggcgtgctaggctgaaccgcattgatctcccgctctgttagcttttgttttctcttagattcataagccaggggtccgccgaagatgtgattaagttctttgcgatgatcttgaaaaccggtcggggcatcgtcttcatcatctttcttctttgatgtgccttgatctccgtctgagggtttacgtgcgttcttaacgtattgctccgcgaactgtttgtagacgaagcaatctttggccacgtggttggagttgggatgatgcgggcattgggagttcattatcttgtcgaaggtgttgacacgagaacgttgtcgggaagatggagaggtggtcgccacaagttcttcgagcttacgcttgcgatccttgtggtttttacttccactccctcctgcggtcggcgtatccttctttggcttccaagtggtgcccgactgcttggatgtcgtgatagcatcttcggctttggcatactcattggctttttcaaacatctgtttgaccgtcttgggaggtttgcgtccgaacttgtcgactaggtcctcgtggcgaatgcctttagtaaaggcggcaatgatgacgtcgtcggtgatgtcggagatcttgttgcgttgctcagagaagcgtcgaatgtaatctcgaagagattctccagacttctgaacgatgttgtagagatcgaagtgtgtgccgggccgttcaaaagtaccttggaagttggcgatgaagtggtcgcgtagctctgcccatgatccgatcgtgtcgcggggtagcccgtgaagccatgaccaggcagaatccgctagggccacaggtagatagttcgtcatggctttgctgtcccctcctgctgcgcggattgcgagaccatagacggtgagccaagactcagggttagtggtgccgtcatattttttgattccagtcggcttaaagccggctggccaatccactcgacgtagatcgcttgtgaaggcagcaactccgtccacgttgtcgtcgtagcgatccggtgaatgatggcctcttgctgtgcggcgctggttgatggtgtcgcgaagatcgatgggacgtcttcgatgtggggagtgtggtcgttcaattcggcgctccctatatcgctcgggaggcgagcgaacggaccgttcatcatgtcccctgctcctgcgactagattcggcgccggcaatgctgaggcttggctggtgatagtcttgagatcgaagatgagggactcggctaccagtcggggtgcgggtgcttgcagagttggctgggaccgaggcagcgatcatggtcttcgtctggttcaagatgttgactacatgatcagcttggttgagtgcgtcttccttgaggagggtgtcgaggagagtgattgctgcaaccgcgttctgttggggggtgcgaaagaccgctatcccatcgacgtcttgttgcccaatgagctctctcgcttgccacccagattccaaggcgcgttgtcgtcgatcttcagcctcctttgcaatccgttcgcgatcttgttgctcacgctgtagtcgttctcgctcttgtcgctgtcgctcttcctccaatcggcgacgttcagcttcttgccgtgcgcgatcttggtccgcttctcgggcttggcgctgttcctccgtttcgttgtcagccatgaatacgccgaagaagaggggcgtgtagttatccttatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatcatcaggaagtttcatcaggattgagggataggacccgtcgtcttgatctggtcgcggaagagtagattggatctcatccgagtggtttgaagccgactcgggagagatgatcttggagtaggcctcggccgagttcggaataccgaacggcacagggacctggtctctccccgactggtttgaatccgagtcaaggagagagatcttgccgaagtcgttggtgatgaagttgaggctgccgaaccggaacgcctgcccgggaggaaaggcgaagtcgtcgatgccagaaacgaaacccatcgcacttagtcggcgagaacttgacgctacccctacctggcgcgccaactgtcgaagcaagatttcggcaataataaaagggggtggctgtcaagctaggaaaatggatgggtttggagacaagaaattttatacaggttcaggccttcttattaaagaagtaataccctactcctgtccggggatgattccgccgagtgtgttattaattgtatagactgggaaaaagaatcacctcccaagaggcacgcggaccctccttatataggggaaggagtccgctttacaaaatacagtccatatcctaacggaatatgggattatagataaaatacaatcgtaaccgactaagatcccgggtatttccttgacatacaagtttagaacctaacccgagtcttcatagagatattccatctatatttgataccgtatatccgactaaattacaaccgtcatgtagatatggggtatccataatctccacaagctggcttgtctcgagctatcttattgggtcacatgacggtgttaaattttgaaatagatctaaggaaatcatgcataagagaaaatagccaaaagaaaataaaagacacaaatccaatttttaaagacttctcaattatctatctcttaaagataaatatagagaatatccataataaaaggaatgccgagaagcaaatagaaggcataacatccagattgtaaaggcttcccaaaatatctttcccctttgcaatctatcaatcccatgctggttggttttatgccagctgattgttgccctcaacattctttagttgagcgacacgtgacgacatacaagcgtcgaaaagagagccggttaataaaccctccctataaaactggcaagcgttcagttacaacggtgaatagaaaaacaagagaagagttgttccacgtgtcgtgaccacatatcctatatttggagaaactaaaagcaataaatagaaaaactaaatgacataaacaataaactctataatcctgataaccaatttctaaatatatgtattttctgcttatactataaataaataatatgtagatctttacgctacaattataataaaacaaatattaattctggtgttggatttatacctagagttttatgtcaaatctaaacaccataatgctcaaaatcataaaagaaaaattgaaatattagtatattaactatatggtttttaaaagccatacacccaagctaattagtggacgcgccaaacggcgtcttgattttctaatctacattattggtgattagtgaacctgaactaaaatttcatgaagtgcctttttttcaagttcacttagaaacttgtgtaaatattgatcacctaaaatttcatatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 171 - DNA, 710 bp, Oryza sativa
  unsure (1)..(710): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 172 - DNA, 709 bp, Oryza sativa
  unsure (1)..(709): unsure at all n locations
cgccccattgaattgagattctnnnnnnnnnnnnnnnnnnnnnnnnnnnnnnnnnnnnnnnnnnnnnattatttgtcactcagtcaatccacaacctgctctcggttcatcgctattttgaggttgcaagttgtcatcccaccacttgaccagaataggagggcacgaatcttcggctgtttgtatacggggaatttcttcttcatcaccgatcattggtcctaatgcatccattgacaaaggttacacgatcgatcagagttatttgggtcaacatggtttcggacaaagtgtttacctgtaatgatttctggacgaggacgagtggattcggatacttttaaaggggatccagatctccggtcattgctggcgtcttgtccacgagggttgtctgcttgggtttcgacttctggaatctcttggcttggccctgcgtccgactggtttccagtcgggggctcctgattaactccggcttcggcttcggccgactggattccagtcgggggttgatcaccggattctacattatcggttgccggttgattgtcactcagatgatcctcagcagttggctcggtttctttggaagaacttgtgtccacgttagtcgggtcagagtctttcccagacggatctatatcagatggtttcctgcaaaattgattatcagtnattattgccgcatgggtgcgcatcaatgcaa

SEQ ID NO: 173 - DNA, 1304 bp, Oryza sativa
  unsure (1)..(1304): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctataaggatgatatttgatgttaattttgttaccgcctagaccggtagaaattatggcaactgttatatcaactatataacatattatatatttttttctgcattcaggaagagaagtcaaaaatagaagagaaaaggaaacttggtgagcaagatgttgctcggctaatgaaagaaaaagaaatttctgaaaacacaatagctagtcttaagaaagagatggaagtcatgactagcatgcatgagcaacaacttcagaaaatcgaactgaccgcaaagcaaatggaagaacatttaactaccaaaattaaggaggttgagtctcttttagtgcaatcaaacaagaaaattgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattatatggngtagcggatttatttcgctagcaattttgaacccatctggagatttgagaacggtnaagggataggtgcgacagaagaaaaggccgcggcatcctgtgagaaaggcggattttgcggtatttggtgccgctctttccggtttcctcgctccactggacttcgctgtgcttcggtccggtccggcttgcggccgaggcggtattcaggcttaatttaaaagggcggtaaaaacggggtattccaacaaaaattcaggggggataaccgcacggaaagaaaccatgtgaacccaaaaggtccct

SEQ ID NO: 174 - DNA, 6055 bp, Oryza sativa
  unsure (1)..(6055): unsure at all n locations
atccactaaaaatcttgtaatatatggtgacatgtagaatccagaaaaattccacatgccgattccgattaatatttgcatttattaattagggaattagctctaggttaattaaaataatttcttcggacgatttatttagccaaatttttaaagcaagcaaaaaggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaacccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgataccagaagagcggagtacgacacctccgtccatacagtgcttcaaatggtgccatctgcagactagcttggtaactgttgttgtacgagaactcagcatacggcaagcttttgtcccatgccccaccaaaatcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgggccactttggtgagtcggtcaatgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcatgttgaacctcacagcatagttcctctacccatgcgacgttgcagtaactcttcctgctcaaggcatctgctaccacattggccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttaaagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacaggtcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctgtcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcatagcgcgcgaggcggttgaactcatgcaaatactctataactgttctggttccttgttgcagggaacggaactctctcttcttttgtgccacgattccctcgggaacctgggctttattgaaactatgacaaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaacggcatgaagccagtcgtgggcctcgattgggttggtggtgcttgagaaagtgggcggcttgacacgaagaaattctaacaatttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcgatcgttgggttctcgggcggtggggacggactgttgtcagatgcaccgttggcacgtgctccattgatcggctcttcgctgccactggcgttgttggagtcgcgtgaaccattccttgtctccatctgaggggataggtagaaatatgagaaaaggaagaaaacaggggctcagaaactaatcttgcttatgaatttaagtgcaattatcttaatcttgattaaaacactgaaaaagaggcacgaaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaatatttttcatgaactcaaataaagacactaatgcaactaaacaataaattaatgcatagactagttgcatggaaaatgatgcgcataacattgcccccaccgaatatagacacgacctaatgcataacccccaataaattcccgactgactgtcgaataaactccaactaaaatttttctaaagccctaggctgagctcattttttttttaaaaaaaaatccgatccgaatgaacgaccaagatttttcccgcaaaccaaagaggcaaaactccaaattttcccaaaacaaattccaagtgcaaaagggcatatgcatatgaaaaggggttcagagggctcttagggtttccagttggcttgtcctacggtcaaggtcggctctgataccaacttgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaagagagcaagactgagtactacccactgtactcagcaagtcataccggtagaggaggtatgatgcaggatataaccaaaggaggctagaggttcttttgcataaagctagcatttaaaagcannnnnnnnnnnnnnnnnnnnnnnnnnnnnnnnnnnnnnnnnnnnngcgatatccaannnnnnnnnnctcg

SEQ ID NO: 175 - DNA, 920 bp, Oryza sativa
  unsure (1)..(920): unsure at all n locations
cgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 176 - DNA, 936 bp, Oryza sativa
  unsure (1)..(936): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctacctagtgttcagaaataccacatgaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgataatttgccacgcctgcttggtgttatcgaggaaagaaaccctgggagctcttacgaagtgaagaaattcccctcaattgaacatcctggcaagagtgtgctgcaaagggcgttcttagctctacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 177 - DNA, 760 bp, Oryza sativa
  unsure (1)..(760): unsure at all n locations
ggcgggttagacgcctgnnnnnnnnnnnnnnnnnnnnnnnnnnnnnnnnnnnnnnnttcctgaaacactgaaaagaactggtgagtgtcatgatgcagaaatttcaagagaccacatggtctacacaacaaaagtaatatcatacctcagaatttatcacagtcgagttgacagtcatggaagatgcaagaaggttggtagagaaaataacatagtgccggagaactggattttcaagcttttgcacattggagtactccatgtcagcaaaggatttaaagtagtctactgtcaatctcattgaaaggcagtggaggctcttaggtaatgtctgaactccaagccggtaaagatatgcaccttgtcttgcatgaaaatgagcttcatcctcagtcatatcaagcaattgcctcagttttttctcaaaattagtgcattctatcagacatgattttgctgcagctattgtcttctccatctttgccatattggctccatggcttcaaaaataacaaataatcactataacaaaacaaataatcattatagcaaactctaaacctatggggaaattttctgttccaaagtgaatctgtataacacattgagccatcagatcatcagtccactcatcatttagaacttactgctacaattattggtaaattattcatcccaatatcacacttttagcttaatacaatgnnnnnnnnnnnnnnnnnnnnnnnnnnnnnnnnnnnnnnnnnnnnnnnnnnnnnnn

SEQ ID NO: 178 - DNA, 858 bp, Oryza sativa
  unsure (1)..(858): unsure at all n locations
aggatcgggttgcgggttttaagatgttgttgtttgattcttccacctttctgatatnttatagattttggacataatttnaaanctccccctccccccnccccatgtgttgatggcacntggcttgcnagcnccncnanacnngaggaanagggaacccccacacgcagnagncaaacaaaactacgctaggaatcacctcacatccgcccatgatcgtgggcacggctgttcgaacagtggtggtaacctctgcagagggggtacactttacccacacgatattactaacccggatcacccagcccgtggggatcagccacgtcgggagacctccaagctttcatgacaaggcattttcaaagccgacacaggcttaccatatgccgacgagaggggtcccagaccaacaacaggttaggtcctagaccatactgtgccaggaagcccaggggtcctgtctgacaccaccccggcgaattcacatgtctctcgggatcatggctcccctgataagctagttactcagccaggggtgtcccatttcacccatgtggtcgcacttgtcctatgttcggatgtaattccaaggaatcggtccttaagtgcgggagcgggaaaaccgtacacccggtatgttccccggtccgcggttttagaaattcatttagttcgcaagcaccgacccaggtgtcgggtttttcaagtcttttgtaaaacccaaagtttacccaagttgtttctcagattttaagtttgaaggcgaccgccgatactcgcacagagtgcacgaatatcgaggcgccattgggtgggtacaagggacatggtttaacaattaacaaaggagggatcaag

SEQ ID NO: 179 - DNA, 1671 bp, Oryza sativa
  unsure (1)..(1671): unsure at all n locations
ngaccccgaaaatgttcccaccccggtaattcgatcctcttcttctcccggcgagttttcctttttccctcgcagcggttaacttccgtcgcaatttgtcgtcgtcggccctttccctttataatccgtccggtagcttcactcctcctcgacccgcttgtcgctccggtggtattccctcctcccccggtgcctcgccccgccccgccgacgggcgccactgtcccctgtccatttcggccagcttttgtcttccctcctctcgccatccgacgcggcccccaattaggcgccacgtcggctagaccaagtcaacccgccagcctcgtccccgctcgcgtgcgctcggtccacggaaagcctaccggctgtgcgtgggcccgccacccttcggtccacccggtgcaccaaaccgcgcgccactcccatccgaaccctagcgcgcgccacatgcaccgctcccacgatgagccgcgccaccgacaagcgggccccactcgggaccccgcaaggtggactcggcccaccggccctctctctccctcactctccccgcgccccttgggccgcctctctgggccggccggcccattagtttggccgagccgcgcctctcctctcgggccacgcccaagccgcccgagggagtctaaatcacatccctccaatttctttccaaaaagggtttaataaattattaaatcctttttcctttgattagtaaatccaataaactttgaaaatccatatattcccaaccgctcatccgattgactccgttccacttccagtaattccgtaaaattgagatctatttaatggcactattaattaggctaaataggatctttcttttgggtcttgtgtaggttttcgattgtttgcgtatagttgcggttaccggattttcgtcaatcgtggttttctcggagattcgtgaagcttcgtgaagaccttgagcaaggcaagtcaccctttgatcaatttctcctataattggaaagtcattattattttgtttgcaacttgcattattagaatcactcacgtttaacttgcttggcctcggtttgcatgccaaaccgacagacctacctagtagtcgcactaattcctgtaggctgtactaccctgactccttatcgctccacctttgtggtaccacggtatccgtgctctctgagcgcgtataccaaatatcccacatacaccgttgtttatcgaaaacttgggaaatgggtttgtaaagccttgaaaacccgacatgtggtgtcggtgtgtttaaaaataaaatgaattgtgaaaactcgcgatgcgggggttgtgcctatgtggcactgtcccgtattcgcatataaggaccgattcctgtgggaaacgcatcgagcataatcaaagtgcaaccacaaggtggaatgggacaccctggctaagtacctagtcggttcagggaaacctcgcaagccaatagttgggtccgcctgggcggggtcggttggngccggtccgggttcctgggggttcnntttcctnnntnnnggnnggtcaatccgacacaaacaatnnnacactggggggggggnggngaaattccaaatttccacaacaccgcgaatctgagaaatgtgaggaactaccacacaatttgccccattattccaccgttcacgg

SEQ ID NO: 180 - DNA, 1174 bp, Oryza sativa
  unsure (1)..(1174): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttactcatgattgaatttgcgagtaaaatttttattgtttggtgacatgaataaatcttagacgttcatatttaaattcaaaggcagttttctagatttcgaatatatatatatatatatatatatatatatatatgtgtgtgtgtgtgtgtatggtttgcactatatattttcccattgacattcgttgtagccgttggtaaaaaaaaaaaaaacagtattatagaccagtcaagggacccagtggagtcaggtctaagttgtcgatcggtccggcgcgacggcggctgacgcgagaagattttttgaaggaaggagaaaaaaaaacgaagagagggtgttgtacgcggacgactcaatcggttagctcgcttcgtcgtccaccgtctccctcggtcaccgtcgccgcgcacgactcccatccatggcgatcgagctctgcccatttaagcccggggcgcctctcttcgaggacttgcaaacgcttgctgcaaggattggatcctctggcttctgttgatttggggagcttttcatcgtctcgaccgaacggccagccgccgagatcgaggaaggaggagatcgaagggcagagtgatttggcagcggtggacatggatgtgaggtttgggcccgaggagcagatcgtgtggccggcttctgttcttgctgggatcctcatgtgcgcagcggtaagttgttccatcgatctcttccattgcttagctagatacgagagtgcattcccagtaagtcctactttgatttgtagaggaaacataagatacttagaggatttcaatattgtacaaaagaaattgaagaaattcctatgaaggcctttgaaatcaatcttttttaaaaaaaaaaatcctacgaaatggacaatattatagagatttagaaaaattaaaaagagctccaacttttttgaaaatttcctttgactatatttcttttatctcctactgcctaatcaaacaacctgttttgcaatnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 181 - DNA, 1144 bp, Oryza sativa
  unsure (1)..(1144): unsure at all n locations
ngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagccacactttcttgctggcggtcgtgcgccactggctcgcgggaccgctcaaccgacttacggtaccgcggcgccggttcgcgggatcgacgcagtcccacactgccgttccgcgtgaccgcctcggtcccgctgcgccgttctgcgcgaccgagcgggcgtcggctcacagcttgattccacaccctcgttctgcgtgaccggtcccgtacccatcattccgcggcaccgctcggcctatcggtcccgcgccgccacgttgcgctttcgttccgctcccgcatttccagcgtgtgggagagatatatttctgtaaatccttctcgcccacgtatataaacgcaaaatgcgaaaaaacaagatattttttcaaatttttttcccgaaaggacgaggttagcttacgaagttagtagtcaacccaaacgctaaccaaccaacacgcggaattttttttttattttttttattaaaagttttacaaaaataatttttcattttgaaaattgacagaagtggtcgcctaccgccctctaggagggcgatttttaaaaatcgccatcccagagggcggcgaaagtgatgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttnnnnnnnnnnnnnnnnnnnnnnnnnnnnnnnctgaggcgcagtgcaattcgaatntcaatgggccagt

SEQ ID NO: 182 - DNA, 1812 bp, Oryza sativa
  unsure (1)..(1812): unsure at all n locations
cggcttgttgatagattcctnnnnnnnnnnnnnnnnnnnnnnnnnnnnnnnnnnnnnnnnnnnnnnnnnnnnnnnnnnnacacgggagatggacaggaatgcccctgggataattaggttgggttggaagggttatgtggctgatggctgtcacgtgtgtatgggacatgggacgccatcaactaataatgacctttcacctttgtgcaaaggaagattagtcctaagtgagatttttaataagattagtactttgaagctttggacaaaggactctagctagatggaagcttaactgacaagcatattagatccaggcttttgccaattttgaaacgattttttaaaaaaattcaggtttattcgcggttatgttagaatgtgcctctagcaaaagaaaaatattgatttttttaacttagcaaaaaagggtttcaaagtcagtaaaaccctgtttaaattctactattttcttttcaaaactttagtccctatttttgcattacaaaatgaaaaatcatagtccttaaaatgctccttaaggtaaaaaaaatattgatgtttaggaccagatttgattctcaaaatattataagtttaactaaatcttattctgaacattaaatatttatttatgatagaaatcaatgaaaaggataagtagtcaaagtcaatggacttgtttgttcgagcctatttgttgcggttcatattttcgttagtcgaaggcatgatataaaagtttacatttctacttttattggctctaaactaaaatcgaataccgggaaacctctaatgatgttatttcatctatcagagtttaaatcttgatgcacacgaatattacgcatattcaagtgagttttcaacaggattgcagttagatcagggatgtaacgttggtttccatttattagagcatgtgttaaggggacatattcgtgggagtgtgagtgtggcgttggtgtgtgtgcacgcgtttcgtgtaattaaaaaattaaatcaaatatagaaatgaacggaaaaaaaaatccaaaaatgaagtttgaaaatcttaaattgactacggcgccggatctgctacaccccaaaatcctgtggtgcacatgaacccaagagagtctcgaaccggcgaaaagtcaaaaattctctcgcggaatcggatagaaaccgaaggggcggcacggcgtcaacgcgtggcgcgagggggatattcgggtggcgacgatgaggtagacaacgcgcgtggggcgccgacgncggcgtcagcacgcggcgtggtcggctggagattacgatggctaaacatggtttttattaggggagattattattattattatcagtggaagccaaggaaatgatcccatcaatcgactcgtacacccaatcacagtccgagatttatatcgttagctgaccaagaacgggtagtcaagttgcgttgatttttttctgttatttaggtgcagctctttttattattattattttagattttcatttcaagcttgccaaccttgtaaaaagttaattcttcgtttatatattttctgtataaaattatctggaaatttttttgaataatatctttttagttttgtaaaagttacttcatacggtcatataataacccatcaattattcataaatttcaactatatcaaacttgtagtacaacgatatgatacgagtttatatcgatcagaaatgcaactgtcatagctagcagaggggcagagacaaaaatagnnnnnnnnnnnnnnnnnnnnnnnnnnnnnnnnnnncaaacacaagnttcattgacac

SEQ ID NO: 183 - DNA, 1743 bp, Oryza sativa
  unsure (1)..(1743): unsure at all n locations
tgcnctatgtgnnnggtgangctgcnnnnnnnnnnnnnnnnnnnnnnnnnnnnnnnnnnnnnnnnnnnnnncatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatacaggtgtggtgatcgttgtcaggttcttcgttccataaatcctacaacattgggtcgaaggttctttgtttgtccaaatattcttgacgacgatttcatggtaagaatattttgattacatgattccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattattacatcgtcgttgtgttcaactattgcactacctccctcctagttcgaatctaatatcatctatgtaactgcaatgcaaatagttgtatcatgttcaaattgtactactatttcttcatgttacataattctccttgtttaagtccatataatgtttctatgacctagactgcgatatgcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgttgatataagaaacaaacatttaagtacaaaccagagtacatgttctggaatattacagaaacttatggaatatgtctatttccattgtattcaagtaaacctctctctatttggaggcattttcatttctattcttttgtgccacccctttttgatgaagatgaatttctcttctttttgccttctaattcatccccagaattatgcttctcctgtgatatatcttgttgcaaatcttttcttttgtttgaaacatctttctttttctgctctacaccatcctgcaacaaaaaatatctttctttattactttttttaaaaaaatcaattcatatggatttgtaatttttggtacctgttctcttggatttttaacctttccttgtttgcctttagaacaatacacaaaagaagtcattataaaaaaaattttcttttaaaaaaaaaaacatgttatttgggtgtaactttttggagctgaaagaactggcatgaatataggtctttttgctggatttcttccctaattggctctgatctttgagctggcctgcctttggattttgcaatatctggatccaacaatatttcctctgtatttcctcagatggtgatggcctggtcatgtgaggtcaaattgtcttctgcatttggatctgaatcattgatcttcttgctttgcatctttatttgacacatt

SEQ ID NO: 184 - DNA, 3913 bp, Oryza sativa
  unsure (1)..(3913): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatgtgaaaaagtatgcccgcaagctttgaatggccggcaaaaattccattaagccccttgccgcctttgttatggccgccaaggccctaatcccaatttggnccgacgccgcaagacggcgcggtcgacccaccgtttgttacgtcagcttgccgcccaccatttgggcggcaggggctatttctgcaatttttttggtcgatagattatttctgtaaatattaaaaaaaaatctaaaacggaaaaaattctttttgaaagcgggtgaagatgacggcttggtttgaaagaaaagggtgggtgggccagcatgcgatcagattgggcctcatttatagggctagctttcttgggccccaagcccccaagtgcatcttccccgtgaggaagattaatgggctcaaatgtagaaagacattttaccttcggaaaaaaatccactttaacttccttaactggtcatcaaatctaattcgtgacccttaactaaaatatcgggtaagaccgaactattgaaaccagtgtaatttgaattctctagcaattttgaagggtggttttgttgtcgtgggggtgttgatctggtcttcatgccacgtgacgcttatatagcattaaaattttaaaaaaatatatgtgagacctactgacatgtggggcccacatatcatcctttattcctccccctctctctctctctcccttctctcacttttctcttccccaccggatcggcggcggcggcgtgcaggcaatcccctccagctccgcgccatctccatgtcgtcgtcgtcgtccgcgtcccttccccccccccccccttttttcgctacaccgcctcttccttttcggacggggggggcgcttcggcagtacgggacggtgcataaggtagaacgttgtgaagaatggttaaacagttaacagatggttattcacccaaagttatcagcatttaggcattacttcagtaacacagcctgatgttaggcgtcatggtattctgttcactagtactgaactactgatcagattatgatgttcttctgccctccctgctctacagaagagtggatcaaatgagagaaaaagttgacacgcggagaggaggataattatctctgcattgcccgttcatttttctgaatttgcactcaggatcttgtgaatgatggtaagaaaatgttggtaaaatttagatggttggttggttaatcaccagcaataaccacgagaaaattttggcagttcactacgacttcgatgtatcacttgcagattctttactgttcagtctggaactcaataaacaaaaagtgataagaactcacagactccagaaaattaaaataatacgagtctcaagttattgacccatgggaaattcgacatgaatcaagctgattcagcataactgtcactgtggatgctgattaagcgactttcggcgagggaagaggaggattagcctgaaaaattggcatgaacaggatcccccacactgaatcattgttcgttgcaatataatgattcactaattaatgcaatctgagtcatgagaaccaacaatttctgcattagtctaacatggtgaaaatagcagagtactgaagagatgctatgatggatcaagcaattgcaagcacacatggatctcgagaacacatcatcgattgcacaaatcaacaaaccatatcaacacgacaacaagtcatcagacaatctaactaagaacatggcagtctcacggcagaatccaaaccggcggcgtgtagtacgacgggccttgctccggcaagagcttgtccacgcggccggtaaccgcctccgccgccgccgccgccgccggcggcagccacttgccgttgtcgctgcaggggaactgggcaaagggattcaagatttggaacgcctcatcgtagagtctcccgtcatccaggaagtagacgccctcgttgaactcggcgcccggatacttgtccgcgtcgtacgatctggagcagcctcgcgcgacgaacaacatccgcccacccagcgattccagctccttccaagcgtatggtgccccgtcgttgttgatgggcgtctcatgcaccatctcgaacaccttgaacgcccatgtccccggcggcagttggggaggatgaggaacgagcctgacgaccatgaggagattctcgccggactccaccaggtaacgaacagcgatggctccgccgtaatctcgcccaccacgcgagaagcggcgaaccaccatgggcggtatctccagattgccgtcgtcgtcttcgtggaagcccgctacaggaaaaacatggaggttttcttccctggtgaggaaatggaagcttcccttgtggtgtatgacatcctccagaactgacgtggtgacgaactcaacagcagtcgccttctccacaacttgatgctccatgcgccagaacacatgaacgcgtggatcgtacatcacgcgtggatcgtacatgaacgcgtggatcgtacatccggtggcgaagagagggtcgcggccaccatgtccgtgcccgtgtcggggaagtggaatcgcgtgccgttgcggaggctgagtagcgcgtagtccaggatttggccgaaggcgacgaagacccagccaccgtcgtaggcgccgaagtagcgcgcggtgcgtgcgtcggccgggagcggggggcggaaggcgtgggtggcgcagccggcgagggcgcacgcgaaggaaggcccgtcggcgcgcgggacgaggatcgatgggagcggcctcgtccccggccgcggctgctcaggcttgacggcgacgcgccagttgcggcagactcgggccatgcggcgccggtcgacgaggcacgggagacgcttgaggatgaatccgagcacgtcggcgtcgaggtcgcgccatggcgagtccattggagaggcggaggcgcggcttgccggtggcgaggcgaggaggaggaatggaaccgatggattcctctgcttctggaagaaggaggagatgtgcttggtttggaagggggatgggggactgggcctcatttatagggccagctttcttgggccccaaatcttgaggcggataaatgggctaaaatttatgaaggctttactttttctttttcataagtgaccttccgggaatttaaaattcaaactgggagttcgtttgtgatgccagctctgccatgcatatttttgttttgaggtcggatgggtgccatgtctgtatattttcggcaaaagcacggcttggcgagcgtctaatctagtgtttttgttgtaccatcagactgatgcacaagttcagaaaaagtgaacaaggaattcagagataagcatcctgtgtatgtatcaacatttcctcatccccttctctctgtaaaggacgagctgtgaactgagcatccttcagttcagcactaatgaaaagattaaccatatcgcctacagaaaacatgtgtgcctatgttactaaagatgatgacctcattggaccaataactttttctatcttttttttctctttttttttcctgtaggataataaccatctgtccatctgaactgttaacctgcttgaatgccttttctcaaaaaaaaaaaaaagggttaaccttccctgctcccatttggttctcctgtctgctagacacgattttgcaccatatgtacatccgaactttacgttctcaaaaaaaaaaaacatttaaggccccaaaaaaacgcttagcaaaaagcagcgatccaaactttaggcccaaggaaacccgggcctattaattgggcccc

SEQ ID NO: 185 - DNA, 3831 bp, Oryza sativa
  unsure (1)..(3831): unsure at all n locations
gtgtgttcaccttcttggcggcgattaaacgttgccaaaaacacgtatattgcatgacctctgccggggcttttgcttccgcctttccaatggaagagggggggcagagggaattttaagggcgaaagccgtccgcttggccacaaccacttcaggtgcatcgtcgacagccgcccattggcctgcgtctgccacgactggcgcgcgcccgtcaagccgctacacaacgcaccgcatctccgcccgctccggtggatcctcgtcccgcgcgcagccggcccttccttctagtgcgccctccgcggttgcggcgggcacggcctcggcgtcccggacggcgcgcgcaccgcgcgctgattcggcgcctacgacggcggctggatcttcctcggcaagacctgccgcaacacgctcctcagcctccgcgaccatcagctgcgcttcaacctccccttttttgtccgcccggacaagacggctgctgaattggggcggccagacggccctgtccctaacagtggtgtgatcatgctcgccgcgacgctctcttcgccaccggaggacgaggattgcgtcgccgccgccatcatcacttactggcccttccaggctgctcgacgcactcacgcattctggcgcgttcagtcagaaaatgcttcccaggatcaggttgcggcgatggggcatggccctagtgccatcgacgagccagctctggaggatgtcatacaccacaagggagccttccttttcctcaccgcagaagaagacctccatgttttcacagcacgggatttccatgaagacggcgacggcaacatgaagatggcgcccagggtgattcttcgcttctggcgtggccggcgcgattatggcggagacgtcgttgctcgctacctggtggagtcccgcggcaatctcctcatggtggtcaggcgcgttcctgctcctcttgccgcgccgccgacgacatcggcgttcaaggtgttcgagatggtgcagccgccgccgaggaagcggaacaaggccctgcacggctggaaggagctggagtcgctgggtgagcggatgctgttcgtcgcgcgaggctgctccagatcgtacgacgcgggtgactatccgggcgacgagttcggcgagggcgtctacttcctggatgacgggaggctctaccgcgagtcgacagtgttcgcttctcgcgccgtcgcggggaaatacccctgcagagacaccggcaagtggctaccggcggcggatgcggcgggggttccgcgtgtggacaagttcttgccggagcaaggcccgtcggactactcaccgccggcgtggcttctcccctgagattgctcatgttagttttgatcgtcctggtacaggtatgattcgctattgatttgttcgagatgtccttctcctcttgtttgggtggatgatgtagtcttcctgatccggtatgataattctcgatcaatcagtataattctccttgctgagtcagacttgcatgaacgcaatgcatgtgatgtgatctctggactctggtctgatgatttgtatgaatgcagcaacgttttggctttcagtacttggattgagtctatgcatcattgtttatgcagttaataataatgcaatgagaaaatgtgcccaattatccgtgcttaattttcttgatagaagaattctttgcatgaaatggatttgcaatgtagctgaatttcttctccgaagccaaatttcagtttgttaactgttcacagatcagtttcaggctttcagctagatgtgaaagatgcaggtcgtttatgttttctttcatcatgcgatgttgtatgatcgtctgaatgtcatttgttcttctatagattgctactactgatggtgctgaatttactttctgtgccacgatttattcctagattgtgtgcatgatgtagaatgttgagtacaatttagtagcagagggcttcttggtcgccaaaatcatttagagataacaggcttttgttaatatgttcactagtactgattagaggacaatttgtacaaactaaggattgattagaggatattctgctctgcaaacagggcagaatgagtggtaaatttgttaaattcacggagaggatgtttctctgcatattcatttttctgaacttgtagcaccattttgtctaatagttggtcaattgttcatgagatggttcatggttggtcgcttgattactagtgttaactcggttagaatcggactgttaagcatctggaacagttagtttgataagcctacgagatcacaagacccatgagccatgatttggattgcattagtgcataatgtgcttaattagcagtaagaattaagtattctctgcatcaaatggatttaagaatgacagtgaattgtcaacaagcaactgaatgttgtctgcttcagttgcttgttgactgtccaagatggggctggggtaagctactgcatctcttctgacgatctaagcaggattctagttgctgctacatagtatcataactgatttctagtattcttcgcattttcataatctggcatgtcaagctctcggtttatttaaacttagatgagataacactgcgcatcattttcaggcttttcagctagctgtgaaagatgcacatgattttttatttctttcttcatacttgttattgtctgatcggttgaaaggtgacaaaaaagtttaaacgtacagtaaataattcgtcctgtgttgtttgttcttctgtaggactactattgatgccacttaatttattctgccctgattttcccctattatgtgcatggtgtagaatattgagtatatttcagtagcagatgaaccggctaaacggtcaagatatggttattagttactaatctgaagtgctcagcaattttcagtagcacagccttttgacaagcaccatgttaacctgttcactagtaatcagatggttttctgctctaaagaaagggggaaatgagagtaaatgttgagacacgaagaggatgtttatccgggaacgctgagatttggagggagagacgtccctccaaacattgtttatctgcaatctgcattcgccatccattttcctgaacttgtagcatcagcggatctgcctatttggtatgaaatgttttttaagggtacgaaattgttttctaacggtacgaaattgttattagatggaattacgagtgctatcgcgaatagaatttataggctattaaggtcacaattctagcaatcgcagaacagggtatttgggactagaaaagcgaagcctttactgtattttcgaccgacagttctctgcctaaacaattcttcaggcccgttcttctatgggtcctgtaggcccatttagatcagcccatgaaacattatcatgtcggcccgcttactctcctaaactaggcccatgcgtgacaagaaattgctgacgccaagttcaagtctgaaacttgtagatcttgaactaatttctaatgcttcaaaattgtagcagcattttggtggtagagtgatgggacttggggacgatatcgccaccaagctagattctgaaccacagtgcaggaagacgtaaaccattaattatcctgccgcagactgcaataattcagcaagcagaagtgattaatagttgatcatagattcataggagtgaaaatgaacacatgcatctcaaaaaaccgtaggaattccatatgaaattnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 186 - DNA, 691 bp, Oryza sativa
  unsure (1)..(691): unsure at all n locations
cggtggatgatggatctatnnnnnnnnnnnnnnnnnnnnnnnnnnnnnnnnnnnnnnnnnnnnnnnnnnnnnnnnncaagagcaagatgcaaaccgttcagtccaaaagctggtctccttctaaactctaacaagataaagatttttttttcttcggtactcgttagcacgcttctcaaactgttaaaaagtagtgtgcttcgtacgaaaattttctatatataagttgctataaaaaacaaataaatccatttttcaaacttttaataattacgattcaattaattatgtgctaatgacttgtctcgtttttcgtgcgcgattaatccttgtagggtgatgctaatgactaagccgagaagatgatgctgaccatgtccgtcgtcatggatggtggttgagcgaaactttcggcgaggggagaggaggaggagccagcctcatgatgatcagcctgcttgcagatatcatccttagctcatatgcagctgagctggtgcgagtgagtgcttggccggcgaggcggcgacgtcggtccgtagtattctggaaaggaacaaggcaccaaacgccctttttttttttttgcagaaggtgatcctgatcaacggcgagttcccgggcccgcggatcaactgctggtncaacaacacatcgggtgaacgtgttcaccagcttgacgagccgaagt

SEQ ID NO: 187 - DNA, 682 bp, Oryza sativa
  unsure (1)..(682): unsure at all n locations
cgttnatttgatgactatcgtatnnnnnnnnnnnnnnnnnnnnnnnnnnnnnnnnnnnnnnnnnnnnnnnnnnnnnnnnnaatctcacgtgtacattacattctaagtcaagatttaaccgcagtccacaaactggagcgcgtgttcctcgtatcctgaggggcatgacatcttannnnnnnnnnnnnnnnnnnnnnnnnnnnnnnnnnnnnnnnnnnnatccgattacacctggtacaatcataaataccctctggtatccatatataatccgatctaagagaattatactgtctccagacggcgacatagctatgaggcccataccgatcgaccttacctacatataatcagtctgtatggctaatatacacaccctatcacggcgatttaagcccctattacctatttacaacccccagacggatcacttaacacatcagctcaaaaataaacgatccgttagctgtatcctattccttcggttctcgcttatccatctatccgcggctagctttaaaccatcggctgcctatagcgngatcaaataatgttgtacggtaccacacccctaagagactttattacctgcactggaactaaagagatccccaggcttatagaggttctcaccctctgatgttacgtccacgggacttattacgagcccttgatccatttg

SEQ ID NO: 188 - DNA, 1174 bp, Oryza sativa
agaaaaagaaggaaaactaagtaattaagaataataagacgatacatacacggtggtagaagatgatgcatccgcaattcgtagaaaacaagaacagcagcgataaacaaatgattgtacaacacaacatagttcaaagagatcaataataatagagcaggaaagcagaatagaaaaagaagactagcagactgatgggcagtgagcctggatgcaaaacagacaagtatacggcagtggtccactgatcaatacgaccaataagcccacggagaacagggaagtgatcataaacatgaagcaagcagagtaagaaaagaagacccactaagaaaaacaactcgcactacggagaagggggcccgacgccgcaggctccccaggccccgaggaaacccgggcgccggctccacgccggcgccggcaagcgccgagcgcccggacgcgcccgtccgacgcgcgggacaggccgacgcgagagaccggccgcccgatgggaccaaactggcacctgtcacacactgtgacctgtcacggtgtgtgaccggtcacagaccggtcagatcgcgggttaggtggcaacaggcggcctgacacacgcctcgccccgtcccgtcggaatgatgagagcctccaggcactcgtccctagccggagccggcgtgctaactcctggagttggcacgtcagtcccggccagattcatgccaggcttcatcgcaaccattacaaggaagtcattgtatgaagaagggcagatgtgcggcatgctaaactgacgcgtggtggacaagaatgaccggtctgtgactggtctgacgccggtcacgtcatcggcagacaaccgtgctcccacgctgcatctacttccggcgaagtggaggcgagtgacggcgctgggcctcactcaaggacaagctgtgatttagcttccaagcgaaggcgcgagccaagtttttggtcaagatagggtgggtccccacccaaaagaagagtaggtagaagtggtgcatgtggtatccccgtgagatataaaacgaggaccttgccccaccgaaaaggatgatggggaacgaaaaagggaggggggactctgagacgaccttgagaatacctgagctcgtataggaaaaaaagaggaaagagggttctagaacctgaactcttttgctct

SEQ ID NO: 189 - DNA, 1671 bp, Oryza sativa
  unsure (1)..(1671): unsure at all n locations
cgaggnatttgtannacctgatattgatcatcggcctcgccccnacnnnnnnnnnnnnnnnnnnnnnnnnnnnnnnntttttttaaatacaaactaatcccacacatgaacttttaaacagcttttctttacaaactaaccatgacactttgctttaaaatatttaaacagtttgccacgccagcaaaccgggcgtggcaagtaccgggcgtggcaaaactgccacattggcgcccggttgacgatttcaacagcaacgatcgccatggggcagctcttgccatgccatgaccattggtgccgccactctgtttggccacgccactgctattggcatagtcaaaaggtttagttttgaaaatatttttccgggtggtctcttaataaaattatatttttaaaaggtctaacttataaaaaaaatttcgtcatgatgtgaccggaactctaatgatctcgcgtgatatggtgattagcagcagaaggagctgggctcttacagcgatgtcaccctcccgttgctgcacatgacgccgtcccacccgccgccgcaggggtcgccggagttccagctcgacgggtagttcctccattgctgcatcagaccccgcagcgcgtcaactgccccaagaatatttctccaaggattagccgagagccaagcagtttttgcttttcgccggtagtgagtgctgagagatcaactcaccgtccactccattggtctcgcagaaccccgtcggcgttgtcgccgccagcagcaacggcggtgccggcccgcgccggcccgttcttgccattgcgcgctagagcgcgtgaggttggggaagacgaagaactcagggaagaagcggactagagagagagagagagcccacggcttgcgagagcccacgcgacgctgtatatactgggccggcccaccaaccagccgcgggggacgcgcgtgttgggaattttttttatttttaattttttttattaaaagttttacaaaaatagttttccattttgaaaattgacggaagtagtcgcctaccgccctctgggagggcgatttttaaaaatcaccatcccagagggcggcgaaaatgacgtggcagacggccgttcgctttcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagnnnnnnnnnnnnnnnnnnnnnnnnnnnnnnnnnnnnnnnnnnnnnnnnnnnnnnggtataggtatcaaaaggntacaaannncacccac

SEQ ID NO: 190 - DNA, 1178 bp, Oryza sativa
  unsure (1)..(1178): unsure at all n locations
actggcatggtaaacggtagaccaatccannnagacncgagaattcggacccccataaggatgagatgaaggaggcggtgaagcattgggcagtttccttgcatagagagtttatggtggtcaaatcagggaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacactataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaaaccgaggtcagatattgacagcaattgggtgtgatggatacaaccaggttctacctatggcttttgcatttgtagagagtgagaacactgaaagctggtactggttattagaaagagtgcacattgcagtggtgcgtatgaggcccaacgtttgccttatatatgatcgtcatgtgggtatgttgcgggttattgactacttgcagaacggttgggatgagaagggacttccagctaagtggcatgatgttcggagtcggtagtgcatgcgtcacatgggtgcaaatttctacaagcaattcaagaacaagcatcttatggagctctttaagaggctatgtgcacagagccaagagaagaaatttaatgagccgtgggacaagttggatgagttgacaatgaagcaaacagatgagcaatctcgcagaccacaagttgaaggtnnnnnnnnnnnnnnnnnnnnnnnnnnnnnnnnnnnnnnnnnnnnnnnnnnnnnnnnnnnnnnnnnnnnnnnnnnnn

SEQ ID NO: 191 - DNA, 952 bp, Oryza sativa
  unsure (1)..(952): unsure at all n locations
gacagaagattgcctggtagcagtggctaatgcctatcacccaccacccgccccttttcgcccttcttctcttntttttaaacgntttatttttctccctcccccccccagcgtggtgttgatctgcgcctggcganacacnnnnnnnnnnnnnnnnnnnnnnnnnnnnnnnnnaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccagtttcgcacggtacagttcagcccagagattagttcatttttgtttcagcttttgcacgaatatgtcaccatgttttaacggcacgtttccttatcgcaggacctcgtctgccttcgagcgcgttcgcaggcacgaccggcgctttcgcgagcttcgcaggggcgttcgccacctcttcgggcgcgttcggcagctctttctt

SEQ ID NO: 192 - DNA, 771 bp, Oryza sativa
  unsure (1)..(771): unsure at all n locations
agtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggagccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctatcaaaaacatgccctaccaatattttggtaatttgaatagtacttgtgtttgatttcgattgaagcctattcattggtaatacgtaatctagatttgagattatgtagaacattcttnnnnnnnnnnnnnnnnnnnnnnnnnnnnnnnnnnnnnnnnnnnnnnnnnnnnnnnnnnnnnngatatacaaagnttnacaaannncatcaca

SEQ ID NO: 193 - DNA, 730 bp, Oryza sativa
  unsure (1)..(730): unsure at all n locations
aggccttgttgctgcantcctgaaaccacctnnttagattgagaattccgtacccncgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgttcttcctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaagtgatcaacgagcttttccacacacggaggagaactaccgggactaccttcgctggtaccttctcgcactcgtgcgcgtgtggcctttacttccaaaccccccaaagcccgaacgttgcccctgtggaaggaccccgn

SEQ ID NO: 194 - DNA, 1404 bp, Oryza sativa
  unsure (1)..(1404): unsure at all n locations
cattaccttaaaataactatagtgtgtgcaaactccgtagtatccaatacgtaacttaaaatattgaatagggaggatatctagtcctctgtcttttccgaattttttcataactatttatgtactttacaattggaaagagattagagcgccctagttatcatttgagtagtattactaggtcaacctggaagctagtggcagtgtgagagcaatctacacggcaggaatctgcgaaacatcaatctgatgattctttggctgtattcagattggccagtgtaagcttggccggtacaatgagccagcagagctgcatggttttggtaagagtctttggtaattggttaattagctcatagtttcactgaatatttaagcagctaatgatcatcctgatcacatgtgtacatcaatccggtattttccagaaaattcagaggtaaatttattggagcaaagcaattctgcatctctctactagtatccaacaaagctcctgcaataacagttaagctcgacattgacacttcagattacaagattgattgatgaacaagtcattctgatgtgtaatcttgctaaggagagaaaaaaactgggtaggaatatattgcagtgaaaacgacgctatataattgacaatctgaaggcaacctcttcatatcttctttcccactagcacacaacacacgaaaatggaagcgccattctttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatgaatgtacatnnnnnnnnnnnnnnnnnnnnnnnnnnnnnnnnnnnnnnnnnnnnnnnnncgaatgatatntagttttcaaantcaacccag

SEQ ID NO: 195 - DNA, 1364 bp, Oryza sativa
  unsure (1)..(1364): unsure at all n locations
ntagcacgacgccgagcgggccgctcggcatgacgaggccgtacacgaacgcgccgaacacgaagtggatgccgatggcgtcggtgcagacgccggcgaccatgacgccggtgaggatgagcgtgatgtgcacgtcgccgatggcctccccctcggggacgcggcggacgatccaccacatgagcgggcggacgacgtagaagcaggcgagcacgaaggccaccccggcgatgagcacccagagggaggagaaggccgaactgttgacctctgagatggcgatggcgagcgcgaggaggatccaggcgcacatgtcgttgacgatggcggcggacatggcgatccggccgaggtcggagttgagcagcttgacctcggcgaggatgcgcgccagcaccgggaacgcggtgacggagagcgcgacgccgaggaagagcaggaaggaggcctggtgcacgttcttggacacctggtgccggaagatgaacgacgtcgccgtgccgatgcagaacggcagcgccatgccggcgacggcgatgatgagcgccttcttccccgacctcctgatggtgttcacgtccatctcgaggccgaccaggaagaggaagtagaggagccccaggtgcgccaccgtctccagcgtcagcaagctccgctccgggaacactttcaccgcccacgtcgaaacctgccccatcaccgacggccccagtatcacgccagcctgcatcaccaccacgacgacgacggcggcgacacagttaaccaatcgaccaatgagaatagaacaatggcggcggcgaaggtggcgggcgacgtacgaggatctccgcgatgacgcgaggctggcggaagggcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcgaggcggggggcgggaggcttaaagtggaaaagacgtaagtccggacttaattggagtggaggcctaccctggggcttatatatgcggtttgcgcctcacctggggctgggcgccacacaagctgtttgcgcccccggtttccggggggcacaacgcaccctggcgctaattttttgggcctttcgacaggggggtggggtctttgtcggccttttgggcaaattcctgggactacgcgcttactcatgactctcgcaagcggacggcgatttcacttttcc

SEQ ID NO: 196 - DNA, 1722 bp, Oryza sativa
atcaactatcaaatttgaaatccgccccgaaaaaaaattgtctgattcaacctaaaaaaaagagtgtgtaagagattcatattgctttttgctttttcctcatcgtctcgtccgcgatttcgccggagttttcgccggcgctttgggaagccgccacggggttatatttacaaccgtattaccgcctttgaagtgagatgttgcctgctcgccggggccccgaaaacaggtcacgtcgccgtcacgccgaaaattcacctagtaatttccgaacttatttgtgcataaaatcctcgtccaggaatcagccgaggtacacaaactgacaatttaatatacagattcatcaaattaactaaaccgataaatacttacttaagaggcacttagtcctcaccatgaagaaaactgcagcggaaaataaaatctagcgaagctccagctccactcccacaggcagctcagctggggtataagccaaacgtcttctcctcctagatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatactttccgcgcacttacgaacctttgcaacgacggaaacgacaac

SEQ ID NO: 197 - DNA, 1220 bp, Oryza sativa
  unsure (1)..(1220): unsure at all n locations
atgctgcattgtattcgatagacnatctcnnnnnagannngnggaatnnggtaccccatcaacatacatgtatctgtgtggtactatactgatagtaccactgaatttgtttttcccgtgccacgatctattcctacagaagaacaaataacacaaggtagattatttactaccccgatgcaactgatcataaagcaactaactagtcctatgaagaaagcaaagataaacgatctacttcttatacggaaactgaaaatccgtttgatccgaagcactgctgcaaatatgcaatctaagccattaacaccaaccattttctggacagcaactgaaatcatgaagtgaagtattgaagagatgttatggcagatcaaacaattgcaagtacactgcacacatggacgaaacatcacagactgaagtaaccggacaatcaacaactgtcatatctgaagttcagaactggctcaaagaaaaaagttgctatgaaacaactagtatgaagaaagagaagagaaacaatctgcatgtttcccagcagcaatttgagaagcccattaaaaattcagctaacttatggaaaagtgaatagataataaagttatgaaatgtgtgggagccattgaaaattcagctaactccatcttggactgctagcaagcaactgaaagcagggtgcagaagcaaattcagcttcactgtaaaatccatttgatgcaaaacatgcttctatcaggaaaaataagcactgaaaattacacattccattactattgactgcaatatcattgctgcatagatgtaattcatcagaccacactgcatttctgctacaaaaggagaatttactaggtagctccagcatagtagcaactgtaccaaccgacaattatcacaccaatcttgacggaaacatcaaactgttgactgaaactacactatagcacatttcagacaggtgaaactaacatgagcactctcaggggagaagccaagccagcggtgagtagttcaacgggccttgctccggcaagaacttgtccatgctgctacccgccgncgccgccgtccacttgccgttgtctctgcaggggtattctggggaatcgggagccaagaacgataacccctcacggtagagtctcccatcatccaagaagtagacgccctcgttgaactcagcgtccgggtagttgttcttgctgtacgatctggag

SEQ ID NO: 198 - DNA, 2808 bp, Oryza sativa
  unsure (1)..(2808): unsure at all n locations
aaaacggcactataaattggcnccaacactttctcggctggcanaagcttggccttctctgcttcttccaaacctcccattcactctgttcccctctcttcccctgctccagaaagccaagttcaaacatggcgcacaacgacgaagcgtcctcgtcgcgttccaccacctcctccgccgcccaaccctcgccaccatcacgcctcgcccccgcctccgccttcgcctctcccatggacgcggcggcgcccgcgcgtgacttcatggcggaagccctccgcctcgtccacaaccgcctcacgtgcctcgtcgaccgccgcaccatggcccgcgtctgccacgactggcgcgtcgccgtcaagccgctgcagcacgcgccgcatcgccgcccgctcccgtggatcctcgtcccgcgcgccgacggcccttccttctcgtgcgccctccgcggctgcggcggacacggcctcggcgtcccgcacgacgcccgcgccgcgcgctgcttcggcgcctacgacggtggctggctcttcctcgccttccgcgagaccttccgccacaagctcctcagcctccgcgacgttcagctgcgcctccgcctccccttctttgtccgcccggacatgacggctgctgaattggggcggcctgtcccttacattggtatggtcatgctcgccgcgaccctctcttcgccaccggaggacgaggattgcgtcggcgccgccatcatcacctacgggccctacgaggctggtcgacgcactcacgcattctggcgcgtgcagtcagcgaaggctttcccggatcaggctgcggcgatgggtcatggctccgatgccatcgacgagccagctctggaggatgtcatacaccacaagggggccttccttttcctcatcacagaagaagacctccatgttttcgcagtacgggatttccatgaagacggcaaaggcaacatgaagatggcgcccagggcgattcgtcgcttctcgcgaggtgggcgcgattatggcggagacatcgttgtccgctacctggtggagtcccgcggcaatctcctcatggtggtcaggcgcgttcctgatcgtctacacgcgccgccgaggacgtccgcgttcaaggtgttcgagatggtggagccgccgtcggggacgcgcatcgaggccctgtacgcgtggaacgagctggaatcgctgggtgggcggatgctgttcgtcgcgcgaggctgctccagatcgtacgacgcgggcgactatccgggcgatgagttcggcgagggcgtctacttcctggatgacgggaggctctaccgcgagtcggcagtgttcacggctcggcggcggcgacggcgatatccctgcagagacaccggcaagtggctaccggcggcggatgcggcgggggttcctcgtgtggacaagttcttgccggagcaaggcccgtcggactactcaccgccggggtggcttctcccctgagattgctcatgttacttttgatcgtcctggtacaggtatgattcgctgttgatttgatcctccgagatgtggtttagtttgcagccgttgtactttgtcccgtcccgtctcctcttgctgcgatggattagtgtagtttcagtcaacagttgcagtttcagtctagatttgatgtcataatcatggattggtagttgctatgatgctggagaaattctccttttgtagcagaaaatgttttcaagtcagaactacatgaatcgtgaacgcagtatgaaactatgaatttgtgtgatctgatgctgcagtgaatcaagaacgcaatatgcttccaatggttgccgttcgtcatgacttggattgcattagtacatcgttatgctgcagtcaataacaatgcaatgtgtcacttgcagtggctagttttcctgatagaagtatgttttgcatcaaacggttttgcagtgaatctgaattgcttctgcgtcctgttttgagtttcttgctgacagtccaagatgaactgaggtaggctagtgccactcttcagaggatcgagaaatgcccaggggtcttccggctagctccacaaggtggtgggctagacgacctggattcaaagcctcacccctcctaattatttgatattaggtccttccctaatattctagttttttttttctcttcagaggatctgttcctatgttatgtgcataatgtaaaatgtggagtatatttcttcagtcaagaggtatttcttcagatcctaagttatcagcatttcttcagtaacacagatgataggcagcgtgttaatatgatcactagtactgatcagatgatgttatactatcagcatttcttcggtaacacagcctgatggctgatggtaggttggtaggcatcatatctgttaatctgtacgggtagttttaccatcatatctgtgttactaaagatgatgatcacattggaccaataaatctctccttttctttttcctctcttttttatttttggccgggaggaccaataaccatctgtccaactctacatgctcccatgtgtccatatgaatcaacctagtgaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 199 - DNA, 834 bp, Oryza sativa
  unsure (1)..(834): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagagtacatgttctggaatattacagaaacttatggaatatgtctatttccattgtattcaagtaaacctctctgtattatcagtcatttccatttctattcttttgtgccacccctttttgatgaagatgaatttctcttctttttgccttctaattcatccccagaattatgcttctcctgtgatatatcttgtggcaaatcttttcttttgtttgaaacatctttctttttctgctctacaccatcctgcaacaaataatatctttctttattactttttttaaaaaaatcaattcatatggatttgaaatttttgttacctgttatctggtatttttaacctttgttctcttgttccttggcaagtcaaactcaacgtgtttcagagggcacgttggaaatgtgtgatctgtcctctgaaaatgactgcaatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 200 - DNA, 1940 bp, Oryza sativa
  unsure (1)..(1940): unsure at all n locations
ctcgttttgggtgaccggtgccggacccatcattccggggcacggttgggcttatcggtccggggccgccacgtggcgctttcgtcccgctcccgcatttccagcgtgtgggagagatatatttctgtaaatccttctcgcccacgtatataaacgcaaaatgcgaaaaaacaagatattttttcaaatttttttcccgaaaggacgaggttagcttacgaagttagtagtcaacccaaacgctaaccaaccaacacgcggaattttttttttattttttttattaaaagttttacaaaaataatttttcattttgaaaattgacagaagtggtcgcctaccgccctctaggagggcgatttttaaaaatcgccatcccagagggcggcgaaagtgatgtggcagacggccgttcgctctcgggcgacggccgtcaacgaaatttgcaggcggcccccttgccgccctccgctagggcgattttgtactgtgcggtacctatatggtaaaacgccaagcaatgcttttgccgagaatgacacattgacacccatctccctgcttgagttttgaaattttgattctgaataatttgtgttcacccggttgatgcagaatagcaatggtcaccctatttcagtatttctgtttcgttttactccgaaaaaatgcgtgttgaatttgagagattatgatacgagtacattggaatatgggttttgaaatatcgagcaggctggccctattggcccagtgaaaaagtaaaaccgtggggcccacgaaaactggcccaataaataatgcccagtctgatagcttcgttccccagcccaaccccctgcctcttccaaaccaaagccacccatctcccacctcccgcttcgagaaacagagcaatcaatcccacgcagccacatcgtcgcaatcgatcgcctcgcctcacctcgcttcgctttctctccaatggagtcgctccaccacgacgtgatccgcctcatccacagccgcctgccgtgcctcgtcgaccgccgccgcatgggccgggtctgccacagttggcacctcgccgtcgcggagaggcagcgcagcaagctcccgtcgatcctcgtgccgcgcgcggacggcccgtccttcgcgtgcgccctcgccggctgctgcgccacccacggcttcgcccacccgctcaaggacgacgcgcgcgccgcgcgctacttcggcgcctacgacggcggctgggcgttcgtcgccttcggccacaccgtgggctacgcgctcctcagcctccgcgacggcgaccggctccacatccccgacatcggcatggccgtggtggccgccaccctctcctcaccgccggacgacgaacgctgcctcgccgccgccatcaacctctccttcctgattgacgatctacgcactcacgcgttctggcccatgcggcgtcaatctgcggctgcgccggagaaggcggcgaaacctgcaaaggtcatcagcggccacgctctggaggatgtcgtacaccacgacgacgccttccatttcctcacgagagaagaaaacctccatgtttttccggtagcgggcttccgcgaagacgacgagggcaatctggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 201 - DNA, 3394 bp, Oryza sativa
  unsure (1)..(3394): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacgcgttctggcccatgcggcgtcaatctgcggctgcgccggagaaggcggcgaaacctgcaaaggtcatcagcggccacgctctggaggatgtcgtacaccacgacgacgccttccatttcctcacgagagaagaaaacctccatgtttttccggtagcgggcttccgcgaagacgacgagggcaatctggagataccgcccgtggaggttcatcgcttctcgcgtggcgggcgagattacggccaaaacaacgctgttcgctacctggtggagtccggcgagaatctcctcatggtcgtcaggctcgttccccatcctccccaattgccgccgaggacgtcggcgttcaaggtgttcgagatggtggagccgccgctggggactcccatcaacaacgacgaggcaccatacgcctggaacgagctggaatcgctgggtgggcggatgctgttcgtcgcgcgaggctgctccagatcgtacgacgcgaacaacaatccgggctccgagttcagcgagggcgtctacttcctggatgacgggagactctacgacgaggagttgatgctcggtgagcccgatttccgggagtatccctgcagagacaccggcaagtggttgccagcggcggaggcgaatccccgagtggtcgagttcttgccggagcaagccccgtcgagctactcgccgccggcgtggcttctcccctgagattgccgtcgagctacaggtttttgcttgctgtcgattcgatcccccgagatgtggtttagcttgcagccgttgtactctgtcccgtctcctcttgctgcgatcgattagtgtagtttcagtccagatttgatgtcataatcgtggattggtacagctgctacaatgctggagcagtggagattgtacttggtaaattctcctcttctatcagaaagagtatgcaagccagaattacatgaataatgaatgcagtatattcaactcagcatgaatatgtgatctgatgaattctacatgaattacaatggttgccattcttggcttggatttcattagtcggtaagattgcaatgtgtaattttcagtgcttatttttcaggatagaagcatgttttgcatcaaatgtattttacagtgaagctgaatttgcttctgcagcctgctttcagttgcttgctgacagtgcaagatggacttggctgaattttcaatggctgctacacatgttcctaactgaattaactattcacttgttcataagttagctgaatttcagttgcttgctgacagtccaggatgggctgaggtagtgccactcttcagtggattttagcagaattttcgatggctgctacatattttcctaactcataatgtagcatgttaagtttaccaaattactgatacacatcggtttcagctagctgtgaaagatgccgatagtttacctgtttgttcttgatactagttgctcggttctgttgttgtataatcgtctgaatcttagtggagtactattgattctactgaatttatttactgcaccacaatgtattcctttattctgtgcataaggtagaacgttgtgtatgttttagtagcagaagaatggttaaacagttaacagatggttattaatccaaagttatcagcatttaggcattacttcagtaacacagcctgatgttaggcgtcatggtaatctgttcactagtactgaactactgatcagatgatgatgttcttctgccctccctgctctacagaagactggattaaatgagagaaaaagttgacacgcggagaggaggatgattatctctgcattgcccgttcatttttctgaatttgcatgcaggatcttgtgattgatggtaagaaattgttggtacaatttagatggttggttggttaatcaccagcattaaccacgagaaaattttggcagttcactacgactttgatgcatcacttgcagattctttactgttcagtctggaactcaataaacaaaaagtcataagaactcacagactccggaaaattaaaataacacgggtctcaagttattggtccatgggaaattcgacatgaatcaagctgattgagcataactgtcacggtagatgccatgctgattaagcgactttcgaagagggaagaggaggattagcctgaaaaattgaaaaattagcatgaacaggataatgatgcaatcccccagactgaatcattgttcgttgcaatataatgatgcaattaatgcaatctgagtcatgagaaccaacaatttctgcattagtctaacatggtgaaaatagcagagtactgaagagatgttatgatggatcaagcaattgcaggtacacatggatctcgagaacacatcatcgattaactggacaaatcaacaaccaccatatcagcacgacaacaagtcatcagacgatctaactaagaacatggcagtctcacggcagaatccaaaccggcgacgtgtagtacgacgggccttgctccggcaagagcttgtccacgcggccggtaaccgcctccgccgccgccgccggcggcggcggcagccacttgccgttgtcgctgcaggggtactggggaaggggattcacgaattgggacgcctcatcgtagagtctcccgtcatccaggaagtagacgccctccttgaactcatcgcccggatacttgttcgcatcgtacgatctggagcagcctcgcgagacgaacagcatccgcccacccagcgattccagctccttccaagcgtatggtgcctcgtcgttgttgatgggagtccccagcggcgtctccaccatctcgaacaccttgaacgcccatgtcgtcggcggaaagaggggaggatgaggaacgagcctgacgaccatgaggagactctcgccggactccaccaggtaacgaacagcgaagcctccgccgtaatctcgcccaccacgcgagaagcggcgaacctccttggccggtatctccagattgccgtcgtcgtcttcgtggaagcccggtaccgaaaaaacatggaggttttcttctttcgtgaggaaatggaaatggaaggctttcttgtggtgtatnnnnnnnnnnnnnnnnnnnnnnnnnnnnnnnnnngtcgtcaggangagcntcacctngcagtggtggcg

SEQ ID NO: 202 - DNA, 2446 bp, Oryza sativa
  unsure (1)..(2446): unsure at all n locations
gatttgtatctgtcaggggcgagctatgaaaacgcacaaccgcttttcggtcctgccttgctgctttgtccatgtcttctcgtatccctatctgtgatacgtatacgctttatagctatcgctccgcacgaacgccagccacagtcatacgagaacgaaaggccaaccaaccctctgccgggcggccggttttgcgcccgaaaatctccatttaaattgccaggttggggccacgacacaaggtttttccccggacttggaaaaagccgggcaggtgaagcgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgccgccctcccgccgggcggcaggcctcgctgcctataaaaggcctgctgcccagcccccagccctcattcttctctcctcaattccagtgaaaaaaaaaaagagaggggagaaaaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgagagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggaggattctgacaacgagcgtgtagaggaagttgattcgtcagatgatgagacggatattaatccagcagaatgggctagtgaggatttttctaggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctagtgttcagaaataccacatgaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgataatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcctttggcatttgcttttgttgagagtgagccctcacaatctttcagaactcagtcacattcagtactctcttccccacttgcttcattacannnnnnnnnnnnnnnnnnnnnnnnnnnnnnnttgggagtcagcagtcatcaaatnnnnncacca

SEQ ID NO: 203 - DNA, 1362 bp, Oryza sativa
  unsure (1)..(1362): unsure at all n locations
tggtgtcnnnaggtaagactcgtnggtcgnaaccannnnnnnnnnnnnnnnnnnnnnnnnnnggagtccggaagtccatgttcgacgaacagcaccaccttgtgcgatagcgagagttcactgtatgcgggaaatttgatgagaggagaggggcttcagtgagcaccgcccaaactactgaggatctttcaggatgctgctgagatatgaagtaaaattgatttttttttgcaaactggtcgtctaccgtggtatgttgagtagtagttccatttgttcattgatcaatgtacagtgaggattggacagatgctgattcgtacaccagcatcacaaaatgggtgagggtgttgtagtttaggagagccttttggggcttgtagattcagtagattaggatcatggggcattaacccaaaaaaaatactgcatatattctgtgcccgttctgttgaaaccatgcttggaattcgttgactttgatagtactcatacccttgcaatggtgcaatattcatcatctttctctaaatgaccatcaagatccatagctcatcttatttcctgaagtctttgatgcaactatccaactcaggccgttcttcatttcttggggctgcaattagaggttaaaaaaagactaatggtttttattaaatactaatggatagtttgattcgggatgatgattggcagtagagtatgggggaatttgaattggaagtgattgatatgataagtagtactacaaagtgataaatagtactctcttcttccctaaatataagagattttgattggatgtgacacatcttagtataagaaagttgtccacattcattgtactaggatatgtcacataaccaaaatatcttgtatttagagacggacaaaatatcttgtatttagagacggagggagtgtagtgtaaacattcttctttagatgcactatattatactcagtgcagtaaaaaaattgtatacttgatgtagaattgtggatacaagcatatataaggataaatatacccgagctggcaactgacgagttggcccaggagccacagtagtagtagtacaatacattgcatatgtgactattcctacgtgggcccacttgcaagagaccagtctggctttggcacgcacgggtgattagcttagtgcttaatcaccatgtactttgtgctaatcaaaagggattaaaactagcttcgattaagcacgcgcgtgaggcggggagcaccacgtccacgcggacaccgcgtagagcggggtgcccttccatccagccggaccgtgccgcgttgtttccgccaccgtgtagccaagccgcccggacacgctcgggccaccaatg

SEQ ID NO: 204 - DNA, 3744 bp, Oryza sativa
  unsure (1)..(3744): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnaggccatctgcgacagctcgagcagcgccccgttggcgcccgcgaggttgcccaccgacatggccgccgcgcactccatcagcagcgcgatcatccgcacgccgtgagcctcctcctcatcctccaccgccacctgttcgacgtcggcccccgccatcggcacgcccgtcctctcctccgccgcgccgccttcctcggagtacacctccttgcacgctcctaactccggccgttgctcgaacgtcccggccgccgccgccgccgccggcgggtcgacgaactccggcgagtcgtcctcgccggcgcaaccctcattggcttcaagaaatcggtggtgatgggacaacaaaggctgctgcagtggcaggttgctgctactgctgctgtatagatactggtgatgatcaagaaactgcatcaagcctagagaatcttgcatgtctgaacctcttcccgtcataagttgatttatcaaggatcaatcaatcaagtagggtttctgcatagctgaagatgagtggagcaagagaaagcaatgtgcttatatatactccctccgtctcacaaaaaacaaacctaactggatgtgacatctccagattcattgtactagctagaatacatcacattcagtactaggtttgtattttgtgggacgaaaggagtactttttgtggcaaccagcagaggctgcttgcttgtttattatcaaccgcaatcaaattttaaattttaaaacttaattttagaatattagctgtagctcaaataaaatgtttccattaccttaaaataactatagtgtgtgcaaactccgtagtatccaatacgtaacttaaaatattgaatagggaggatatctagtcctctgtcttttccgaattttttcataactatttatgtactttacaattggaaagagattagagcgccctagttatcatttgagtagtattactaggtcaacctggaagctagtggcagtgtgagagcaatctacacggcaggaatctgcgaaacatcaatctgatgattctttggctgtattcagattggccagtgtaagcttggccggtacaatgagccagcagagctgcatggttttggtaagagtctttggtaattggttaattagctcatagtttcactgaatatttaagcagctaatgatcatcctgatcacatgtgtacatcaatccggtattttccagaaaattcagaggtaaatttattggagcaaagcaattctgcatctctctactagtatccaacaaagctcctgcaataacagttaagctcgacattgacacttcagattacaagattgattgatgaacaagtcattctgatgtgtaatcttgctaaggagagaaaaaaactgggtaggatgttaactcctaagaggtttcagagtactgacatttgacgattgcgatgcgtaattttctttgcttttctcaaggaaaaccgaaaccgagctactagaacccctaagaattaatcgaagtcatcacatttcatgattgtgatgtgtaattgagaaatgagtaagaaaatagctttgaagcagtagcttcttcctaatggcgagctgatagatcacttggtgatcatcgctagttgaggacgagtcgacgaggagctaggctgcgcttgcaggcagcgaatcaatggctggcgatatcatcaaccaatttggccagttagcttgcttaattcttcagctactaattgagtaattggccggactaattggcatcaagcagcagaattccagcatcaatctgccggtgcctccacatgtcaaactcatcgtttcctatgtgctattacacactgaactcatagtagtttgctacatgtttaattgtggtctgttaatttgacctggtattgttacaaggccatgcgaacatatttatatatgtatatatcctgctaattaattcaggctgacaaggccatgcgtagatgtaccgtgctaattaattcaggatatatgcatcatcgatcgatgacaatgtaattaaactacgtatatatactgaagctgatgatgcctaccgcttgcctttgtctgcacttacatggacgcatccaggagatattgcagagacaaacctggcaaacagacgacgatcaggaccaaaatccaagtgattagtgactgattttgcatttcttttagataatactccctccattttaggttataagatgttttgagtcaaagtcaaattgattcaagtttgactaagtttatagaaataaaatagtaatattttcgacccaagataaatttattataaaaatatatttaattattaatttaataaaactaatttggtaatgtaaatttactatatttgtctataaacttagttaaatttaaagcagtttaactttgactaaaggcaaaatatattataacctgaaacagagagattataaatgtattacatcttggcctattccataatacacggtcaatgagtctttaaaagaacaaagaaaaagagtgtgggacatatctactcttaagtaacagattttgtacgcacgagtggttttcaaataatcaattgattgattacagtttagttaatcatcaaacaagcaagctagtaagcatttggcttccagacagcgttgcatctccttttacccaagtcctaatctgtcttgacgcattgacttcggttggcgctggacatggccttgaccatccccttgcagatcttccggaaccagaggaggttcatcgccgacatcgccggcggcaccgccatcatactgtagaaccctagcgggaacaccgtcctcacctgcaaattaatcgaacagccaggaactaatttaacaacagactgtcacaaagctgaaccctgaagagaagacgattggttgattatgattacctggtcgaagtgaaggtacacatgagcgaagaagtatacgaacagtatgacgcgagcaacctgcatccaagaacaagaagatcagtatcacttggagtataagtgaattgttagttttttttcatcattttaatatttgggttgaattggtagttatatgcaactcaataaggtatcgttagtttaaaaaaaaaaactcaataaggtatcggagctacaagtctcaagttcaaatcttgtcggacgcacacttaaataaataattgcagcttccattccatgtctgagcactcaaaaaaattcaggcatgttttgtttttgttgttatttactatcggcttagtcttttatatgaaaattcaattctgttttttttgttgtttacttattggcagtcctttagatgaaaattcaggcgtgttttttgatgaacaaaagatgaattggttggtgcatggaaacatttacaaagagaaattataccagccatccagcaaacagtgccaccccgttgtacaggtaaagcttggagtccttccggcctgcaagatcaaggtacctgcattttcagaaagaatgcatgaataattgtgatctcagacatgaacaagcaagatgattaatgagcaatttgggaaaactgaatgagtnnnnnnnnnnnnnnnnnnnnnnnnnnnnnnnnnnnnnnnnnnnnnnnnnnnnnnnnaatagtgatataataagtttntacaaannnnnanccag

SEQ ID NO: 205 - DNA, 1279 bp, Oryza sativa
  unsure (1)..(1279): unsure at all n locations
agaccaattcaatgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatgattcgttgcagatccttaaaataaataaagaacttattaccgttaacttagattccagctcaagccaccctgggaatcacgcggaagacgcaggcggaggaaacaccagcaacagcagcagcagcggaaccaacggtctaacacccaacaccacaggcgacagctgggaaccaggacgaaaccctaatcttcacttcacttcatctttacttcaaggcggaggaactatatatatttatatagagcaaggtgagtactttcatactcagcaagtcacggggacttaggtgtttaatgcaagcttagaagagaggcaaggttgttttgtaaatcctttgtttgaaatcatttttgaaatcactaagtgatttatttctttttaagtttgggtcgaaaaggagacttgcgtctcgattcgacttaagagatgcttttcaacaactcaaatggcaatgtatcgaccccccgagtcagatcattacttatcggcttccagagccatttcacttgattaggcggctcccagagcctttttcattttctcggactcccagagtccagctgcccagcagcaaagcaatccgcttccactcgggaagcctagtctatgatgcccgcagacatcccgaatcacacagattcgtttctgaccactcaggtcatccatctgccacataggctgattctggttacgattcccaatccacaacaacttttcacaaagtacaggcaaacaaatctacgcaacgggaaccacctcacacccgcccattaccgtttgtacggctgttccaacagttagtttacctttgcagaagggtacactttacccacaagatacgaacttactccagacacttgcccggtgtcagaggctctcgacaaaacctttcccaagccgcaccatgttacc

SEQ ID NO: 206 - DNA, 1204 bp, Oryza sativa
  unsure (1)..(1204): unsure at all n locations
cccagcgaaacggccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacaagaatgatcggtctgtgactggtctgacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacagggagatccccggtgtcaggcgagtgacggcgctgagcctcactcaaggacaagttgtgatttagcttccaggcgaaaggtgccaaggccaaagtcgaagtcaagtagaaataagggngtaaggggtcaaaggggcccccaatacgcaacccncnncacnnnanngttgnccgattcatatataaaggaggaccttgccaccaaaaaggcgaacaacaagacaaagtcttctgtatggctctccaggcctttgcatagcttatagtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatctgctgacttgaccaccctaaactctaacaagcaaggaaactgcccaatgcttcaccgcctccttcatctcatccttatgnnnnnnnnnnnnnnnnnnnnnnnnnnnnnnnnnnnnngcagnngtcntacgaagcac

SEQ ID NO: 207 - DNA, 706 bp, Oryza sativa
  unsure (1)..(706): unsure at all n locations
gtggggtnnnnattgatgatcgcttatnnnnnnnnnnnnnnnnnnnnnnnnnnnnnnnnnnnnnnnnnnnnnnnnnnnnnnnnnaagattcctataatgaggaagcgggcgacaactcatgatccgatgaggaaagttatgtaatgggcactggttggtcaaatgaggacttctctggacttgttataactggaggagatcatgctcccctgggagcataaagagaacgaggtgaaagacagagcaaggcatgctcataaagataagatgaaggaggcggtgaaacaaaaggcagtttccttgcagagagtagttaccggtagcaacataacaaattatgtgtatgaagcgcggtgcatgataggagaaagtacgaggcctttccatgcctctgatgcttattggaatgattattggaaagttagcattgtgaccgagctcatggctaattacaagggttgtgatgtgtcacctaccaatgctatctcttttggggctagcagatgtgcactaatgatcgtgctcacattggctttagaccaatatgcaataattatgtgcaatacgaacaaaatcaagttcgctttatgctatcacaaggcctggaaagctgagcattgactattgagatgacgtttgtcccatttgaggcaaatcatacaatttgacatttttgtatgccaccattggccatagagataattat

SEQ ID NO: 208 - DNA, 1557 bp, Oryza sativa
  unsure (1)..(1557): unsure at all n locations
tatatatatgtgagcgatgaaatcatatgtataatataactccaccattacaatggtttttagagggcatatcgaaattacatccagctgacgacgacggcgctcagcttcttcataggacgtacgtttcagtttccactcctcttttgttcttcttttcgcggggacatgcaataagcacgagcccaaattaagttgattatttcgccagattaagcaaaagatcacaaaaaatgtcaagaacaagagaagaatgtcatcgggttcagtacatatatgcatcgatcgatgaattaggccgggaggtaggacggcggcagcggcaggccgacgaccttgccgcagcggagggcgttctccggcatgttgtactcgtcccggagcgacctcgccggcgagacgacgctgatgtagagctgctcgccgaggtagtgcctctcccagatgttggacctcacgttccacatcccggcgttgtcgaacgtcagcatgatcgccgtccacgacctcgggtacacctggaccgagtgccggctcaccccgtccagcaggttgtacgtcttcctctcctccgccgaccacttccccggccccatcctgcgccatcagtcagtcagtcaacggtagcatcagatcgtatccatcatttatcttatttaaaaattttatgtaaatatagaaaaatcaaatcgtatttaaagtacactcgacaataatcaaattacaataaaattacaataaaatagatgataactgcataattatttttaaataaaataaatggtcaaaactcaaacgtttgtgaaaaaacatatattataaacgaatgttaaaagtaaaaaaaacatcgtatattataaatggaggtaatttaaaaaactttttttatatcattcgtcttattaaaaaattttattattatgcgcatcagtaagttagttaacagtagtatcagatcatatacatcattcataatattcaattttttatgcaaatataaaaaaaatcaaattatgtttaaagcacacttgacgataaatcaaattacaataaaatagatgatacttatataattttttaaaaataaaatgaatggccaagcctatctttaataaaaggttaatggaggtagtagtaatggggggcgatgtatgtacgtacccgacggcgaagaaggcgtagccgtcgaggtggacggagtccatgctcttctcggggttctcgaagatgatctcgatgaaggtgcggaactcggcggtgatgacgttggggacgacgtggagggggccattgacggcgggcggcacgtcggtcatctggttgtacctgaagacgccgtcggtgacgttgaagtactcggcgagcttgagcggcgtctcggcgtcgacgtgggagacgccattgaagccgtacttgagcttgccgtcgatgtggccccgggagaccatgagcctgatggtgcgcgtgatgttgatctggnnnnnnnnnnnnnnnnnnnnnnnnnnnnnnngctgcgtcaccaggcggcatntcaatctcgaanntcaatnggcccac

SEQ ID NO: 209 - DNA, 1220 bp, Oryza sativa
aggtggcttcaggcagtaataaaccggtgggtgaatgccttacaacggagtcagggatgttttgattcttcctttggcggaagacaatgttgggggacatatcccgggttgttattaacacattgctgcacaagcggtatgacttccaagaaccaatcggtgcttgtggcgtcccggatggctcaagatcaacggaatcacagcgttcgacagccaatcggtaatgccggatctagtcaattccatcattccaaattgcagtgaaaacgaaaagagtaaatttcataaaactacagatattataaccaaactatcacaaaactacatatttaaggaattatatcacaaaattacacatttagcaccaaatttagcacaaaactacatattaaagatgaagtgttacaaaactacacgtttagttattaaattatcataaaactaaaggtttagaaccaatttaatcacaaagtaataatgtttatagctccaccataacaatggtgctagggatttaaactccaaaagttatagttttgtgataagttcaatattaaatatgtatttttgtcacacctaacttaaaatctgcagttttgtgataaatttgatgctaaatgtgtagttttatgatacaactccttaaatctgtagttttgtgataatttggtcaaaatacctgtagttttgtaaaatttactcaaacgaaaaggaatcgccaatactatggttgtgtttgcaaacccatgttcccaacccctctccctcgtttttcgcgcgcacgtttttaaactattaaacggtgtgttttttgcaaaaaatttctatatgaaagttgcttaaaaaaatcaaattaatccattttttttaaaaaaattagctaatatttaattaatcatgtgttaaaaagccgctccgttttgcgtgcaggagggatgagttcccatcctgcacttgcaaacacaccctataaccattcatattttcaacacataaaacaggtccatcaaaaccacacgaagttttctaataatacctcacaaataccccatatactttatccaatctttacccatttagtactgtcggtgacatgggaccgggggtatcgtgactagaagcttgggcagccgcggtcacccacgtggcctgaccccctcgggggggtcgggcccgagggtgacatggccacccctccctctgtctccccgaggggttgg

SEQ ID NO: 210 - DNA, 3676 bp, Oryza sativa
  unsure (1)..(3676): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgctctatatgcttcattgacacgttaaatctgccctttatgtcaagatattattgcatccaagtatattaagcttctgtttgttatattctgcttgttttaacatcttaatatagagtcgtatcggagtattagccgatatatgctagatctatccgatcggctatggtacgaacatatatagtcctgttattaatatatatttcgatctaagtgatttatactgtctcggcacggcgaccgatctatcccaatcatttgatttaagtatatatcgatataataattgtatattgctaatatctacagccgatcaagtagatttaattctttattacctatttacaaacgccgatcgatttacatatgacatcggctcaaagataaatgatatgtcatcggcacctagccgatcggctatcgtttatagatttaaccgcggtttctttgtatctatttcttgttgattgcaggatcaaatcaactggcacgctaacacacccgaaggcgagctttggacctgcactggagttaagcagatctcccaggcctcgtgtttttcgtcaacacgcttttggcacgcccggtgggacagattaggagtcagataagcaattttcttcatggccgagaaactaccgccatcaccgtcctcgggtagcccaggatttgttaaagaaaaaatccaaaaggtatgttttacggacgttgatgaaaggaacattgtgaccatcaatccaaaaaagctcacacctgatcaaaagaaagattttgacgcgatgatgcaacaaggtgttcgcaaataaaacccgaacctccttgttagaccgacatgtcattcttttccccggcttgctgagtacgttaagtactcacccttgccccttataataatctatagagtttgaagatgaagacgtcgacctgacagctgaggagtatctccaggagcaagttgagtatgaagacttctagatgttttgtgcctagccccaagcctcgcctgtggaataagttagttgcctaagttctttgcctagtgcgtagtcgcttagttctccgcgctgttcgcttctgtgccgtcgattttatggttctctgtaatgctgtgttgctcatatgtgggcctgtccatgatggcaacgtttgtaaggactactacccagtgatgtaataaagcaatttactttgattccacatttattctgtgtataccagctagtgtatcctgggactggtactatatcacaggtaatgcataacaccccggtgtgagtttgctgtgtttatggctaacaaatgtcggggcgttacagtgaaatgaaaatttttttatgtcacatcggacgtttgactggatgtcgaaaggggttttcggacacgaatgaaaaaactaatttcataactcgcctggaaaccgcgagatgaatcttttgagcctaattaatccgtcattagtacatgtgaattactgtagcacttatgcctaatcatggtctaattaggttcaaagattcgtctcgcgatttgcatgcaaactgtgcaattattttttctttttatctatatttaatgctccatatatatgtccaaagattcgatatgatgtttttacgaaaagtttttttggaactaaacaggcccaaagaaaacacatgcgatgatagtgagggaaatatatataccttcctcactgcctcgctgacattcgtcgtcgcatctggatcgcgaaagtaggtccacccacgagcagccatagtgttgagttcatcgatgtatctctcccagtcaatggcagaacaatggcaatgcatacgcttgaactcttcatcagtaaagtctgcatatccgttagggccataagggatcgtccttggctctagtgcgttaaccttgtctgcccacagggtggcctccttgaatacttcgtagcggcgagccttctcctcctcagtgctgtatgaacggccatactccttcatcaagtcatggaacctggctttcatggtcgcctcatcgaccttcacctcctgctttttaatggcttcttggtagtctctcgcctctttagcaaatgcctcatcgtccgggagagtcttcccatgttcgacgtaattgagatagctagaccacaggatcttgccatctttgtccacgaaccctgcctcgattgctgcttccttgctcaggtaaggctccttgccggcgtcctgggcagctggtaacttcttcgtgacttcctccttatcctcctccctagctacaggttatgtacagatagtggtagtggctatggttaagttacatggatcagagctaaatattccctttgtttcatatcataagaccctttaagtttgatcaagtttataaaaaaaatatagtagtatttttaacacaaaataaatatattattaaaatatatttaatgttagatttaatgaaatcaatttgatactttaaatatttctaaatttttctataaactttatcaaacttgttaagtttgactaggaaaaaattactaacaaacaatgagaaatcttggccttttcaggattcagattggatgacatatggtaggcatgtcacaaggtgacatagctcagatctcagccctccaaaacaaatccaacggctgagattcgtccacgttntnncgagttaaaatttaactcgtaggagtaaaaattttacttggagtcaaattttattggagttaaattttaactcgtgatgacgtggacgaatctcagctgttggatttattttggagggctgagatctacgctatatcacctttaacatgcttatcctatgtcaccatctgaatccgctttttcaattcatacctcctgacttgtcagtgttttgcttgaaacacagaattgtggccgccaatccaaccaatgaagccgtggctacaacaacagagccaccaccaacggcgaaacccatctgtatcgcgtaacgagatgagagacatatgagctgcgagtgaacaaaagaaaagattttcgatttgagaaccgggtgagatgagagacgaacggagtggaaagagtgagctgctggcctccccgcccgagtgaggatacccagcgaggactccgcctgcgcacgggggatcccgcgtggcgagaaccccctccggcttcgggtgagaaggtaaccgatggcccggagcgacatggccgcgaccggagaagctccccttcttcctcctcctccgcccgcctccaatctcgcctagtcgccgagattcgattctagggttttctctctcgtgacttcccttcccgatcgacgtacgcacactacagttacggcccagtttgtaaggcccgcatatagatcccagcccaatagggctcaactataatgggcccgttccaatcgaacgagtaccacgcgtgcgtgtgggccctgtcgtcgagaaccaccgtcactacctgcacctgcacgggcccgataataataataaaaaagaaaaaggaaaaaaaaaagagaaaaatccaactannnnnnnnnnnnnnnnnnnnnnnnnnnnnnngtggntgtgaggagcagctcacctgcacgc

SEQ ID NO: 211 - DNA, 1943 bp, Oryza sativa
  unsure (1)..(1943): unsure at all n locations
nacagaagctcaggcttaagcctttgatttgtttaaacattgctgttaagattttagcatcatgtttctgttgaacaggtgtttggcggcaacgagggtggtggttggaanccaaaacatcgcaggtagggggtgtgctcatgattgccatttctgggatatttttgttctattacctgaaatgttccaatcacatgggggtgtggttaggtgtatttatcctaattaggtttggtcaatgatgactgatggggtactactgcggaaagagaatttaatctttagatcagtgatgcatttttttttcgcaggaaaatgacaggctgccagtcaacgacacgaacaaatttccgccatcgattgaaaaggtttgcatttgagcccatcggccgcagctgtttcttctctttgttcatgcgtgaaattttatccaagtagagtgcttgttgtgagttgctatcgtgccgattgtggtctcatgggtagtgtttgagtggaattgccttttaatacatggtccatggccccatttttttggaaatgtcagtctgcttttgccatatcatggatcttgtttcacatggccctcttttgcatttctactgcaatcaaggcactgtttctttccttttggcatgtaagaggctcagagctgaatggggttttgaacttactaactgtttgtcactatgtcccaaaaattgcattgcatcatctgaaaatcttgtctatctaccgaaacatgcaatttttttttgcgttacctaattgatttagttgttcgttcacaggactggagcaaaacaaataccggtaattctgatgcagaaagcaatgggaccaacaatcaaccaagtattgacaaaccgattagcaatacctcaatccatccaggtaagcagggcccattctttgaccacttatttagttttaaaattttaaatatcaagttacagctttaattcttcttgtaatgtgcaggccttcctatcaaacaaatcgtgatctttgatgatatatcattactgagtgtaagagctaatatgctttacagttatttttaacatgcccttgtctgttcgtgcagtaaatatatatgctgctttcgcatgaatttctgagcagggcatgtgatatgcaccttgcttttgcaatattttaaagaaacatttcaataatcctttgtaacttgtttgcggacttgcagaattatcatatattacatactttttatttttcacctaatgttgcagaatactgatgctgatcctaaggacaattttgaacaaggtttacctggtgatgagagtataaaatcgtgccaactagaatttggaagctattgtgtttggtctgttgaacacaaggaagtgatgaaagattctgtagtgaagagacttaaagaccagctctttgttgcaagagcttactatccaagcatagcaaaacttgaggggatggaaaaactttcacatgaaatgaagcaaagtatccaagagcatgagcacatgctcagcgaagccatatgtgatgctgatcttcctgcattgtaagtaatcttccagaaatactttctttagttctcatttttaagctatcatctttaatccataaggcactgctaacttcagaaattgatattttaccatacatgaaactgttgggtatttaagcagcctgactttgcaccaaaaatggtctacctactaactgttgtgcttcactgtttgttttttattttcacagattttgatatccgctnnnnnnnnnnnnnnnnnnnnnnnnnnnnnnntagcaagtnagctcgcaatccacacatgggggggnnnnnganatnagaaaaaatatcttcggaaatgannaanatagnnncacagtttaacctgatcaatagccacatcnaacatagaatccggaaaaatcgtatnggnacgccacgagtg

SEQ ID NO: 212 - DNA, 1726 bp, Oryza sativa
  unsure (1)..(1726): unsure at all n locations
tggttcattagaaattctacaaaggaagccactatcggtgttctgaattttgaagatttccaagcaacacatttggataataggagagttgaacacttatcaccatatgaggagttccgcatcgcttcccatagcaatgcccgaattccaaatacccaaatgagaactgaatatatttcagtgtttggacactctcttttcttgcttcctgagctgtttagcaatcttaaacgggtgattgttttggaagatgatactatagtccagagagacttgtcacacatatggaatcttgatttgaaaggaaaagtgattggtgctgtacagtcttgtcgagttagattaaggcatctcagaccatacttggttgacttcccatatgatgctagttcatgtatctggatgtctggagtgagtgttattgatctcaataaatggagggagcatgatgtgactgcagttcgtaatcgagtactccaaaaggttagtattgaatagtgatgcttagcagctgtcttttcttctctctttcaagaattgtttttaagaaactactttcgatgttatatttgacataaggcatattcctcatggctatactcttgattttctgtttgtgttcaactgaacttaccctactgtaccgtgatcttcactaataagataaacttgcttgaagccttgaagtttatttaagatatgtattttttttcttgcacgtttggcctgttaagcgaagagctgcaaattcttaactgatacggttgtgcctatgtctcacttttgacagctgcaacatggccctgaagcgtcatggagagctgcggtgttacctgcaggcctgcttgcttttcaaaatctggtccatcctattgaagcacagtggatccagtctggtcttggtcatgactatggagtcaatcatggtgctataaagaaagctggcatattgcactacaacggcaacatgaaaccgtggttagaactcggcatacggcgatacaggaaatattggagaaggtacctgccaagggatgatccattcttgatagattgcaatgtgaatccatgaacaaggcaattttgttagtcctggagtccggaagtccatgttcgacgaacagcaccaccttgtgcgatagcgagagttcactgtatgcgggaaatttgatgagaggagaggggcttcagtgagcaccgcccaaactactgaggatctttcaggatgctgctgagatatgaagtaaaaaaatatcccaactaccttcagagtttcagagcccaggtaaggagaatgctctggaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacccagcctccacaattttccacaactttccgttttttggctggattgggagcggattttcacacaaattattaaagggtatctttggccgcttaaattaactaaccatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 213 - DNA, 745 bp, Oryza sativa
  unsure (1)..(745): unsure at all n locations
agtgcctggaaatcgactgcacgtnnnnnnnnnnnnnnnnnnnnnnnnnnnnnnnnnttgtttgttttgtttgtgtctcgacgagatgtataaatttggttggtacaatattacaaatattaatatatatatatatatatatatatatatatatatatatatatatatatatatatatatatatatattatgaaacgtacattgtacgtgcatgtttatactagtataatatataaaacagagggagtactacatattttccctatcatgggtaaacagtacagtgaactcggcccatttaggcccacccacctgtatttggatcgagacccaaaccagcccacgaaaatttgggccgcaaaatacgggggggccggcctatacacttttgtgatagggaacatgcagctttcacttcaactgggttagctgcgacggccagggcacgtcaaaattaggcagtgtggggagcggatcgcacgcgccacggggagccggacgaaaacgagaagctcacagccaccggcgcgcgccaccagcatatactctctctctctctctctctctcgtcgacgcgccgatgcgccgagatggccccgatcatgaatggggcggcggcggctggtgggggcacgggcaggcgcgcccccgctcataaagaacgcccacccccgcgtccaaaagtcgcgtggaaagggccggaacccgccgccggcgcgggggttttgctactccccgaggaggg

SEQ ID NO: 214 - DNA, 958 bp, Oryza sativa
  unsure (1)..(958): unsure at all n locations
tggggtcnnnttttatatatnnnnnnnnnnnnnnnnnnnnnnnnnnnnnnnnnnnnnnnnnnnnnnnnnnnnnnnnnnnnnnaacttcaaaaagcagaaaattaaaggcaaagctacgtaaattacattagttgaggcttagacttaaaagaatatggcagctggtaattcgtattttatcgggtgaagctaaatgaccaatggtctagtcgtccaatggtacgaatccgcgacaacaaattctggtttaatttcttctaggaatttaaaatatttttatttttctctttttttatgttttttctttcatgtttatgttttttttctcctactagagtgtagcgcccgttccgtcgtggcgcctagcgggaaaattatctcctaaaaaccctaattgcgaaatttgtttcttcgcttgttgtctagtgtccgtgccatctcaagatctcaatccccgatctatcgtcgagttcaattccgaatccaaatccttccaaatcattcctccgcaaaagtccattttgcctcccccggggtcgatgggccgaatcccgctctgaccagactcttgccgggctctggaggctgaacattgtagctatcctgctatgtgttactccttcacacacatatccaccagaacacaagagtagggtattacacttctcatcgggccgaacctgtctacattcgcccggtctcgtgcacttgctctctcgcgaacattctacagatcaatcgtgggctaataacctcacttagcgtaccctgacgaaccggcaaaggggggcctgtgcggtcttcccgtgaggagctacacgcttccgccggtatattaccattcttcaagggtcttatgagcattttttcttttgaacccacgcgcgtgcgtgatttgagacactccactttatcttctcggcttagttggaggatggcgccttattgtgcccttgaa

SEQ ID NO: 215 - DNA, 3340 bp, Oryza sativa
  unsure (1)..(3340): unsure at all n locations
agcgcttgattgacnatcnnnnnnnnnnnnnnnnnnnnnnnnnnnnnnnnnnnnnnnnnnnnnnnnnnnnnnnnnnnnnnnttcgtctcccctcatcacgaacaaccgcccggtgtgctagcttttgcccgtatcgccggggttcgctccgccgctcgccgccgccgcccgctgtccattcgcggccgggtcgtcgtctacctctcgccggcccgcgtggcagccacgtaggcgccacatcggcgccagctcagcctaaaccgggtcgagccgaccccggtcagtccctccccgtgcgcgcgttccaccgcgagccgtgaggctgcgcgtgggcccgccgcacctgcgtccaccgcgaaccgcgtgcgtgcaccacgtccatcctccaccctagcgccgcgccgcgtgctccctccgcacggtgagccgagcagctgacaagcgggtcccacccgggaccgcgcgtggtgagcccggtccaccggactctctctctccttccaccgcgcgcgcgcgtcttgggccgccttgggccaccttcttgggccggccggcccgttaagctcagccgagccgccctttctctcgggccgcgccctaaccgcccgagggaagtctatattccctccctctccctttttcttttcttttcttttccaaaaaggatttaattaaatccttttcctttagaccaaaaatccaataatcttagaaattcaatatcttccccaccgtaaatccgtttgactccgttcaacttccaaaattccccaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctctggatctcgagcaaggcaagccacctttgaacatcttgagcctatacttgaaatttaattatattgcttgcaaaatattatgcattgataggatcacacttaatctgttgttccgtctgcaaggcagattggcggacctgcctaatttgttgcatttgatccttcctttgttaattgttataccatgtccccttgtaaccacccagttgcgcctcgatattcgtgcactctgtgcgagtatcgacggtcgccttcaaacttaaaatctgagaaacaacttgggtaaaacttgggttttacaaaagacttggaaaacccgacacctgggtcggtgcttgcgaactaaatgaatttctaaaaccgcggaccggggaacataccgggtgtacggttttcccgctcccgcacttaaggaccgattccttggaattacatccgaacataggacaagtgcgaccacatgggtggaatgggacacccctggctgagtaactagcttatcaggggagccatgatgccgagagacatgtggattcgccggggtggtgtcagagaggacccctgggcttcctggcacagtatggtctaggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatatcgtgtgggtaaagtgtaccccctctgcagagggttttagacaaggttgaggtcacccttttatagctttgaccatcaataactttaaaaatatttagtttaaagaaattagaacaacatatatagatttgtctttcaaagccactataataaaagtaacacacatttatttattatatatattataatagaaaaataaggtcaaaaatatattttatagaccgtgtcattgtccaaaacgtcaattaaaatgaaaccagcggaagtacatcctatcagctaagtatccgtgcgttacaacagattccggttgaacgataactggtagtactagtagctaggtacaccatggtttgtgtgtgagtgcaggtacgtatgtatgtgtgtctgggcccgagtgccactagggttatctggttgggaggggacaaaaatccacgagagaatacggggagcagtgcacaaagcgcggccggtggcgggctccatggatggcgcacgcagctaagctagatgatcgatcgagcaagccatgtgcattgggttatagaaataaagagatcgatcgatgcaaagggatgaagaggaggagtagtaggatggacgtgataaagcggtaaaggtaaaggggatcagattcagagagggtttagtgatccaagaaaggctctggatttgagcccggataaaagcagtatatccccagctacatatgggcatgatacgtacattccctttgggcatttgcgtttgcatgtatatgcgccccatgcgaatgatgcgagatgcgtttctcgacgcatcttgcgcgtaggatgagatgaaacaagcgcagcgcggcgctctgtcgcttcagtagctagcttaggtgcagtaccacgtttccttcagataaaacacacgtcgcgtgcaattcagggtttacagtctcgtcgagccttcgaaaccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtcttcaagcagcagtgctgtccatcggcattagttcccaaaaataaccttctggtgctttctcttccttccaaaaacaccataaaacattaaccgttgttttcaagaaggggcaaccgttttgggaaaaatggtggttggaatcaaggtacctttctcaaaatgactgaaatggtctcgggcttttggtggaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 216 - DNA, 2266 bp, Oryza sativa
  unsure (1)..(2266): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnttgtgagctcgggatctgtccacagcccaacatgactgtactcctactctataataaagagacctctgttgctgtgatattctatcctcctgtgataccagcactgtttcctgggactggtatcgattaacaggttaatttggagcgtcacgggctaattccagtcgggactagctcggggcgtgacatagagtatactcatgtctcttgttatatttttaatacaatgtaattattttaggtgtgtcgaccgagtttttctctcttttattaaaacaatgtattgtctttttcgtgctaaaaaattcctacaattttttaaatttgaaagtgtggacaaagagggcagctgggcctcacagttaaccacatttaagacgcacgcacagaaaagatcttcttcaacattgcatcatccaccctgtcgattgaatgctgaaaacaacaattccagcttgggcataattacaggatttcaaacttactttattaagtacattgttttgtaatggcaactaacccgatatgtacattggccgttgaaaaccacacatccacaaatctaataaaacgcaattaaacatcatcctgtcgtacattcagcgtgattataaaataatgcaaagaggctgatatttttaacctgatgatgatcagatcacattacgagcactgcatgaaccatcaaaaagatcatcttgaattagtcagggtatcagagaaagccaggttacggatggctatataggacaaattaacacggcgataattacatagtgcgacgcatgcttttgcacatgattctctaaagaagaagaagaaaaagaaatgctcagcgatgccatcggctaagctaataatatagttaatctaactaatttttggctaacactatagtctaattattaatcattggtgatctggtgtgactcgaccagagcatttttcggttgcatccgacgtagatccttcggctggtagctgatcgtaactagtaggtgtagtacatgttcgatcgatatctgtacttgttttttttcagaggaaagaaagtgagatccagctaactagtattatagtacttttaaaagtattttttatatatatgctatcagtttgttagcttttgcttgttgctaaattaaattattgtagcctgtaatggggaaaattattagcatttatttacaggttgtttatttgtgcagatcaattggtgttcttgtcctgcagacagatcaaatgattttttttatgagagaataattgattagtttaatttgctacggcagatcttcctcttaagaaaaattgacctcattatcatttctttaatataagtcccataatacaatctttgaagaatcaatattactaactatataaccaatcattagatattctcttatcattagtgtatatgcagaaaaatgtacagattacctgctagctgaatagatggcaacgttatcagccgtatcaggcaaaaataattccatcatgggggtttgatgaattggtcaggaactttgaagggaatttagtatttttcctaaaccccaaatgaaagtgattaaatgatgttctaagtcaatttatcacgtccatatccaggactaaataaactgatcttgcaccgatgttccagagcattctccttacctgggctctgaaactctgaaggtagttgggatatttgccatgacttctgaccttctgtcctgttgatgttgccccggcccttccccgttagcttcttcgttttcgatgaagatgtaaacaagttggctgacttagcagttgacacaatcattaaccattaacctcttgttcttggctgctctctgaatggtatcaaaattttttagacggtttataactttatatgatgtcaatcacatggttcttgaaaaccagcggttaccggccggtaaccgtccggagttgacgatcagttcgagcaagtgaccaaaaggatatggttgtttttaaaattgaattaagaactattttgtccaaataaaaaaaactgaatttaaatttctatcatgtaaaatccggtaaacggccgttacaagatttgacagagtccgataatcatggacaaacaggtttcaannnnnnnnnnnnnnnnnnnnnnnnnnnnnnnnnnnnngccacgagcactatcaatnnnnanccatac

SEQ ID NO: 217 - DNA, 997 bp, Oryza sativa
  unsure (1)..(997): unsure at all n locations
cccacaatcaccctngtatggttatggaagacttctcccccacccagaccntccacggtctccctcatccagtnatcgttatacccccccaccccccccccagggtgatgacggctgctggaccncccnnaganngagaannggaaccccccagccgagacggaccccaaaacaagaggaaaacaaacgagcacaagcttattctcccaagaagcctcctaactaagatacatccgctgtcgtccatagccttccttcttgcttaatcctctcgacgatgatcagaactgacgataggacagcgtcgaagacacgcattacacttctaccatagttgccaggatgtcaacgaaacaatagaatcgaaggggcggtgatggtccctcgcaagtcgatgccaagtttgcggccaccggtcttggacccaaaaatgatggtctagggcaacatcagcccatccagcggcgcgaggatttggaactagacctagcgagcgaagagtcgaagacataagcgatgatgatatggttcgcgtctcctgctcctgggtgtagaaggggcaagcaatgtggctctccatggtatgacgcaacatgacatcggcgatccaacaacacttttgcagcaccagccagaggaaaaaccagcacttcgcaagcgcttgcgcatgctagagggggtcggtacacgcgaacaagtgttgccccgtgaagaaagctttataagccgacgaggtagatcgagaaggcggtattgttcgaccaccgccagataaggttgtcctccatccgaggttgcagctggataggctgtaccatgtcccagagcaggaggaactggctaaggattaatccttacacggagagaggatatactccctccctccagttccatattagctgacgttttagacaaggttgaggtcaaacttttannnnnnnnnnnnnnnnnnnnnnnnnnnnnnnnnnnnnnnnnnnngcatgtcatttcaacgctg

SEQ ID NO: 218 - DNA, 1015 bp, Oryza sativa
  unsure (1)..(1015): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaggccgttcaagtctcataattcatctaaaattatgatgtacatgtttgtttactttttatgtattgtttatttggtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggattacttatgactcattattatttaatgatggcttaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccg

SEQ ID NO: 219 - DNA, 1846 bp, Oryza sativa
  unsure (1)..(1846): unsure at all n locations
ctggatatntgtgtagtctttttgaagagatcatttcatcccggttcggaaggctcgaatttaaaaaattatagtgaatttcgtcgaagttgtgacccttggtgatattcagagtggtgttttgtaatccctttcttctttacagagcatgtaccatcgtgggctttagtctcgtgcaaaagataagggcttgcgctcttgggccggaaaacattgggccgtttgatgacgccgttcatgttccccgtaagacatttcttgatttctgatggctctctgcatctctgatcactgtaattgagcattagtgcacgatgttatctgaatttggttcaagtctctggacaatgtacttgagcatgatgttttctgaatttcatgcaagtttttcggataaaaaaactccaaatcctagcatatgtaatccacacgtactacatattgtaacatcctgtttgttcttgcttcgacaactttctgaattctgatacaacgaaactgaccactctagcttgcatatgaaacatctctaagaacaattagttaagaacctagaagagttaaaacacgtagtagtacatgtaatcgatcacctctcacactacaggagggatcgatcacagaatctgaccaattaaacacgacatctacaaaaacaatcacctagaattgtactccgtactacacaacaaaaattaattaacaatcataattaattcctaaaaataattaagcttcgaaaccctactactaccaatcgagcgattaactgacggcgattacagcgaagcgctcgatcggatcggagtccggtcagtacccgccggcgccgccgctccatccgcctcggtcggcggcgcccatctggttgccgccgatcgccaccgacggccgctggttggcgttggtcaaatactgccggacggggtcatccgtcggcggcccggcgagcgccaccggcggcggcagcggcgccgtgatgacgtactgctgcatgaccagcacggacgccatcttggagaactcggaggagacgaggaggtcgccgatggggccgagctccggcgactccatccactcggcgagcgccgacgtcagcggcgagctcgcctcgccggggtggcggccgacgatgtacagctcgtgcgcgttgtccagctggctgcggatggcggcgaccgtctcctcgctgttggccaccacctgctcgacgtagaggatggcgtcgttgccgaggttgcgcgaccggaactcgttgaggtactcctcgtccatctgccgctcgctcttggcgacctcggggacgacgttgatggcgcgggagtgggcggcgggcatcggcggctgcggcggcgagatcgccggcgccgtgtaccccggcgggattaagcggacgatggtgaggcacacgcccgggttttcgaccatccgccacgcgtacgcgagcccctcccggtcgtcgggcccgccgaagaagaggagcgcgacgtggtgcacggccgccatcctcgccgcggcggcgctgaggccgcggtcgacgaggatgccgacggagcacggcgccgacgcgaggatgctctcgttgaagccccggagcgacgcgttgatgggctccatgccgccgtccaccgtctgctgcttgtggaacgggagcacgatgagcgagacgtgcttgtcctccgccagcacgcacacgttctcgtgcatcgtctggtacggcgacaccgccgtgagcgcctgcaccgacacgccgccgaccatctcctcgtagctctcgaacgcgttgaagatgtggtcgctggcgccgcccgggttcgacgcccagtggtgcgcggcgagcatgttg

SEQ ID NO: 220 - DNA, 1263 bp, Oryza sativa
  unsure (1)..(1263): unsure at all n locations
naccacctttactgggactggcggcgactctgttaaccaatcgagcagttattatagttcaatgacgncgtctaaggtgacggacnacgtccaagtgtcacccatataactcaagcctggcggaagggcttgagagtcatgtctagaagacggtggctgctaacaataatgtcgacctgaagaagtaccaggcgtagctagaagtcaatatggtagggtccctgacaaacgctgtaggcggtgtccatcatcggggagtatcataagagcgcgcaggcgcaggcctgtctcttaccacttacatactggaacgcggaggcggggttcttcatgatcggtcagcggagcacagtgcctcccgcggctgttgccgcccaaataatgataggggccatctcggcgcatcggcgcgtgttttagacagagatagagagagacagtataatctggtggcgctcgtcggtgcctgtaattttctcgttttcgtccggctccccgtggggcgtgcgatccgatccccactaggccttattttaacgtgccctggccgtcgcagctaaaccagttgaagtgaaagctgcatgttcactatcacaaaagtgtataggccggcccacccgtattttgcggcccaaattttcgtgggctggtttgggtctcgatccaaatacaggtgggtgggcctaaatgggccgagttcactgtactgtttacccatgatagggaaaatatgtagtactccctctgttttatatattatactagtataaacatgcacgtacaatgtacgtttcataatatatatatatatatattaatatttgtaatattgtaccaaccaaatttatacatctcgtcgagacacaaacaaaacaaacaataggaaacattaatgataatgtggagaggtggtgccatcgtaccaactcactctcagttccatcatacgtgcatgtgcggccatgccaactgcctacattcctccacatataacttgcttctttatgcccatgtcaatttgaaacagaataagaataattttaaacttcaacttgattgttatacagtttgactggaacctatatataatttgatcacaattactttaattgcaaatataacagatcatattggattaggagcagaagatgcaacagtagaaaagcaaagtatggataattcannnnnnnnnnnnnnnnnnnnnnnnnnnnnnnnnnnnnnnnnnnnnnnnnnnnnnnnnnnnnngttnaacaatnaaaacat

SEQ ID NO: 221 - DNA, 745 bp, Oryza sativa
  unsure (1)..(745): unsure at all n locations
ctgtgcttttgataacctatnnnnnnnnnnnnnnnnnnnnnnnnnnnnnnnnnnnnnnnnnnnnnnnnnnnnnnnnnatggtaaaatatcaatttctgaagttagcagtgccttatggattaaagatgatagcttaaaaatgagaactaaagaaagtatttctggaagattacttacaatgcaggaagatcagcatcacatatggcttcgctgagcatgtgctcatgctcttggatactttgcttcatttcatgtgaaagtttttccatcccctcaagttttgctatgcttggatagtaagctcttgcaacaaagagctggtctttaagtctcttcactacagaatctttcatcacttccttgtgttcaacagaccaaacacaatagcttccaaattctagttggcacgattttatactctcatcaccaggtaaaaatggatttgcaatgtagctgaatttcttctccgaagccaaatttcagtttgttaactgttcacagatcagtttcaggctttcagctagatgtgaaagatgcaggtcgtttatgttttctttcatcatgcgatgttgtatgatcgtctgaatgtcatttgttcttctatagattgctactactgatggtgctgaaattactttctgtgccacgatttattcctagaatgtgtgcatgatgtagaatgttgagtacaatttagtagcagagggcttcttggtcgccaaaatcatttagagataacaggctt

SEQ ID NO: 222 - DNA, 1470 bp, Oryza sativa
  unsure (1)..(1470): unsure at all n locations
tgaggtcnnatgtanattctatnnnnnnnnnnnnnnnnnnnnnnnnnnnnnnnnnnnnattttagatggacgacaaaaacattttcaaattttttaagtagtagagatagagattagccattttcgttttcttagggagtattgtcacggaaaacatagtaatttattaatatataactaattaagtactagtaaaaaataattaaaaaaatagattaatatgtttttaaagcaactttcatatagataatttttgcgaaaaatgcaccgtttagtagtattagaaggaaagaactcagtattaagggacctgaactgaacttatttcgtgcggagcctatgttggtatttcataaccttacagagaaaattcgcaagcacacgtaaaataccgatgtagcacttcacccgaaaatattctcaggtatcgatttccatagggaacgggtattacttccatatcaagttcacccaaggacactaagctatggtaggcgaaggatagagagaatttcctagtgggatgcttaattttaatcctaatgcaataacactggcagctcttcctagatgtcactctactacgtacccagacagggaggacttaagtgctcttgagagctgtcatcagctctacacccacctcaaacgtactgtgggatacgcagcaattactagatattaattacctaaataccacgtctaaacaattaatatctactctagtgtttataactcactaaagcaatcactatattttagttgattatagggaacaataatcctgtatgctgattaggaactaaccaaaaagtagttctcacaagtaaatctaaatcactcagaaagatatttctattgaaatcagagtaattaatagaataaaagagtctggagaggtttgccaacaactccggaattcttccgacttcttcaactctaccttttcctaattctagtatacaaatagtacaatagagcctcttataattcagctcaagcttgcaagtgtgtaaaaaagtgaagtctatttatagggcaagtatgatggttgaaatgatgcgaaatatataacttccctgcaatggtcatcagaaaagcatgtggagcgtccctgccaaaccccagatccaccgtagaaaaccagggttcggccgaaccccgaccatagggtggcccatctggctgccaggtttggtctgggcctcctccttgccatgcctgtatccatttcttctaatttggggctaattctccggagttttggtgaagtctaaagcccaactcttatatggatagatttcttctcacttttagtgtaaatttcctcccaaatacagatgcctgaatgcctatttacagtaccatacaaagaacattagttgtttacaacaagggaagctaccaataggnnnnnnnnnnnnnnnnnnnnnnnnnnnnnnnnnnnnagtaggacattcaaggcgcgcg

SEQ ID NO: 223 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcttatgtccatcccctttccaatagaacatagatcgaaggtagtcaagtttcttacgtaccccgctaggtattgcaagaaaagacatcatatacattgggagactgctaagaactgagttaatcagcgcaagtcaccctcccaacgagacaagttttcctttccagctactcaatttgttttcaaatctttcaaccacttctttccattctgcatttcttaacttcctgtaatggatcgggatnnnnnnnnnnnnnnnnnnnnnnnnnnnnnnnnnnnnnnnnnnnaatataatnngcacac

SEQ ID NO: 224 - DNA, 748 bp, Oryza sativa
  unsure (1)..(748): unsure at all n locations
cgcggtnnnttgtanatcatataacnnnnnnnnnnnnnnnnnnnnnnnnnnnnnnnnnnnnnnnnnnttaggaacaaaatgaaaggttttatctttttctttaacaaatggttggtagtagtaataggccctatttgggggagcttgtcccagttgcagtttttcccaaaagatgcttctgctagaagctgccctaaacagtccacacttctaagaatctgtagttacaaattctgaaaaatgaactaagaagccagaagctggagaagctgggtttcagagtttttttagattctcagaagctgactatcaaacagctgcttctcagaatctaaagctcccccaaacaggccgatagactagtagctggtgggccccatgacacagtcacttggattttcctctttccatgaggtgactgcttgcatttggtgttattctctgccatatataaacaccaccattggtcgccatggagaaaagagggagagggtgagagaaagcagcagcagagcatatcttattgagcagccaagaaagcaaggtattggaaggaattgaggaggagaggaagtgatggaacagcatgagctttcttcttcctcttcctcttctgaaccctcttctccttcggtttcttcttcggcttcgtcatcgtcctcgtcctcgctgctgaggcagtgcaggatttgccatgaggaggaggatgagtggtgcgcttcaattgaatccccctgtggatgctctg

SEQ ID NO: 225 - DNA, 1352 bp, Oryza sativa
  unsure (1)..(1352): unsure at all n locations
gaatgggnnntttgannatgatataatcctatnnnnnnnnnnnnnnnnnnnnnnnnnnnnnnnnnnnnattgttccctataatcaactaaaatatagtgattgctttagtgagttataaacactagagtagatattaattgtttagacgtggtatttaggtaattaatatctagtaattgctgcgtatcccacagtacgtttgaggtgggtgtagagctgatgacagctctcaagagcacttaagtcctccctgtctgggtacgtagtagagtgacatctagaaaaagctgccagtgttattgcattaggattaaaattaagcatcccactaggaaattctctctatccttcgctaccatagcttagtgtccttgggtgaacttgatatggaagtaatacccgttccctatggaaatcgatacctgagaatattttcgggtgaagtgctacatcggtattttacgtgtgcttgcgaattttctctgtaaggttatgaaataccaacataggctccgcacgaaataagttcagttcaggtcccttaatactgagttctttccttctaatactactaaacggtgcatttttcgcaaaaattatctatatgaaagttgctttaaaaacatattaatctatttttttaattattttttactagtacttaattagttatatattaataaattactatgttttccgtgacaatactccctaagaaaacgaaaatggctaatctctatctctactacttaaaaaatttgaaaatgtttttgtcgtccatctaaaatgaaaaaaagagagaaaaaagtctgattgtatgtaaaaagggcagaaataagtctgatttctattcgatttcattgtttatacgttcaatatctctaacctcttctggtgaaattttcttccatcctcacctatttttgtccgcaacattccaagtccaacacacaacaaatcatccagaatccgcatcaaataacacttcaccttcgcttacccaaaagagaacgaacggtaaattttaattcgcaggctgaagaataaatgctgaaattatgtttgtattgtcaaaattagcaattaagctttgaaaatttcaatgaaattccaaagagtgtagttaattatgaagaatttaaaaagaattaaatccacagggagcacctattttacttgtaaaataatttaattattcactttccaacttaaaaaaatattcaaattttgaaggaaatttgtgtttgcaactttttgtgacaagttgaccagcacaatcacagcacctaaaagcttgcggtgattctagagtcgcccaccattcctatctagcaagcacttgatccagttg

SEQ ID NO: 226 - DNA, 726 bp, Oryza sativa
  unsure (1)..(726): unsure at all n locations
tgggnnnttgganaatcnnnnnnnnnnnnnnnnnnnnnnnnnnnnnnnnnnnnnnnnnnnnnnnnccctgcatttcttgtagttgttacatgcatgatatggttcttgtgatgattaatttactagtttgttagtggctaaaatgatgtgtttatggtttgtgtttgttaatttgtgcatgtgcagtatgctcacaggggatgtgtgcagaggtggtgtgatgagaaggggagcacactctgtgagatttgcctccaggtagactcttctttgtgaaagtttgtgtttgatcattagtgtaccatatgacctattcgtgtataatgtgaaacagctagccacttttattggggttagctagaaaggtgaaatttgtgcaggaaaggtgccaaacagctagctccttttttcttggttatttatgatttggaattatgtgtagctgtgcaacattatgtttagaggataaagtaacagatttctttggggttaaaagaaagttagctaatgcttctaatcataagcaaagtgcacttttcttgtgcaaaatgtaaacttctgccaacctttcataaactattacactagccgcctaaataagacattctgaaagatttttcatgcataatcctgtttttttaataatacaagatgcttttcttgacagaattttgagtcagattacaccatcccttnccaagaaagtgcangtttgttgaaacggca

SEQ ID NO: 227 - DNA, 2824 bp, Oryza sativa
  unsure (1)..(2824): unsure at all n locations
ccgcttgnnnnnnnnnnnnnnnnnnnnnnnnnnnnnnnnnnnnnnnnnnntagtggttctccaatgagattacagagataaagctgcagctcagttttcacacagaaccatcacaacaaaatataaaaagagagaaaaaaaaaagaagcttcagctggcaacatttccacacagaactacactgaccaattgcgttaggctgtgtgaaatgccattatctgaacaaaaatgtacaatagggcatcatgccaaaaatgaccagatagacagccaaatcaaaccgtgaagtatgagctgtggatgcatcggtgaggcgtcctgtcaagagcgtgcgtccaaatcacacggtgtcaatgcacaaatccaccttcccggccatccagcattccagctaacgtggccaccttagtcacactcacatcatcacccggggttgcatcttgctgcaaggtttcagcagttgcaaccaccagatcggattagatgggggacacatgtgccaactcggtacactgcctgatgcagagccttcttttgcagagacgaggagatgctccctgaggaactctctcaggaggatcaggagcagtatgcaggatccgaggcgcagacgggtaatggagactgctcctcatggtgccgatcattgacgataacggtatgagacagctgaagcgaaattgtccattgtctggcaggccgttcagggtgtctcctggattctgatatcatctgtgattcttgtgcagttcaccattatgctgctggtgtggcatctcattgcagtggtgacaattgaagcggcggatcactgtgcattcagccttgtcacagtgagttcactatctcaacagaggagtaaactaatcaattgaaattaactaactggggaatgttgcattgcagatattcttacttcgggctgctggaatcttgttgccgttctatgctatcatgcggatggtccgcatgattcagcatggccaacgacagcttcggttgcagctgcttcaggttagtcttgactgacttctgctcaatggcttataggagcataatagtccgcagtcatgataccttctcttcctctgtttctgcaggatcaacggagaagaaacgcatcaaacttgcacagtatgagtggccaggagcagcaccagcagcttgtaattaatgttcactgaacaaatgaacttaaatgcttctacattggaaggtcacaggaatgtgcaatatgtgttgaggggaatatgttcaacatttgtaaaattttagtatatttgtagatagcatagtaaaaaccatgaatctgcagtctgatacagtttcgacttaccagtgccatggacgcctcaaatatgaatgaaggttcaaataagtgaagattgcaacaaaagaaaaagactatttttttcttttttcttttttcttaatttgtttgtcatgaccaagtattggtgtcaagatggtataaacccagcatttacagaaaactaagctaacacactaacagaactaagataaaattgagaaaataaagtacctaatcttgttcatccaatctaaaagataattttaccactggcagttggagaagcccaagatatgatcagattgaaaaggcacccacacatgacacttgaaagaaacaggttgcatcagtcatgagacaagcaggattcaattcatgcgtctttcgtaaaatctcagctagatttgagaagccagagcaatccgatatcctgaatggatgctgtcccattatcttgatataaattaatatgagaaatccattacactaatccagattatatttcagttaccaggtgtgtttattttctttaaaacaaacgtatatactgtctgtacaagggaccatcaaagaactaaaataatgcccattataccaaataagtcaatttcaacctgatgcagttttccttgaaaaaacgcatacgtaaatttaattcaggaaatattaggacaagagcattcagttttaagctgaataaatctaaaggctagattcatggcattattactattttattttctttctatcctgcataccaaatgtccttgaaagattaatcaaagagtaaaagctaaaaaaaaaatactaacacatgcatcacaaaagttgaaatgtgagcatgttatatctgtcaggtttaaatttaaatcaggacagtaggaatcagaataaattaaattcaccaaacagaaaagtacaatagaatcaaagagcattgctcatgtttggtgtaacagtactaagaggagctagctaactgaatactgtacattaccttgactcttaccaaccaagtgccaagttagaatcaagcaccacatgatagacagaaaggtctcccatgtgctgtgggacagtagaaaagtctgagacatataaagccagataaggaacacaataatacaacggaacagatttataaaacaaatgtggcaaataattacaacgtactgagcttgcagttttcataagcagtgaaatatctacaattagacacgcaaatcatatttgtaatagcatttagtaaaggacggaaccagtgcacatctaatgttgaaaggcacaacaagacaactccatgttaaagaaccacagaaacagagctaaatctttgatcacatgtgaacagatcagcaaactgtaatacacacaacatttttagtaaaattgacaaatctatccccaattgtaaacatatggcaatgttgggtcctttgtttatgcaatggnnnnnnnnnnnnnnnnnnnnnnnnnnnnnnnnnnnnnatagagatcgtcatcaaagggcgc

SEQ ID NO: 228 - DNA, 1571 bp, Oryza sativa
  unsure (1)..(1571): unsure at all n locations
cgctggcctttgattgacgattctnnnnnnnnnnnnnnnnnnnnnnnnnnnnnnnnnnnnnnnnatggaagaggcactcctgaatgaagatttagcgtaacacatgactgaactaaaataaaactaccataggctacatcataattaactgaatcattttgttcacacatgaaaacacactaatatttcatggaccattactatacaacacagaaaacaactagcacctttctcctaaaaagcaggagcaacacctcaaatttcagccaccatcaaagagatccacatttctgctggcaaatggtaatcttagaacgtcctgctctcagtctgattagggacattcctcttgacacgttttttcattctctctgcccactggtggaacacattagacgcatcaaatttacctgtaaacttcaccttctgagccaattcatacaatatgtcaggcttcccagccttggagaaatctgcagcaaacttattgtagtctatctgtggagtcttcatccctttttggatcatctcttcaatgtatttacatgcctcctcaggtctaccatgtcgtatatgcccattaataaacactgtgtaagagttcacatctggacaaatccccttccggtgcatctcctcccacaccgcacaacccatcatgtagttcctcccgccaaggaaatatgacttcatcatcatgttgtatgtatggatcgtaggctcaagtcccttctttatcatctttttatatattcttgccgcatcatctggcatattcctattcgtaagtagcttaatgagagcattgtatgtccgtccatcaggagggcaccccttttgagtcatttcctccaatagggctgtcactctatccatcctctttgcattcccatatcccacaagcaagcatgtataggtggcgacatccggctggcacccaacatcctgcatctcctcgaagcaccgcattgccatgtccatctttcctcgcttacagtggtcccgaatcaacattgtatacgtccacacatttggagcaggcccctttgccttcatgagctcaaacatcttcacagcctcgggccgcctctgcccgcgtagcaacccctcaatcatcgtattgtgcacgacaacatcaggcttcaacccattctccagcatctcattccaaacccgcccagcctccaccagattcctcgcgttgcaccatgccagcatcagcgcggtatacgaccgtaggtctggagcgtagcggtcacgcattctgtcgaacacctgattagcctncctccccagcccctcctgcgccaaagcaactagcaagcaattgaaggactccaccccatcgtcgaagccgtgcgtcctcatcatctcaaacacgccgaccgcattcttgatctcaccggcagcagcaaacgacttgatggcgatcttgaacgcgtccatgcagagggcgccctccttccccatctcttggatcaacgccaccatcgactggaactgcctnnnnnnnnnnnnnnnnnnnnnnnnnnnnnnnnnnnnnnnnnngatacgtcttaccctggcgcgcg

SEQ ID NO: 229 - DNA, 6354 bp, Oryza sativa
  unsure (1)..(6354): unsure at all n locations
agcgtccattgaagtacttgtttcnnnnnnnnnnnnnnnnnnnnnnnnnnnnnnnnnnnncacctcgccccacatgccagcggcgagagcagagggagcgaagcggcggcggcggcggaggtcaaatgcggtgggggcagcggtgaagggcgaagaagtgggcgatgggggagtggcagtagaagcggaagtagacggtgagggcgatggaagaagcgatgaaggcgaagaggaagagcgtcgcgcacgggcacaggagcaccgtcgccggcccgggttgccgcggcggggagaagggcggcggcggcggcgacttggaggtctccatggacggcggcggcggcggaggaggaggaggaggggaggaggaagaagtanntngtgggtttgggcttaacggccatggacggggatcctgccactgcgtcggtggaattttggtgttccccttcctccctcccgtcttccactgttccgctgtaaaaatgtaaaatcctttttcggtgctttgctgtaaatacctaaggcatccgcaatgttgtgtttagcgggtataagtagcattagatactcttttttcttttaacccgataacaatacagtaagagcaagtataatgagctatatgcctactataagtttatgtggagaagagatgtgacaaaaagttaagggtgttggctttcataccagagctagcttaacacaagcttcaaaacaaatacaattaatgtataagtaagagatatagagaggagaagaaaattatagccaaccttatagctaatctattatatatgttggctttaagattggctaatagtaggaagtgagctctattattatccttgctctaagagtcataagtagttacttccttcgtttcacaatataagttattcagcattttccacattcatagtaatgtcatctagattcattaatatgaatgtggaaaatgttagaatgacttacattgtgaaacggaagaagtagaacctaattacacaggtacaatcaataaagaagagttaaactacagtgtttctgacaaaaaaacaattataaaagggagctggtcattgctttccaaccgctgttctagctgttgcttcttgccaatacttcatgccattttacagctccatactctaaaaaatacttatatgacttgtaacttgttgaatcaaaacatatacattctatcaaatagaagagatggatccctccaacagaagtttataaaagaattgcaggcatgatatttatcatatacttcctccatcctaaaatgtagctacttagtatgggacgtgataccacctagtactacgaatctagtactactaaaatgtaactaaagacaaatattttaaaaatgattcataatcaaagattttaaagtttgacctcacccttatttaaaacgacaagtattatcagcccggagggagtatatgaatctaatcggtggcaagttttttagtcaagatgaattaaaggacaaatattgagccgaacccatacaaccactctcaccgaaaggacaaatattgagccgaacccatacaaccactctcaccgaaagaagagaatagttgaggccttatgcaattagcaatgggttgaagacatatgacacaatatgacgtctgcccttctcgaggaatactttgttacatggcgtgttggcacgcccaacttacagccgtcgaaagaaactaaagacacaataagatggaagtggacaaccatgagaatatagtgcaaagtcagcatatgaaatacaatttagtagaataattgaggtggcatcatgcagtcaaacttagagaacatgaatacctaccaagtgcaagatatttgtttggtttatattcggtattcacgtagatgctagatgccagatgaacaatgacccatggtctaggttggagcaaagtcgacggtgacaaattatcagcaaaggagacgatgaaactacctatggcagtgacaaattatcagcaaaggagacgatgaaactatctatggcagtgagtaccttagagcagaggagaaacgtttggaatgggtcaaaaccctaagccacatgggcgttgagcagggtacaaagtttcatctcgtgccacacaaaaaatgcattggtccatttcctaaaccatagtctaaatgatagttttacagtttacactgatcccaatgttttctaattgtgtggtctagttagtataggaccgtttttgactgactagatggttaaatagtctaattcgcaatttaacttctaaaatggacgagaaccgtttgtctagcatctagacacggtctagactgtctagactatggcttaggtgaacattgttcactagcacgggatcggctatgtctaacgggcttcaagcctcatctctttcgggtaaggcccccgccactaagcaaatgtcactggtgtgagaaaatatctcaatcgggcaccaggccatcacggatggatgttatctcaatcgggccaacaacaaagcccgtcacagataagattgaccaagcaatacgagtcaaaccaggttaggtaggagcccgtcatggatgactaatcatctcaatcaggccttaaggaacagcccgtcaccgatagttttgacctacctgttgagtcaaaatagtcccggtttggatgacttatctctatcgggcttacaccaagagcccgtcacagatgactatatctctatcaatctttatttagagcccacagatgactatatctctatcaatctttatttagagcccacagatgactatatctctttcgggcattttaaaactgcccgtcatggatgattatgtcaacatgtactgcgtgtatgttccatacagtcatagcaagccttctttcctttcacggtttatccagaaagattacccagtgcgggataatcattaatggtgcataacaatagaacttgtagcttgaagttctcctgaccatatgcatcccaagtttccacaccttctttctagagaatctcaagatcattgataacaggctccaagaacacatcgatatcattgccgggttgcctcggaccttggattaataagcacaacataatatatttccttttgaagcacaaccatggcgggaggttatagttcgcaataagaactggccaagtattgtgagaactgctcatgtctctaaaaggattcatgccatccgtacacaaacatatccttatgtttctgaggtcggcagccaagtctttgggcttttgatcgatattccttcattgaatcgaatccgcagggtgtcttagcaaaccgatgttccttctttctgtggcatgccaacatactaactttgcttacttggggttggcaaatattctcttggaacgatcaatgatgagaagatacaacacaaccttcgccggaccacctcgcttcgacttctttccctcccccacacttttctttagcttgtatcaagaagccttgtagacaagacaaacatctaagtccgcatattgtttgtggtacaatatgtagtcgtatggacaagcgtgaattctacggacctctaacctcaggggacacgaacttgctttgcttcatatgtcgtctcgggcaatgtgatctcttcaagaagcatggccttcaatattcccaaaagttctgtaaaactcttgtatgcccatccactacttgccttcagcttcattaggttcaaggtagctgacaatttggtatgtttttggcttgcatctggtgtatagaggtgtctccgagtcactaaccaacctgctgaacttcgtggaatctctctcgttgtaagttgggtcctcgacgtcacgtaacatgtcttgcagcagatcagggtctacattaaccatttcaccgcccaatggagatggtataaacatgccatgctcatcttcatctccttcttcatgattgtctgcaccacttgtctgcaactacaccacttcccgatttttactctccatacttcacccaacatgtgtatcccttcatgaattcccccgttgtatgaagtgagagtgtacgtccattctgctttcaaacatattctcattcttgcaatctctacatggataacacatgcatttgttgtttcttcttttcctatcctcctccgcagcgttcataaaacttaatgcgccatttctatactacttgcaatgacgcttcaaagtagtcgcatacatctaacttcgatccaccgctgcaaaaatgaacaaaatattagttaacatcttataaaataagtactactaaattaataagaaattattagtaactttttacttattttcatgattttcctgcttttctttggaaaaaaaatgataaaaattcgctcccttcaatctcccacaaaaatagtgaactgtgggagtcagacaacagacaggtggagtatttatagtgtgcaaaatatatctcaatcggtccaaagaaacgagatttctaacgggcataaataaaagcctgtcaccgatatgaatcatcggtgacgggcgttaacctcatctcaatcgggccttatttggagcctatcaccaatgttcttcatcgctgacgggcttagtagttgggcccgattgagatataggaggtaatttcaatcggatctaacagtgtgcccgtcacagatgagtgtcatcggtgacaggttataggtatatacacctcgattatgtatgtacgagtacatctataacaatgttaatttaggcccgattgagatgactttgttctgacggcccacgaaacccaagcatgtgaggggccagtggccaaataactattcctattagctgtgcatgaagaatttgaaaatcgctaaacatctgattttggagtgctcggtcactgtgatgtatggaatgaaaccttcacaaagttgcatcatcaaatgaacaacacctaagaccatagcagccttcttgactagttactccctccgtttcagtttataagacgttttgacttttgtcaaagttaaactattttaagtttgactaagtttatagacaaatatagtaatatttataatactaaattagtttcatcaaattaataattgaatatattttcataataaatttgtcttaggttaaaaatattactacttttttctataaacttgtttaaacttaaaagtagtttgactttgacaaaacgtcttgtaactttaaacggagggagtagaatggttgtttcatataacaagtatgcaacatattccgcgcttgctgaaattttgaagcctatttagcgagaatatcttgacatggcagtaagcctatttaccgttataagagtatgtacctatgcaaatcatatataccatttggcaacttgtactttgtttcttctgagataaatagaaggcccacttgcccaagctgttttttttttaaaaaaaatctaaccagatagagcaaacatgtgacaaaatttgaaggaaattcactctaaatttctatcaaagaagattagcaattatgtttttttcctacattttaattgcacgggatgggatcaaagctatgggtgtaatcttttttatcgtttgtcaaatgcaggccaactcggtatctatacgtccaactaaaatggaagatttttgctattttttatttttattttttataagattcccgtgtttcaaaggagaccaaataaaggtcgctttactcaaatcaaccttataaaattacattccaattttacataaccaggtggcaagcacaaagtaacagggtaaccaggtatacattgtgctggtaagcatacattaagctttcacccaaagaaatggtactactggcgaagtgagcatagcgtctatatttgtactgtttctaaaaaaaaaaaagtacaactccatttcataaactcatgtaggcttggatgtctactttttatagtggtgttcgggagggagagaaggttatgaacttctatctcacgcatgtaaaataggttggcttattagtgcattaacaattaaatattagctataaaaacttaaaatttagattaatatgatttctaaagcaacttttctattagatttttttttcgaaaaaaagtatttttgagtagtttggtaagcgggcacgtgaaaaaaaaatgagggagtataaattaggaacatgtaattaaaaacactctcaagcattgatggaaaccgtcaattgagagattttagcaagcagtcatctcgttatttgttttaaaattaaagagagcaaaatggannnnnnnnnnnnnnnnnnnnnnnnnnnnnnnnnnnnnnnnnngtgatatctatnncgcgcg

SEQ ID NO: 230 - DNA, 2076 bp, Oryza sativa
  unsure (1)..(2076): unsure at all n locations
ccctcccacacacgatactccgccagggtgaataacggcntagnganntcnctcactccctaanttatattcttnnatcccnnnnnccntnnnccaantnnctnnnncccnncncccccnnccccgagaggnatgatttcantgtctggaagcnccgcagncgactctagaggaacccccgcactagcgttgctcgaggcaaagacgcgcggtattgcgacgtcggcacttggaaaggttcttgcggcggcgcgtctggaacaacagaatgggctgtctatagttccacactaaaattaaaagtttaaaaaaattgaactatgtgacgaaaaagttgaaagtttgtatgtgtagaaaagttcaatgtgatataaaagttgaaatctaaacagagctatgctttgcgtagagataccagcggggcggctgcgtgcagttgagccgacatattgtcttccttccctgaccacgctggacggctgtttgtggttgtttctgttgcaacgcatattttctgtgtgatcaaattagcacatgataattcactagtataagtccggccatccttgacgattcatatgtgtcgagctaatgcaacctttttcggatgactcatctctaacggtttaaaaaagtatcatgtttaagatatgactatcggggatggtccgtcaccgatatgtcatctttgtggggtcgtagttctaacacgtcacggatgacctataacgagtcacaaaccatgccccatcaccaatttaaagtcatctttgtcagatcgtagactcgtagttctaacacatcgcatatgacctataacataacaggtcacaaccattccccgtcatggataacatgtcatccgtgacaggtgtaatgagataacccatcaaagatgagagcactcatccgtgacgggacttaattaacacccttcacggatagcattatccatgaagagtgacaatcacgaaccatcacgtatgaggaaaaattcaaatgtttgaaattttcaaacaaccttaaatagagacataccttatgaccttaaaactaataatatttaaatttgagatagtttacatgtctgaatatgccttataagtggtgatagctattttgaaatacgtaattttgaatttttcaaatgatctcagatggagacatagtctatatcaaagtcaaagggttcgatgagatgtacaactttctaattgacaatattttcatttaaagttgttttcatctccgaataagtgttacaggtgatgtgatatatttcaaaaatattttttgaatttttcaaacgaccttgaatggagatataccctacactaaagttctagagctcgatgagatctgcaactttgtacttgaaagcattattatttaaagtcatctagagtttcaaatttgtgtttcatatttggacaatagttaaaagaataacatctgattaccaatcaacatgtggtctgtaggtgagatggtaagattggtttgcatgtgttgagaagtcttatgttcaaatctcatatatgacatgtatgcatataccatttagaatatgctagtaatatttaaaatatattttttagggtttttatatatttaaaattcaaaaattgtaattctcgtacttatgaaccgtcacttatgagagtcatccgtgaccgtcttttatcgataaagatgattgtcatctgtgacggcggccgacccaacacagatgacttttcacataagtgacttttggttcgtgtgtacccctcgccgacacagatgaggcttcccacccattacagatgagctatcccgtgctagtgattaacagtgaaggcaaactccttggatccatggattacagacacaagaggttaaaaaccaaatcacagacatgtgattagttagcaaatactgactgcacttaggcagttagcattgtctctatcactacgagacatgccttcctgaaccgatgccggtccggtctggtcttgataactatgcccgtaatgnnnnnnnnnnnnnnnnnnnnnnnnnnnnnnnnnnnnnnnnnnnnnntactaatncgcc

SEQ ID NO: 231 - DNA, 4083 bp, Oryza sativa
  unsure (1)..(4083): unsure at all n locations
ccccgtcccntttgatgcacnnnnnnnnnnnnnnnnnnnnnnnnnnnnnnnnnnnnctactacccctccacagccattttcatctctacctcttgataatgttgtttccaactttagatctttaggagttactttgggtaactctaattttcctatttctttctcgcttaatgccttgaaacatattgaggtagatagatctaaagtaggaaccaaatctaatgaaaataaccagaccaatacttttgtgtcggagatggatccttttatgtcaagtgatgacgagggcgacgatattgatggtgccctacccgatcacttagtaaaggatatttcagagattgatatggaggatgtggaccaaagtaacaaaatttgtgacttattggtttccactagaaaatctaaatcatcttcaaaaagaaaagagcgaaagactcgtcccaaaaatccaaaaaaacaccaaaatggtttcgtcatgataggtatcttttggaattgcagaggtctttcagatttgactaaatttcggtatgtggcagatatacttagagaaaaaaaagctcgactttgttgcgttgcttgatacaagaaaggacgaaatgtcaaagacaaattcagatcgcctcactggaggtgctgattttgtctggcattgccttccaccaaaaggaagataaggagggtatacttcttggtattaatgtggctatcttggatctatctttaattgtcgaagggggtttttttattaaatttcatatcaacaatagggaggataattttaaatgtattttgatggcagtgtatggtccggcccaagatggatttaaatctagtttcttggcggaatcaatttgtacatgccaacaaaatcatctacccactttaatagggggatttcaacattatgagaagtagtgccaagaaaacaatgatcgatacaaatgctcgttggccttttctcttcaatgctgtgattgatatctttgacttaacaaaaatcactataacgggcaggcaattcacttgggcaaactcacttcctataccgacatacgagaagctagaaaggatcctcacttccatagaaatgggaatccatataccctctggtttcggtccatgctctagatatagaggggtgtcatatcacatgcctatgttccttgacacagaggaagcggctttcgctggaaaccttaagcagttcaagatggaactcagctgatttttgtgggacgattttcatgaatgtgttgtcgaagtttggaatagactagtcaagggtcgtaatgtaattcaaagatagaataacaagatgagcgctttacgtcgatttcttagaggttggtctgctcataccaatggcatttttaaacagaaaaaagctcattttcaacaaaccactgactctctggacatcgctgcagaggctagactcctttgggatctagacttcttcttgatcaatcgagggatcatctcacaagcctacttcatgaagaggagattaaatggtaccaacgcgcaaaagtctcggatgtactcttttgagacaataatacaaaatattttaacccaaattgccaatggcaaacataggaagaagaggatcttctttctacaccaggatgaaggaaaaatagggggctgatgcgttgaaaacatacattacgaatttctacaagagactctttggactaccaaagaaaatccgttttcgcttgatgagaccataactgaagatatggctcaggttacacaagtagaaaataacttccttactgcccttttctcagaggaagaattaaaggaagcgatctttgcaatggagcataacaaagctcctgggtcagatggtttccctgttgaattttaccaaaaatttttgggaagtcatcaagcatgatttgcttaatttatttaatgaattctattctggcggtcttccaagttttggtttaaattttggggtgattactctaattctgaaagttgaagaagcaaatcgaatctaacaatataaaccaatatgcttgttgaatgccaattataaattattcactaaggtcgccataaaccgaattagttcggtgggtgaccatgtagtgaatccaactcaaattgccttcatgcgtgggtgaaatatcctagatggagtcatcatcatacatgaaacagttcatgagctacacaagaaaatgttgaatggggtgatattcaaaattggctttgaaaaggcctacgacaaggtcaaatggccctttttgttacaaactctacggatgaaaggtttcttgcccaagtggatttcttggatcgaatatttcatttccgggggaagtgtggcagtcaaagtcaataatgacgtggggccttttttcagactaaaaaaggcctacggcaaggagaccctctctctccaatcttattcaactttattgctgacatgttagccacccttgaaaaatagggccaaaacacaagggcagtagaaggtctcataccacattgattgatgggggactgtccatactacaatatgccgatgacataatgctttttatgaatcatgacctacataaagctcaaaatatgaagtcggtgttgctgacctttgaacacctatcaggtttgaagatcaacttttataaaagcgaactatattgttttggctaagcgcttgattacagatatcaatataatcaactctttggttgctaggttggcaatttccctttccaatatcttggcatcccgatccattacaggaagttaagaaatgcagaatggaaagaagtggttgaaagatttgaaaacaaattgagtagctggaaaggaaaacttgtctcgttgggagggtgacttgcgctgattaactcagttcttagcagtctcccaatgtatatgatgtcttttcttgcaatacctagcggggtacgtaagaaacttgactaccttcgatctatgttctattggaaaggggatggacataagaagaaataccagcttgctaaatgggacatcatctgtccacccaaagatcaaagggggcttggaatacgcgacctagaggtaaagaatgtagcgttgcttagcaaaaggctatacaaattactcaccacatatggaatgtggcaacagatgctacgtaataaatatttgggatcgcaacctttatctcaggctttttgaatgcgggagactcatatttttgggccaaccttatgaaagctaaactagattttcttaggttcgagtcctttcgtattagggacggctcttaaataaggttttgggatgataaagggttgggtaatacctcattgagagatcaatatccttgtctctataacatagctaagcataaacagtcgactatgtcacaaatctttcaaaacaatcctccgagcttttcatggagacgagatttaatcggagcaaaattagccacttgtcacaatttatggcctcgcatagctgatttggtgttgacacaggatcaagatgaatttcgatgggatctcacccccaatggagtcttttaagtcaattctcattgcttagctcttgtccatacaggcatcacgaatataaatagacgtatttggaaggttaaagtaccgctcaaagtaaagattttcctttggtacttacgtcagggcgtaattctaaccaagaataatctagctaagcgaaagtggaaaggtcatacgaaatgttgcttttgtcacaaggacgaaaccatacaacatttgttcttccaatgtcatattactcgtttggtttggtccgttattcatatggcttataacttaaaacctcctcaaaatgttaatcatatgtttgggcgttggcttacatgtgttcctaaagacatgagaaatctacttttgatgggtgcaacaactctttgttggtccatttggctaaccagagacgaggtaatttttgacaacaagatggtgtcttctcctttgcaggttattgctttagtcacctggtagctacgcacctggcctatcctccacaatagggtcttcaggatactattatggtggtattgtgtcgtttggaaca

SEQ ID NO: 232 - DNA, 4695 bp, Oryza sativa
  unsure (1)..(4695): unsure at all n locations
agagtttgattgacattgtannnnnnnnnnnnnnnnnnnnnnnnnnnnnnnnnnnnnnnnnagattcaaattgcaaaacaagtgttaatacaatctcagattttagaacaaggatacaaatttgtaccatgttcaacaacaaaagaactagcaatattagctactaaaaatatatgaaactaaaaatatatgaaaatattccatctataatgaagattttttaaacagactaatgctacacttgcattcctactagaacataacgtttctctgttacagtgccgtgcaacacctatagagagaataagcattaagaaacatagtagagaaaagagcatgattacatcatgtcttgatatatctatcaatacctacgttcctcttttttcttttttcttttttctttctttcttcctagcgtaccacacaaaatactacgtcgtcgtcagatgaaaacggagagcaatggcggcgactgctcggtggtggcagcgccggcgagcaatggaggccggcggagacacaagctggtgccgaagctgcagttgtcttcaggccaccacttcgtggtcttggatgaggagctcgttgacttctacctccgcggcgagatcgagcaacgtaggccgtccaggcacccacggacttcatcaacgaggttgacattattagtttcgatccagtcaaattgatcggtaaccaatcttttttaattatttcactttattaacagtgtaaaacaattgatcaaccattgaatacatatatgataattaattaaccatggtgatataagtgcatgcacaacacatgcatgaataattacttgtagagaaatacaagggttacggagagaatatatggtacttcttcacggtgaggaagccgtcgaagacgaagaagcaggacaagccaaacaaatgaatgatgcaatatctaactgaaaccatgacaatcacatgctaattaattagaacgctgaacatattttcccaattaaaattgttacattgttaattctaaaaaatggtaaaacacactatggtacacacatgtgcaaacgtgtgattaaaagtcaaaacaaatggtactcgtttttcaatagtacaactcaaatatacatttcagagatagtagaatctaagcagatagttttccaagaaatcttttactataagagaataaatttcagatcacgaaaggaagcataggcaaaatgatctttagcatgtctgaatacgataaattgaaattaaggatgtcaatcatgctataaaagttaagtttcaatagataaatggatctaataagagaagagcttattgtttctgaatttctgtgtgatatgcataattctgttgtaaactagtgcacatatgaaacaccaagaattgctttagaggggtgaatatgaaattcaagatttgccattgaaagtactcatcaaaagtgtttctcaaaattgatttctcaaaattgttattagaaaaccagacctaggaaagaggtgagaagaaaaaccaaaactaggggagaggtgagagagagaaagaaaaaaccgttatcgaaaaatccaaatcgcaaaaacaaaagcggaatttaacttgtggaatttaaatagagaggcaaaaatgaaacgaaattcatcaactcattttattcataggtgttgcaaaacaaccgctcaatgaggagcaaacacgcaccttaacataaatttaaattcaaacacaaaagccactcgggcaaacacactccaaacccacacctaaactctattatagagcatctccaaagattacaaaaatgacacccccacccttgcatccacctctctatttatagttgaaacccccctaagacattgtcacaaatgcccttagggctaatccctagcctaaactccatctcagccactcgcttttccttctcctcaaaggaatagctccggatgattgccacatcatcgatccattttttttctcgctgaaacggatgtatcaatccatgtcctcaccgtcttgccgaatcagaagcttccacgcatcctgcccgagccgctcccgcactcatgattgagggcccgtttggtaaggctccaaactccaacttcaatgggagctggagccagctgaaaagtgtttggctagctttgtcagctccagaactcctaaaagagaggataggagggaggttgacaataatacccttgtggtttttgttgttttcatggtatataagtgataattgtatattttttctttagaatttcttcaaaattacaaggttaaataataattgacaaaatagttgacataattagcaaataatacaaatttttagtacattaataatataaatctcttgggaatggtaggcacataatctggattcctatcaaacctatgaaaatgcatatctggtgcatcatggtcacaaatgaaatgatgcaatgccattgttgccgccacaaccatcttttgctttggtagcggaaagctaggcatatttaggagaactcgccacttcatcttccatacaccaaagcatcactcaataatagtgcgcaaactcgagtgtaagaagttgaatttttcttctcaccagttggtgttgaacctctccaaaattcagggacatgatatctttgtcccttgtatggtgccaagtaccctggacgattgggatatccaacatcgacaagataatatttccctacgattaaaaaaattagaaatatacaaacattagaaatattccaatttagaatctcttcatagaaaaatagacaagacataatatgtggcaattaccttggggaggatgtgggaagatagctatatcggtttccagtgcattaaataacacagtggtgtcatgcatcgatccaggttgtccaatagatgcataggtaaatctcatgtcatgatcacaattagccataacattttgagtggtcaatttagacctaccaatatacctaaccttatcttcatctagaactactgcaaggatatgagtaccgtcaccagctccaatacaatctttgaaatgtggccacatgcgatgatccctcctaattctatcatgggtagtagggaagtttggatcttttgggcgcacgatatcacgccccaattctaccacagcaagcaatacttcttcaaacttcctagaaattgtctcaccataatgcttgaaatggctttgtgctctttggtttgatgagccatcaccaagtatgtatagaaaaattgcaagtgcctccattgtatgcatatgtatagtagattcaagcttgtaaccaaaagaccatgtaatacaatgaaggtgttcccattcatacgaagcatcttatagcattcacctcatgtggctaacgtttcttgcacccattccatcccactgaggcgtgatgtccttggcggagccttttccaagtagagtgtgttataactctctacagcttttctagtcgaagaaagattggatgctacagtttcgaacaaatgcatggtaaactcatcataatcatattgctcattcgatgaaccatcttcactatcacttgacatgtacacataaaggtatgcaccataaattacaacttatgcaagatgatattcatgaaaacttgctgaaattgcataccaaaggtatgaaattgcataacatagttctaaaaaggcataacataagtctgaacatacgcatacaattacatgaaataggtctgaaaataattgttcacaattggaaacaccccatacaataaggtgatacaaaccaacaatagttcatacctgaaatcaagccatagatagttttctgaaatgagaaaaaatacaattaaatcaaagggatagattccatggcaacgccacatgcaactagtttccatacttcacttcgtacttcttcttaagccatgaaaaatgtcctacaggagtgcgcaatgaattgacaaacatcactctttgatccttttatttataaaaatctcagttgcaatgaggtgctcatttgtcccttcaacgagcccacaatcctcctcaaaggccataacatcctttatggaacaacccagaagatcctcgctcgacctagcaaatgattgaatggatgataatgtctgtgctgagagttcattactcttgaacatctcctgtaccatcttttgggatccactcttgctcttttccccttatccatctttgatccaccaccatccctctttatcttggcagttgattcatcctcatcagtttcctcatcaatttcattatcatcggcaatatgaattgcatgagtggtgtttgtcggaatggtgccttgtcctaaagaccaatggtcagcaccagtattgcgaatgtcttcaaacatcttctcaagtagctcttcattttgctagctagccttcatgaactttgcacacccgggtttgtcctgcataacatggcattataaaattgagttagaacataaaacctagtagaacaattcttaattttacacattattataaaatacttaccgatttcaatttcctccaacgttctgcagtcgccatcactgtttgccttgtgttgtcccatcctagtcctgtttgagttctcaatttcttccaatagctnnnnnnnnnnnnnnnnnnnnnnnnnnnnnnnnnnnnnnnnnnnnnnnnnatnnaacagcgcc

SEQ ID NO: 233 - DNA, 722 bp, Oryza sativa
  unsure (1)..(722): unsure at all n locations
cgggncngttggnnttgaganattgtataacnnnnnnnnnnnnnnnnnnnnnnnnnnnnnnnnnnnnnnnnnnagacagatctggtttgttttttttttttaatcttgaatcttgacgagctactaaaagattaacttggcttgcctggctcggcgagccaatgtgagctatattgctagtgttttttttaaagggaaaattacaaaaaccaccccaaatatcactctgagtttaagatgcctccccataagaagatttgttgcaaatccccacctcctaattcatcttgatttgatttaggcacattctctccacatatgcgtgattcccgattcatcggcggcaattcgggatttcaggatgacgaagcgacacggctcggcctcgatctccgcctcttcggtctcgcaagtcgcagtcgcgggcagacgaagcgacgcgcaatcgcgcacgcgcctttgccgctgatcggggattgcatcatcgcacgcgattgaacttctggtgggctgccgctgggcttggaaaaaaaaaggggggtggtaagtgatggggccccctctggccttggccctangcggtcgcacaaccgggctatgccctgcgccgggcctgttcccgaagaatttgtagcgaaatcaactgagtgccactaggcgggagcaagagataatgttggttgttctggataaatgaccatttaattgtgttatcatggaan

SEQ ID NO: 234 - DNA, 5173 bp, Oryza sativa
  unsure (1)..(5173): unsure at all n locations
tgggcnnattgaanatctaatttttgtataacnnnnnnnnnnnnnnnnnnnnnnnnnnnnnnnnnnnnnnnnnaggagacatgcatgtgtgctgtgatcaaggttatcattatcccgattcgtatcctagtatcttacgatactacgatcctactaagccgaaacggtaccgatcccatctagtatcctaatttttatagtatatcgatcctactattcattactacacgatcctacgaaatcttaggtgatatcccgattctacgatccctatgatgctacaaaatattatttaaaataacatggtttgaaaataatgttactaaatatgctcaaatttatatgaaaatcagttaaatatataaaaaccaaagtggtttctcttgataaatatctctgtttgcatgacatatatcattactgtatttttttatatggaatggctatatataataaatataaatattaattaaacttaaaaaagaaaatcttgtagtatcccgatactctgatacgatcctacgatacgatattactttgagcaaaacgataccacctagtatcccgatccccgatcttgataaccttggctgtgattggttggcagaggccaagccaaccatccatctgtgatcatgggctaggccaggatgccacatggctgtaccggattggcccagtccaagatggagcaggccgtcatggtccaagtgacggcggcccggctccgtctccgcgtgcgtgggaaagcaacggagacacgtaggatccgtacggtgcgggacccacaggcgacgtggtgcgcatcgactgggagacagacgcgtggcgacgcggcttcgatacggaggagaggcgcgcgcgtggagcggcggcttcactcgctgtcaagcgggccggccggagcacgggcgcccctggcgacgtggcgacgccgggttcgagccgtatgatgcgggacccacggcgcggagagtgtcaggcaagtgctacggtggacgtgactatcacttctaaatttatttatttggcaaaattttatacagaaaattcaaaaatatgcaattagctatgggacaccgtaaaaacgcgtatttgctgtaggacatcataaaaaactggttattagctcctggacatccgctgcattattttattatttttagaggaatatgagagagaaacggctgtgtaagtacggttctacccttcgaattaatttttctttattcttccttattcttctctctctcattctttctctctttctctctcagctatttcttcaagtgagcctgagggagagggagagcgctggtgatggcgtgggccggtgtagcgcctcggctggggcggcgctgcgcggtcatgcgggaggtggtgcctgagctagagggcaggttgtgccggcgcagttgggcggcatcggcgcgcaggcaagggcggccgggctcggcggcgcgaccacgccaggagcgcggctgctccaggccaacttcaggaggctggaccggatggcaccggcgccggcgcggcaaggctcaagccgtcgctgcgggcgctcttctcatgcgggatcttcagcacctgaacacacccagcactcagcccgacggcgacgcccaacaacaatgtcgtagcagggatgagtgggtctaagggcggatcgagcatgccattgggttggttgtggaggcggcggcaccggcggtggagacggcgtcttcgctggttgtggaagcggcggcggaggtgacagcggatgcagcatcgggcggcggtggcggcttcgatgatggtcgacgagcccgacagctgcggtgacngaggcagcggcgagcagtgctgggaaagcggcggcggtgataagttcgatgacgatcagcgagccggcggctgcggcttttacggtgacngtttgcgagccgtggctgggaagcggctgccaacaatggggattagatagggctaagggcaattttgtctttttgaaaattctctctcctctttttgataagaaatgataaaatattacctcaggtgtcctatagcaaattacacaaattttatggtgtccatcagcagcgacgtgattttacagtgtctcccagccaattacacaattttcggatgtcctagggcaaaatttgcctatttattttattcactcataaacttagaggcaacccatataatgtatcacctttagtacacataccaatacctttaatactttcacacttttcttgaaatttgtatggaggttacctcttgatttaggggtggctcatcatctctctcctcatttctctcctccaccttatcactcaatccaatatggcactcttagaggcaacatatggggcattatagtacttgccctcagaagccgtttagcacagctctaactcccaactccaacttacctagagccggagttgtgccaaacagtatagatccttagattttcagagtggagttagtagagttactcctaaaaattgaagtgggtggagttgggttttactactccacaactctactgcaccccaaaaagaccactatcctttatttttaacatatttacaacaaaatgccagtgaactaccctacctaacccacctcacccctcaggccctcatcccatactctccctgtttgctagcgatgcgcagcgactagggttggcggcgcgcttcttgcctggcgacgcgcggncggcgacgcacggcggcgcgcggatgtgtcacgcccgggaattctatccaaaattccaaacgcttacatgtgtgtgaaccctcgtccaggaatcaactgaggcacacaataacaaaattgataatagagtacaattattactctaattattaaacgaataaaatatcattacagaggtagatagttcctctcaatcaataaagatctaagcagcgaaaaaataagatacacggcgcagacgactccactccacaggcagcttgaccagggctacacctaatcctccacaccatcagcacactgtagaactcctcctctgatgaatgattgcaaggtgagtatatgacatacttagcaagccacgcagcaaatatgcaagtgcataggataacaaaggatggcatagtagggtttcatttgcataaacaacatttaataaacatttcagaatttaataaaatagttaagtagtaattaaacaatattaatccaacgctatacaacataccctgttggataggcccaaccattctgaacaaccatcccggctgcacagttctatctccaaaccaggaatataccattccaaaccaggagctaatcaaattattaccagttatagcatcttttattatgatgagaaatgtgaaactaatcatgaaagatattgttagacccgcccataaccgcgggcatgactattcgaatagttttactctgtccagagatgtaccactgtacccacaagacacagccccacaacatgtcaccatgcgcctcaataccaccacagtacctcagaaaggagctgtgacagtacccctcgcacaacacaatccaccacagcacaccgttcctggatcataatcacccccttataaacaaggcatggactccccagcgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccagtccttaattgtcatgtgcacgaccatcaaaaccatgtgctcacaacccaccattatcaagttttagttggcaaattaattaattaaccaatcacgattgaccatcgtgagctatcattaagccatcattaaataatagtgagtcataagtatcccagttatatggactagtgtttctaagcatggctaagcaattatgtctaacatctagttgaaccaatatatataaagctcaactagtcaaattataatatcccaaggtatcaaggaatcaagtaatcaataacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaagtcttcaaattcttctcctgcaaaaacggactctccagaaacgtcggaatctaaacagaaaagagcaaaatcaccaaaacagcacacaaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagagaattactgcgtcagcggctagggttcgcggtggacagggtgcacggcggcggctcacggaaacgaacggccgagatcgatccatccaaaacgaacgaccgagatccatcggtctacgaccggtctacaacggacggcaacgatgacgtcggcgatgacgtcatcatcggcggcggctcgggcgtgcatgctcgccggcgaacgacggcgcgacaacgcgaacggaggacaccaacacatagagggcgtcgtggcgaactcaccggtgaccaaaacagcggcagacggtgatcggacgacgtcggcgacgaggaagaagcggcggcgaccttcggcttgacgacgacggcgatgctccggcgatcgacagcgatagcagaggggcggacgaggttggcgacggcttggcgaacccgacggcggctttcccgagcgacgacgacgaccgaagcgacggcggcgcacggctggagcgacggcggcgacggcgacgctaggctgcacggggctagggctctacgggcgacgaaaggcgaaggcgagggtgccggcgggtagtgccgggcttgggggtcaatttatagcgtctaggaggcggcggcgaaggcccacggcgaccggcgatgcgaagggggtaccgagctcgaattcgcgctatagtaatcgtgtagtccaattcaacaggtcttcagcct

SEQ ID NO: 235 - DNA, 783 bp, Oryza sativa
  unsure (1)..(783): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatactttcgatcggcgactacgtcctccgatgagttcaaagctaagcagggcgaaacaaactctcaccaaaatgggaaggaccttacacgatcacacaagtcttgcggccaggcgcattcaaaatcgcagaaggcgacggtcgcgaattagcaaattcttggaacattgaccaactacgtaaattctatgtatgagtcaatatcatccgtacctgtaagacaccttacagtatcaataaagcctattcttaggcccatattacaatcaaactgttttcacccgatgatcccttaccctaatgacacctagcgttgaaacctatcctcatgtccctttacgccgtcttaacaaggcctccgaggaacctaagggatcttcggctggggacgcccagagccaataaggccttgtcagatcctatagagacgaaagaccatgtaagatctggtcgtgtaagagttctcgccgtgcgtattaaccaagctgcgaaatcggaaattaactttccaacttcacggctgggggctaggatcagagcttattcaaccaaggcaggtcaaagnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 236 - DNA, 3095 bp, Oryza sativa
  unsure (1)..(3095): unsure at all n locations
gcgcctttganatctnnnnnnnnnnnnnnnnnnnnnnnnnnnnnnnnnnnnnnnntcaagattcaagattaaaaaaaaaaaacaaaccagatctgtctcgttaccataacaaatctgatcgtgccgcgtgtcttacaaaagaatcgttatccccttctacagtcattcctacagtaaaaataatgcattcccaactcactttccaagtgcaagtgcgtgtaccattagttgggaatagatcgatgcatttttgtagctttgcatgactcacccctttcactcatcacactcatgtattttcactttgcaagctgccaagctattcaggggaccaaaacggccggtttgatcgacgagtcgatagctcccccgctggatgtatctaatccatttggtttggagtttggataagatcatgagaccccggccggccaccttcttctgctggtacttgcatatcctatacaccggggcttacaatctcaattggctaacggattttatcattttaaatcctgtccaaggcttcgattatcgttttaattaattcgaatggaattttgataaatttcaaataaacagttcgcgatgcacgtttggagccacggtttgagatgctcaaaatttattgaactgctctgcacctggataactgggtactagaattgggtagatgggtagacagagagacgagcacaaaagggatcataggtattcatacgaatacccaatgttttttaaaagtagctatccatctatgcaaaagaataataataattactcaattggttagtacatttaatgggcgttgggttcaatccccattcttcctgtgtctttttttttctgattattacttttcaatagatacatcctctttttcatatataacataaatatgtatcttaaaatattggaatataaatcttgaatacccacactttcaaaatcttacgttcgcccttgtgggtagatatttctacttcgccgtcacgctgcgagcacaaaggagagaggtctctggctgtctggctgtcttgtcgtgcgtacattcttgctaattgctattcaatccggcgggctgcaggatatcggtagctgcttgtgcaagagaaaacccgcgactcttgtgccgcagcacgcagttttgctgacctgccaaaaaaaaacaaattaccagtgtgaccctcttctccttatccaaccaaaaccttcttctatacaatcttattttcatttctagatggatgtgaatgtgcaaccactgaaagatcgatcaacgtcaaaatacatatagtccgtttatccgggattaaaagaaacatattactagaatttaaacaaaatattgctaagatggtgtttgaatctcctgaagatatcagattaagtgtttcacgcaaaacgaggtggtaataacgtgcgattaattgagttttaattattacaaacttagaaaacggattaatctgatattttaaaacaactttcatatagaaagttttcgcacaaaacacaccatttaatagtttgaaaaacgtgccataaaaatctttatcttcgtccaactcttgttggagaaacgaacgggacctaagtgagttctactactgtaatcacttcatgcttcctaagcttctatttattaagaaaaactatatgtatgagtttttttataatacttttaatagaaaaatagccgtgtgttccaacgggtgaagactattttaatcttattattgttatacgatttaactaggataaaattcgctatatgaattcgctaggatatatattttttagaaaattataagctgcaattagtagttcgactttcgtatcaagttagcatgcgagtttttttaaaaagaaatttcttatacgatttattttgtatttccaaaaatagataaatttaaaaaccgacccaaacaaaaattacgtaccaaagtaccggtaaaaaacatcttcaatttttataatagtagagagaaatcttctatttttcgttttgtaccctcgaatctctactattataaaaattaaagatgtttttactggtactttggtatgtcatcttgtttgagtcggtttttaaattcactcgcttttagaaatatagatcattgtttgagtcggttttaagttcattcgcttttggaaataaaaaagagtcgtataggaaatctctttaaaaaaaaacttgcatgctgattacttgagacgatcaaactcttaattgcaactcatgattttataaaagaaacaaattcaagcggattcttatagtgaatttcacattaactaaaccgtataataataagatgattaaaataatttttctattataacgcacggatattttttctaatattattagaattagatcatgcatcatctatttagaacaaaaatgaactcgtcagttgcgcgaaaattggtcctcatgtcgacatgtccctagcgccaaactacctaccctgtagaaacttcctaccaacatgaaaatcgccccctagaaaatcataaatttcaactcatacttatcccaaagatattccgcaactgaagggcaaaaccgtcaagcagcaatgttcgaaagcatcaccgaagctagcttactcctgccgccagcccgccatcagctaagcatccatccatgttctatatagaaagctctccggcttgctcaatcatcagcaattcagcattagcaatacacagtgtcagattgtcaccatatatagtagccatcaattgaaaccacataagagatcagagagttaattaatccggcagccatggagaacgtcaccggaggaggaggaggaggatcgccgcggcgggtggtggtggcggaggacgagagcgaggagagcatgcacgcgctgtcgtggtgcctctccaacgtggtctccgccgccgtcaagtacccccaggggcgagccacgaaccgcgaaaaggtcgtgtacatgccgtctgtgcatacgctctactcccccgacgagcattgcagaagtctacgttctaatcagagagggcgaagaccgccaggacctttacatatcccacccgtttccccttggaagctgccn

SEQ ID NO: 237 - DNA, 1419 bp, Oryza sativa
  unsure (1)..(1419): unsure at all n locations
gcggnattgtatttgactnnnnnnnnnnnnnnnnnnnnnnnnnnnnnnnnnnnnnnnnnngtatgtatatagtggccttggtgcagagtttgtgtatgtgtagtagtacatgttttccttgtagtaacaagtaacaacattattgcactctctaatgtatatatgcaaatgctaggcttgcttcagttactgtgcaacatcagagcattactatctaagattgactcggttattctagttccccaaatcgctcacgttgaaaaagaaaagattgggctccatttcctaacaatgcccataggaacaaagaaattccacaaggaacccagctacattcctagacccaaatatgacaccattcctattttagccccaagaatgtgaaatgtaatcctacaagctacaagcgagcgtcttcacataagatatacagtacaatcctacaagctacaagtttatacaccagcagaagctttgggatccatctagttgaatctgttcttaaaggctaatcagcaaccagagtgaatgacaaatcacatccaaggtaactacacgggtggattggggatgataattcaaataagcatgtaaatccacgaataccatacactcagaaagacaaaaaagataacacattctgacgaatcacgagctgtaagcagtcaagaagcacttccagtcatccaggcatcacaacaaaatattgagatgtgctaatgcaaacaagacaaccttaaaaatggataaccaattcttatagaagataatatttcaggtgcaatccaacagcatggaactgggttgcacagagccaaactacgcatgataaaacttaagtaccatagtaatctcctttgcccttacagaacagtgaaataggttcaaaactgtagatccagagatacaagaaacattcataaccaaaaggctcctccaccttactcctcggattcagcctcaccactcttcttgttgtgcttcctcgagtacctctggttcctgaggaactttgggtccatctataaaagcaatttacaaagaacccaggtaagaacgcggaaacaaggcaacaggattcaatttcaacataacagcgaggacatttgaattgatttccgaaaacaaaataaatcctaagaacaaaataggatgcaagaataagcaacaaaatagattcctacacaccacaagactatatagacaaattcaaagtcgcttcgacttgtgattaaattgtttatactgtccagaaaagtatattgacatacacagacgattgcccaaactacctgagcactgggtccaatgaacgttggacttaatctttggctaataatcatcaaacggcagggctaaaaccaagcaaaatatccaattccacaaggctaagtgacacagcagtagaaagccattttg

SEQ ID NO: 238 - DNA, 735 bp, Oryza sativa
  unsure (1)..(735): unsure at all n locations
acctgtgcccggccggaagaatgannacgttggtggtggtgaagaagggggaaaccagcgggggggagttctttgnagctatggatgggggtgggnctgggccactgacgncgncggtgcggganccagtggcgtcggggaagncggcgaagaagaacgggnagncggtgncggtgncggtagtgaaggcgnaggtgncggtggcggcagtagcggcgnaagaaggtgctggtggggatgcggcaatggtagacggcgctacaaaggtggcaaaaaaggcggtgtcggcggcgaggcgggcaagggcatcagggcggagagggaaaaggccggcgatggcggcggtggcgtgggnattaggagcgcgcggcgggggagaaggcacggcggggggccgagctacaactcgagtctgtaccgggtgggggagtacgcgcggtgcatggcagcgatgaggcggtgccgaggggcgctgctggtgtgccagatgcagtgcgagggcccctgcttctacgactgcgacgccaactgcaaggcgcactaccacttctaatagcggcgccgctgccgacgtcatttgccggccgctcgggaatatatatatgtgccaccggctgcttgcatttgcttgctcattgtgtgtgtctagctagctcgattggctgcttaatttatcggtgagaaggggatcctctagagtcgacctgcaggcgtgcnttacatgggtcctaacgt

SEQ ID NO: 239 - DNA, 3942 bp, Oryza sativa
  unsure (1)..(3942): unsure at all n locations
ccgcgttggtgaccatctcattacggtgggcgaattcgagctcggtacccttttatttttgtataagattcccgcgtttcaaaggagaccaaataaaggtcgctttactcaaatcaaccttataaaattacattccaattttacataaccaggtggcaagcacaaagtaacagggtaaccaggtatacattgtgctggtaagcatacattaagctttcacccaaagaaatggtactactggcgaagtgagcatagcgtctatatttgtactgtttctaaaaaaaaaaaagtacaactccatttcataaactcatgtaggcttggatgtctactttttatagtggtgttcgggagggagagaaggttatgaacttctatctcacgcatgtaaaataggttggcttattagtgcattaacaattaaatattagctataaaaacttaaaatttagattaatatgatttctaaagcaacttttctattagatttttttttcgaaaaaaagtatttttgagtagtttggtaagcgggcacgtgaaaaaaaaatgagggagtataaattaggaacatgtaattaaaaacactctcaagcattgatggaaaccgtcaattgagagattttagcaagcagtcatctcgttatttgttttaaaattaaagagagcaaaatggacgtggcaggattgagcagataaaaaaaaatggatcacggcagtcagatttcaagaattacatattgaccatacatgattgcttttttgtgcaaattatatctgtattctatcgtaccaatatcaaatgataatgtgcacaattcctgttaccatgaactatacagttaattaggatcctacgttggaaaattaagtacagaaaaacatctaaagtgatccctccaaacattagtctgcaaatcagaaaaaagttgagttattcacaaataccaatttgaataagaaaaaacaacttttgaaactagcaaaggatgcaaccagaaagcatcaaaacgtgctattgcctaatgcaagtagacctcaacagagcatgtcatgtcgcagcaaattagctgattcatttgtgtaagaaaacctcacctggcattcatcacaaataatccagaaaacttcttgtttggaggagaaaaaaaaaaccactttggcatgacaaaatcttcccatcaagctttaaaaactgcctgcttttgagaagcgtcctatccaagacccaattctgtataaataaacatatgaacaagacaaagttgcgactagggatggatcccctcatttcatggccaatgatgccgctgacgcctcagctatcaacgagagaggctgacgagcttggaggcaggcgccgatgtcaaaagggtgaatctcagctccatcaaatataagattgactccaggtaagaccacatctttggtgtctgcatcatccggttctggttttgctacaggtgtggtgggttggtcctcagtgacagatcttgtggcagcttcatacacaggggcgagagcgtatgacctattagagttttaaatttagaatggaatgatccagtggcaaaattaacattacaagaatcatattaacctatacatcacaagaacaatgtattgagttgcatactgatacacctgccagttcaacccaaaagtttaaaccgatgaggaaggacggttaattcactttaccgctacactatgcggtgcagttctttttatgtatagaacatacctgaggatgctcccgtcgaagcttagaacttcagtgaagcatttctgccgtcttgcaactttcagtctgtcattctcacggggggatcctccagtggttggcgccactgtgtcatgaaatggactccatctgccactgacaatgttgattagttggcgcggcgagttctttgaactgcccctttgattgaatagccttgctgttggaccagttgcttggtactcagcacaaagttctctcagcctctttctcacattctgcattgcctcgtaatgttcagtgaggtcatctttttgaagcatgtgtgactcgatgaccctttcgcatattttttcacataactttggattgaacagtggaattccaaattccaggctcaaaggtatccactcataattttcatcctttgagaaaatttcattggatttgcttatcctgtgaagcctaactaaactaagataaccaactgtgcccaactcgactctactggacagattatataatagcgaagacaaatttaatattttctcctcaggtaaatccatgctggctactgtggatgcaattgacccatcagcatttttcaggggtaacgggacatcaacggtgacaaggtttccagtttcatcaagatcatttaagctcaatggctgcactataacagcagaatgctttgtcattgagttcaggtaatgcagcagaaggcttccctttactaaattcccttcgaactttcctcctaatccacccaccacagattgatcccaagaccatatcaacgccttttcgcagctggctaatggttcaggcagcatcctcaaacggtgtcctttcataaacacagcagatactgggccacaactcccagatgtatacagtgcaagcttcatccaaggtgtcatggaagagtaagaaggtggaccaaaatgtactaggccggcagtgctgggtagaagtactgatgaatatggaagaggaatcatagacaccataatgtcatagtccctgacaagtaatctttcaagtgttgttgcggacagtgaagccaagctctcgcagcgaagaatattgatccggtaacttcttttagttttcgacaaggaactactgtcagttgatccatctggtagaggggttttgctcgtatcagaatcatttttgtctgtgctttccttactttcagagacaatacttgagggtgatgatgtactcgcatctgcaacatctgagtcaaccattgggtggtctgcttgtgacagttcattatgatgatcagtatctgcagtgtcgacggtttcaagtgaacctccattactcttaacaacattactaatgccctcatcaatgctttccttggataaagttttggagaaattctcctgcaggcagaattcctggctgttcggttcaatagcttcatctggtgatgtccctccagacagcaaacactcaaggaagcatctgaggctaaaagcatgatttgcaaattcctggagcacaccttcaaacctctttccttctaaactagcaaggtccttgcatagatcagcaatgcaagaatcaccaagctttccggcctcgtatagtgtcacagcatgagacttcagacctgtgatacgtatgtgagaaaattattaccaatcaatgacattgaacagttccctgcctagaagtagaaaattagtaacaaatggaatataacctggagataatgaacccatcatcaagtacgaagttacattggcatcaacaatgaaacccacataagaagccccagatattctcctgggtccatcggaatcactggtgagcaatgcatgacctgacctttctgagttgatactcgtaagtgaaccttcgtcatcatcactaagaatattactaggtattgtagatccatttgaatctctaagaatggagtctgcatccataagctttacagcccaacccagtcgacaagcaaatgatgcagctgcctgaagctgatacaggtcagcctgcaacgttttagccaattcagcaactgtagcattttcacttgatacaacaaatacagcatatagtagtctgcaaacaagaaaggcgtaaaatcattttaatagctacagatgattcttgcaatgcactatagtttaatagggaatggagnnnnnnnnnnnnnnnnnnnnnnnnnnnnnnnnnnnngtacgcaaacaaacgcg

SEQ ID NO: 240 - DNA, 2179 bp, Oryza sativa
  unsure (1)..(2179): unsure at all n locations
aaccaatgggctttagggagaattgagctgtgttgtagtttcgtgtctacagaataataccctcaatatacacacactgttagtgcctctaaggatgttataggtttctaactgatattgtacttatcagcagtttaccgttacaagcttgaagcaactgtgccattgaattataggccaatcctccaacaattttatgctaaaccataataatagaaatcatacataagtatgtaatgacatagatttctccgaacccatacctctgaaacggtcctcaggataaacagccacatcgaagtataccattcctctcttgtaaagaccatttataaccttcggatcaaatagaacataggaattatcttcgtcctttgatattttatctattgctgatgcctctgcttctgaaagcctctacagtaaagtaatattatcaattaccaaaaaagaacaaggtacttttgaatcttagagagaaataagtttaactaacactgttgtatgccatcatggtaagaagagaaccacaaaaaaaaaaaactcgctatatcattctgttaaaagtacaatatccttgcacaaagaaaacttgtcactgatgaacctaaccttaaactcttccaatgtgaagttgacaaaccgaactccccaccatggttctattgctaggtccgcagggagtgctggcagcagctctttcgcaattgatttgctcagcttccacattatcttctgacataaacgagtggaacaaataaaaatataacagcgagaaactaggctagatatgttcattttctgaacatacgataagcacttgtgctgcattcaaatattacagtccattcctacatcacagtaataatgctaaaatattcccgtggattcactaattaaatcttgtaccctggcaagaatataagaaccaataatatcatagacgacagatcatgatatggaaggtaatgatacctttgatctacacttgttcataatatcgataaattcatttctcccaacacctgtgatcctcagggaatcagcagcactgaagtttggaatactgtcatatggttgctctgccagtattatcaacaatatacaaatataaagaggtgcgcacaaaacataagtctccatgatgaagataaacggattgtaaaattgttgtatagtaaccatatatcaataaatgcaatatataaactcaaaaggtaccacatattacaagctagaatcagaaacgtattgtgaagagaacaaaaggttcctccattttaaatggtataaactgaaacattttaatcaggaaagctttgtcagatgagttatcctctgaggactggaatcagagatatgagatggaaaatgaactagaacacatttatgagatggaggaactctattggcataagagatgtggtgaacaatggatccttgagggtgatagaaacagagttctttcacagggttgccaatggaagaaagaggagatgtactattacttccttatgggatggagacacagaactaacaactaagtcagaaatcaaagaccacattgtaggatactataaatccttatttagagctgaccctccttctaatattcatctttcccaagaggtttggagagataacttttgcttatcaaatgcagctagtgaacatctgatcagaccctttgagattgaggaattagacaaaataattagagaaaccaagctaaatacagcacctggcccagatggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 241 - DNA, 1487 bp, Oryza sativa
  unsure (1)..(1487): unsure at all n locations
tgttnnttttaaaattctnnnnnnnnnnnnnnnnnnnnnnnnnnnnnnnnnnnnnntctcccaacacctgtgatcctcagggaatcagcagcactgaagtttggaatactgtcatatggttgctctgccagtattatcaacaatatacaaatataaagaggtgcgcacaaaacataagtctccatgatgaagataaacggattgtaaaattgttgtatagtaaccatatatcaataaatgcaatatataaactcaaaaggtaccacatattacaagctagaatcagaaacgtattgtgaagagaacaaaaggttcctccattttaaatggtataaactgaaaccattttaatcaggaaagctttgtcagatgagttatcctctgaggactggaatcagagatatgagatggaaaatgaactagaacacatttatgagatggaggaactctattggcataagagatgtggtgaacaatggatccttgagggtgatagaaacagagttctttcacagggttgccaatggaagaaagaggagatgtactattacttccttatgggatggagacacagaactaacaactaagtcagaaatcaaagaccacattgtaggatactataaatccttatttagagctgaccctccttctaatattcatctttcccaagaggtttggagagataacttttgcttatcaaatgcagctagtgaacatctgatcagaccctttgagattgaggaattagacaaaataattagagaaaccaagctaaatacagcacctggcccagatggttttagtgtacctttttatagagctttttggccccaagtaagaaatgacctctatgagatgctgattttgcttcacaatgaagaactggaccttaagaggttgaactttggtgttatctctctgatcccaaagagtagcaatcccacatacattaagcagttcagacctatttgtgtgttgaatgattgtttcaaatttctcagcaaggcggtaaccaatagattgacagaggtggcaaatgatgtcattttccccacccagacagcctttatcccaggaaggtttatccttgaggggtgtgttattatccatgaggtgctgcatgagatgagaaccagaaatttagaggggattggtttgaaaattgactttgaaaaagcatatgacaaagtgaggtgggactttctcatagaggtgatggagaggaaaggcttccctactaaatggattagctggattaaaagctgtgtgatgggaggtagagtctgtggtaatatcaatggggagaggactgacttttttagaacttttagaggccttaagcagggagatcctctttctccccttctctttaatttagttagcgatgccctagctgtaatgtttgatagtgccaaaagggctggagttctcaaaggggtagttcctagtattttccctggggggatcacccatctccaatatggcga

SEQ ID NO: 242 - DNA, 1812 bp, Oryza sativa
  unsure (1)..(1812): unsure at all n locations
gagtttagaaaanagactaggtacttggggggctgnagacctatctcatgctggtagagctgtccagatcaatgctggcctttcttccataccctcatatgctatggggttctaccagctacaagagggtgtacatcagagatttgacaagataagaaatagatactactgggctggtaataaacttaaaggaaaataccatatggtcaagtgggaggatatggcttttccaaaggactttggaggtttggggtttactgaaaccagaaagatgaatattgccctcctggcaaaatggattattaatattgaatcagatgatcagagtttgtgtttagaggtgctcagaagaaaatatctgcaagagagaggtgtgtttcaatgtaagtctgattttggctcccaattctggagaggcttactcaatgttagaaagtggttgaacctgggggctgaatggaaaattggtaaggggtctcatgtctacttttggaaagacacctggttttgcaactgtcccttgagtgtgaggtacccagctgtgtttaggatttgtaatcaacaagaggtgatggtgtcccatgtagcccaaaggagactggagtgcttctcttttggaagatcctttggacctgaggaactgactgaatggggggaattaacaaaaaccattgatgatttagaggtgactgatgaggctgacagattgctttggggattagcaacaaccaagagatacacaacccaaatcgatgtatagaactctgacctttaggggcttgagggaggtgaattcagatatgtggaaaagtccatgccctacgaaaatcaaacattttctatggctagctcttagagataggattcagtcggctgaacaattgaaaaagaaaaaacgggagggatctgagtcatgtcaactctgtgggaatttagaatcaactaatcatattctctttaactgtgacatggctaggttaatgtggtgtatttgtagagatgttctgaactggaatgtaattcctcgctgtttcgatgatttcttccttttgtgcagtagtgacactaacccttcctccattagagtttgtatgagtatgcttgctgctgtttgctggaatttgtggctgactagaaataatatggttttcagagatagattgctttactccccactaaccctggctttccaaattgcttctaatcttttgcagtggaggaagctctgtcaacctgaggatgtgccgaagctggaagtaatggtggataggatcaagtcagttgcgtcaagtctgaaaccgcagaggacgggtgttggatagtttcctgatgtcttgagtccctttgataagtgatgttggctggctgctagaacagcagactttgatattcatactgataggctctttagctacggttctttctcccgctttttaatctgctagctgatggtctaagtagagttgtcacgatcttttgctagcccctgttggctcctgcttttctatgtcttgatgctacgatgtatgctggtgtccccagctggaacactgcctatgtggctttctataaaaagccgggtctatgaccttttctaaaaaataaataaataaataaactgaaaccattttaaatagtataaactttttagctgattaaaattcacaatcaagtagaaactgaaactatagccaagcttacgtagttgtcaaggtgaacagaaacatttttagtagtataagttatgagtgagaaatcannnnnnnnnnnnnnnnnnnnnnnnnnnnnnnnnnnnatggtgtaaacagtcgt

SEQ ID NO: 243 - DNA, 727 bp, Oryza sativa
  unsure (1)..(727): unsure at all n locations
agttgtcaaggtgaacagaaacatttttagtagtataagttatgagtgagaaatcaaaactactatttggatagatgaattttagatattgatgcagaaacagcggtgcatgttacatcacacatatggagctttgtttctggtagaatatatgtatctaaaattcaaaatgagtcaatgtggacattgcataacggcatgtcaatcagcaagtacgtgatgcaagtaggtggaatgttataatgagggtgtgtttagttcctgaaaaaagttggaagtttgaagaaagttgggagtttagaaaaaagttggaagtttatgtgtgtaggaaagtttttgatgtgatatgatgtgatggaaagttgggaataggcgggaaactaaacacggcctgagatgctttgctttctattaataagcagttaccattcttcatagcttcaaaaagcacatcacagtaatatttgaaaggtgatatcctcattactcgacagatgtggtctgcaagatggtacgggtataactacaaaaaattaataaaaagtagcagtcatgaaagctttctagaaaaagtagtcaagcctagtaataaaattactttctccgtttcacaatgtaagtcattatagcatttcccacattcatattgatgttaatgaatctagatagatatatatgtnnnnnnnnnnnnnnnnnnnnnnnnnnnnnnnctgcaaggggtataact

SEQ ID NO: 244 - DNA, 1927 bp, Oryza sativa
  unsure (1)..(1927): unsure at all n locations
ccgcgtttgtttgcgnactcactcactatgggcgaattcgagctcggtacccgatgtgggggttggtgaataggcttagcttctgttgctttgttaataaactggttaaatagagtacagctgacatgagtagccaatcaaaaggactaaaaagagcgtccaaccaaccctgaaatatcacaggtagcttcatatcattaactaatatgggttgctatctctaagactggcatatgcagcagtaccagatatgttgtttttctgtcatgaataggggaggccccgttccacgcatgacataggcagtgatattgcaattatatcacagtattaatgctacatggcgacgtgaacagttgatttcttcagaatgcaagtctaccagaaaacagataaaatttgagttacataagaggtaacattactgttgcattctgttgtgcaggcaaccgaccagccaaaacaagctttgggaaaaccagagcctgcagcaaaagaaaatggccccataacaagatgacatagagaacatcaactggccaaggtagtaaaatactggataagatgcaaccataaccatccggttataatgactgtgaagtcatacctctgttaacagtgtgtaagttgtagctaaagtaaaagccccacgcccaaaaggtaaagctgttgttctttgtgcaaagttccatagttgttgctgaaaatacaagaaataagttgggacaaggttactcataactgttgagatcacgataagaactgaattagtaccctgacaaaaaatggtttttaccagtattttgaatatataaatacttaagaaaactgaaatgacatatcataaagaaatgaaagatccacagagcggaaatgcacagcatatggaggaaggtcacagtgacaatgggagcatggtcttgtaattcgaatttaagcagaaacaataatataatgtgataataaatgtagttgttaggtgaaacgataatttactatatgtagtcagtaattgcaatcaaatagcatgaagagaacctgttgtagatcctgatcagacacactaggattattgggtgtctgtattgccacaggtcttgctgagcataagaggcgtctaacctagttaaaacaatatgatagaataagaagcaatatataaagaatattagaataaacactatcaagccaagttgacggacaatgacaatataaggttgaaaaagaccggtatatcttatgcaagctaagtgattgtcctgttgtggatgtgtcaaggatagatatgtatttaactccttgacaaaaacgacaggtcatttacagtcacggaattacagtggtcaatagctatgttcatgaaactatttgcacttgcacctacaactttatatatcaaaacttatttttttctacaactatcgtgggacatcagaaaactaccacaatagcacacgatttttgtcagaaactgtatctcataggcactgccgttagcaacaggacaatctgatacaacaagcttgcatgtcatacacaaatacaatgctcatgctgttacagtgtaccatacaccatgccatgcgcaagctggccctgtgtgtatgacagatggacctgacctgtcagatgtcccatgctaaacgaaatgttcttttatgataaaatcatgtgctactgttgtagttatcccaaatgcttggtaaagttgctgcaaatttatagtttggacaaaacagttgaagttttctgcaatttatcttaagtttcaatttcagtatagttgtaatatctccatgtgggctcagcaacttatatagaacttaaaggagtgaaagatatgcagctgtagggacaatnnnnnnnnnnnnnnnnnnnnnnnnnnnnnnnnnnngttcatcaagnanntcgaaactcaatggcgcgg

SEQ ID NO: 245 - DNA, 729 bp, Oryza sativa
  unsure (1)..(729): unsure at all n locations
cgcgttgatttgcagtgagtacnnnnnnnnnnnnnnnnnnnnnnnnnnnnnnnnnnntaggatggagtggcggagcgggcgggcggcaggtagagtggcggcggccggagcagctggcggagcacccccgccataaatcacacctcctccagcatcgggaggacttcctcggtgaggctggcgccaacggcttggccgtgcgccgcgacgtctgcgtcgtctgccggcgtggcgaggttccgctcgcgatgggagttgtggcggaggcaggaaggaggcgcggtggtctggacagccggactacaccaacacgcagccgacggcaaggaaggaggtgcggccgtcgatggggaatccggcggcggagcagcggagtgcgtggacagcgtgtcgatgacagtcatgtcgtcgtggtctgcgtcaggctgggcagcgccgagaggaagaagcggtgcgggtcggcgacgaggtgcgcgtactccaagtcgccctcggcgagcgccgggcatggagaggcgtgaccaccacggcgcgtcgcgcttgtccgcgtgcctgctctgcacgggctcggcgtaccatgactgcagctcgtagtccgcctgcacggccttgtcgctcgggtagtaggccgccacgtacgcctcgctccaccgcgagatcgccgaccagaggcagcccatcggcggcgtacgggtattcctcgatgagcagccggagcccgtgcggctt

SEQ ID NO: 246 - DNA, 1390 bp, Oryza sativa
  unsure (1)..(1390): unsure at all n locations
cgcgcgccttaatgatccatacannnnnnnnnnnnnnnnnnnnnnnnnnnnnnnnaatgcggtcaggttgcgatgtctatactcagaatcggatgtttggtttcatgtgtgtaggtaatcgaagtcaactttgatcaatggcgaggatcgggactatgctcaggaaggagcagaggtcttgcacggtccagaagctgtgacaaggtgggactgacgtcatgatttctgattgtcaacctgggtcgacggcagatcaggactaaactcagtgaggagttgagatccagaacgataaggaagtcgtgtgacaaggttgagatcaaggtgacacacggtggacaaacaccgtgtcgggaggttatcgcaacgggcttcgcaaaatcaactgcaagcgttgaaattcgcaaagaaattggaattaagacgtattttgtgtgcagcgtataatacatggcgtatggtcgatgtgtacgccatgtattcgcaaagaaaattggcaactaagcgtataatgtgctgcatgtatgtgtgtcaaggacaacgaacacatgcatggctcattggtgcagccaagactagggccggccacgaggcaatgcggacggtgtgatcgtaatgggtctctaaaaattagatgcctttaaaatatacatattatgatatcaggcctgagaggcttagaggaaagacagaagaccaatcggtgatcgagcatatcgtgactgcttgattgtattttaaacttattagtgtgaaattcattaatgataatagatttttaaaatattttcttgtatttttatggtgaatggggtcttttatttttttttaagcaatgctgcacgtactaaatttttcttactaactttttactaacaatcatttcaaccgtttgatttagtagatgcaagttacaaaaaatttacatgcacttatagcatgactcattagtgttagtaagaatttaataagaaaaagttagtacatatagccttttcttttttttttcttttcaaaaccgggccacagaaagtcaggccggccctgcccaagacatgtatgctctaagtacatgtgtgtacattagcttgagcagtgcatgcatgcacgagcaaacatgcatgtgtgctgtgatcaaggttatcattatcccgtttcgtatcgtagtatctaaaaatactacgatcttaataaccggaacgggcaccgatccccatttagtatcataatggggatcttctttngtngnccnncggcctgcgtgttttagatattaaacaaangcccactggggggggggaggggagngnnnnnnngaanacgcttaaaaatgaaanaaagagnnaaatgaaaataaagaagaaccaatttatgaaatcgacgtgaacct

SEQ ID NO: 247 - DNA, 5376 bp, Oryza sativa
  unsure (1)..(5376): unsure at all n locations
acgccttgatattgacnnccnccatnnnnnnnnnnnnnnnnnnnnnnnnnnnnnnnnnnnnttattggcaatcaagaagcaggctagagattatggttctaagcacaacttagtagatcaaacttaactgatgcagcactaagtatgaaaataaacataatatctagacaatcaagcctttgattgattttcagggtggtagataccttagctaatctaatctagtaaagtgatttaaccgataccggtataaaccctaaagcgagaatcagctgatatggttaaatcgagatactaagactagattaactaagataaatgataaataggtgcttacattgacaagattagagtgtcaaagccctagccccgccgatgcaaacagccatgacaagtataaattcgtcgaaaaagtataaaagtaaaacaggtggcgatcgccgaattgtaatgatcgtagagatagtttactgatgaccctaggtgtacatatttatacccgtggatagatactagtccttgttggacaagaaaaaaactttcctaaagacaaaaggaaaacataaaatcattatcgaacacttaaacacactttcctaaagacaaaaggaaactaacaaactcttcctaattaatagataacttgccatgccgcattctccttgaactcggtcacatctggataagcttcctttaatatattaattttcttaaccgaatcctccaagaatccgactgctggcgacttgataattcccatcggctgatttaaggactctgaagctgatattaattttaggccgatgacgtcttcggggcttaccaaatttcactgttaacaccggtacaattgcctaggccagcggaacgtaggacttaccccttcgctggagatcgaaagccgctgcagccccgcgtcaggtgccaagttccaccggatgataaataaaaacatcggtaaagagggtggcgatgcaccgggagtagttatattgatctgtaagatagtttacaatacccccgggtgtacatatttatactcatgagtagatgctagtcattgttggacaagaaagaaactttcctaaagataaaaggaaaacataaagtccttatcggacactaaacacactttcctaaagataaaaggaaactaacatactattcctaattaatagataaactgtcatgccgcatcctccttgaactcggtctcttctggataaactttctttagtagattaatttccttaaccgaatctactaagaatccgactattggcgactttataattcccatcggccgattccaaaagtctaaagccgatactaactctaagacaaatagatgactttggggcttaccaaatttcactgttaacaataccctagacattttttaaacactaaacaatgaataccatggtgtttggctgttattttttctagaatatttgttatgcaaatctgaagttacataagaatatatctttttcctgcattgggatttatcaacaacattactctcttcaaggtagataatttattcatagattgtgttttgtgatgtaccgttgagacttaacaattagaattatatgattatgttttatgatgaattgtttaccgttgagacttaagaattggatttatcagtttgaggggtttttgtattccgttaaattttcattaccatacccgcgccggttcgttttcgctccattttcggtttcaataatattgattccattttcgtatatggggtttctaattccgaaaaaattatgaaaacgaaaacaataaatgtggttttcgtccgttttcatccctagcttgagaaacgtgcgtatttatcccccattatgttccatgaaaaaaaaacacgtcttaaaggattaaatttgacaataaagaattttctttagaaagtatggctttgtatagttagagcaatcaaccaaatagtttataaaaagaactatatatcaaataagcgaagttcatcctggcacgcttagcctacattctgaacatgaccaaggtgctcttcctttacctctctttggcacctgagaacacaatgcattgtggtttgatttagagcattctcatatggtagaagacatatcatctatgtttgtttcatttgttgattttcctttgtttctttgtgagttggtttaagcagtaacatggtagtgtcacatgcaagatactttttgaaaccgacatgcaagatactctctcacacagactacttcctccgatacaagggattttggagggttgtgacatatcttataactacaaatctggacaattatcttttcaaaatcgcttatattgtgagatagttgtagtatttgcttgctatgcatgtcatccaaaatcctagtactccctccgtacatgtaaaggaaatcgttttggacagcgacacggtctctaaaacacaattttgacttcttgtttctataaaaatatttattgaaaagtgatatatgtatacttttatgaaagtatttttcaagacaaatctattcatataaattttatattttcaaactcaacaacttgagagttaatcatgatttatattcccaaggtttgacttaaacattgtcctaaacgacttcctttatgagtatggagggagtacagttcaaaggttaacactagtcatacccacattaaatacaacctattctaatattgaaccaaaactaaagccaacaaatcaaatgctaagcatcactttatattttccagattttggcccataaagcctttgcttgtcaaatgcagaaaaatccctagttgagcatcgtaagtcgaaatttcaaaattgcatttgctaaaactagtaacgatataaacctactaggaaccacattatctctgttcttagaacagcactaggtaaagagcatgcattataaacaaactgcacaatgagattttagtacttggttaaaaatatttttcatctcatctgtcaataaccaaacaaattctcaaattttttaccccttcggcgaaacccacaaaggaccaaaacctactgaacaaaaatcatatcttactagaaatgttcatataagagttaaattaagactgtgctccacccaaacataatatttacaaataattgcctggtctaggatccatttcactatcaaatatttacaacacgcaacagtatacaacatgtgaatgtaagacctgttaactcaaggatcacatgctgagaatccataaaaataaatgaaaaacacagtaagtcattagctaatcgcaaatgctacctgcagaagagtaggtaattccaactctggcgtagaagatggatgccgggaagggacatgaaaatagagcatctgaaaaattgcaatcaagccaaaagcagtaaaaatcaatttggcagtcaacaaagcagcacatccccattcaaagtgaccaaacagaaacaataccacaataaacctgattttttcgacaacctaaggaaacactgaatgactaaagtaattgtgccttcagaaggaaaataaaaaaaaaaaaacagcaggacaagcaggtggttttaacctcatcacttctaatagcagttctgagagaattaggagttatttatttggtttttttctgttaaaaaaatgtatttggttctgttgaaaaggggtttttgaagattatctgctatatatgtccaatgagcattggatgtagataaggagggaaaaccattgctggcagaggtcatgtatacaattcactatgcattcctataacagatggaatccactactttgaaaagaaaaaaagaacaatacataaatctgaaaggaagacttgtctaataaagaatcagtcaggaagtcaccatacatcttattagatggacaaagcttaccaatttgacagcaatatacttttgagacgtaataattgtacaggtacaatgcaaaaggaggattgcgtacctttgaaattgccgggtgcattgtccccctattagatgcagccaaaccaagtagcaaaccaagtctagttatatcatgctcctgcggtaaagtaataaaaaggttataccataccaataaacaaataatgacatcacaaccccattttctcctaccattttgagtacggaagtaatcaaaaggaggacaaagtgctgagtggtgactgaggtgcaaagtggtacagaacgatttagatataacaatgaatacttgaacacaaaattagtgaagccagttattttctttagtaatggaaccaaaggacaaaaggccacctgggagagatatcggtaagcgtcggtcatagttaaaactcgtagatgttcatgcaaaccaaatgcaagaagcagaccagcatgagtaaaatttggttcagaaggtctattatattgtatccaggttcttaacattttctcctgcaaatagaacatgactgttacacattcacaagtagaaggaaatacagagtaaaaggtggcaaagcatttgccaagagttgtgaactttgcagcttttgctactgctgggtaatatggtttatctgttttgtgatagtccagtttacttgaaaaggagcaagcctgagcccagcagcgacaccattgtgaaactcagcccaagatttgaattctgagacgcttctagtacttaggtcaagattaacctatataaaatagtgtaatagggtaaagaaagttacaaccaaggatctacgatgaaaagatgttgtaaaaattcaggggcagcgcagcgttcatgttatgaggtgagatagatcgaaggtggtagcagtggcaacatgatatttatcgcccttccctgctgtacatgggaagaaatgcagttggatgtgggggttggtgaataggcttagcttctgttgctttgttaataaactggttaaatagagtacagctgacatgagtagccaatcaaaaggactaaaaagagcgtccaaccaaccctgaaatatcacaggtagcttcatatcattaactaatatgggttgctatctctaagactggcatatgcagcagtaccagatatgttgtttttctgtcatgaataggggaggccccgttccacgcatgacataggcagtgatattgcaattatatcacagtattaatgctacatggcgacgtgaacagttgatttcttcagaatgcaagtctaccagaaaacagataaaatttgagttacataagaggtaacattactgttgcattctgttgtgcaggcaaccgaccagccaaaacaagctttgggaaaaccagagcctgcagcaaaagaaaatnnnnnnnnnnnnnnnnnnnnnnnnnnnnnnnnnnnnnnnngtcactcaacgcgg

SEQ ID NO: 248 - DNA, 3265 bp, Oryza sativa
  unsure (1)..(3265): unsure at all n locations
gctgatatgcataagcataagtgaaaagatcagaaaagctagttggcacgagcgcgccagcaacgctgctggcgcgcgtgccacctggcgacgctcccaccccatgtgaggcgttttttctgttttttttttcgatttttttctttttctttttctcttttttcagattttttttttaatttcagcacatgtgtgttaacgaccaaatttggtaattcaagtatcaaagatggaggtaaaaccaaagcagaatccaagatagagatcgttccggaaatagagcaagaatcggttaaagtccgaatcggctgcaaccagaatcagcagagtttgagtcggacaaggttagccgattgagccgattccgacaatgtgacttggtacatgttgtcgggttgagttaatgtgcttcatatggattgccacgcacatattaagtcctgaaaaggcaattgtatctattagttaggatattttatataatttccttatagataagtttgggcaaaagtctgccgcaaagacttatggtatcttagagtttgttagagataagagtcgtgtccgataaggacatattttgtatctcaggtataaatatgacccgaacccatgtaatcaaacaatacacgttcaatacaatctcggcgcatcgccaccattttactttcgtttactttcgacgagttcttgctttcgggttaagctgcatcggtttcgatcttcaactagaggtaaaacttgttatggcggcttgcgttctcgggattagtgcttccatctttatgatactttaatcttgtttatgtaattcgtcgagttatcatatatcttatataatctttgacaatattgttatttaaccttcaattggccaacatctattattggaaggtagccgattaggttaaatatcaatgttgacttagattatataggatatccaccaccctatgaaacattcaaaggcttgattatctagatattgcccttcttttcatacttatagctgcatcagttaggtttgatcttataagtcgtgattagaatctcaatctctagcctgctttttggttgccgattagggtagtatcggggtttcagccgatcttacctgatttaactcttttatatcttatatgcttttattgacatgttaaatctgccctttatgttaagatcttgtcgcatttaggtatattaagcttcctgtttgatatattttgcttactttaatatcttaatatagagtggtatcggagtattagatgatacatgctagatctatctgatcggcaatgctatgaatgcttataatctctttgttaatatatatttcgatccaagtgatttatactgtctcggcatggtgactgatctatcccaattacttgatttaagtatatatcgacagaagcattatataccattaatatctacagccgatcgaatagatttagttctttcttacctgtttatgactgccgatcgattcaaatatgacatcggctcaaagataaatgatatgtcattggcgactggccgatctgctatcgtttatagatttaaccgctattttcttgtctttgttccttgttgattgcagaatcaaatcaactggcacgctcacgaacctaaaggcaagatttttggacctgcactgaagttaagcagatcatccaggcctcgtgtttttcgcatcaacaatgtgttttcaaatattttgtgttaaatgtttttaaaccatgacatgaaaattttcaaattttaacttaaaatcaaatcttgagtagaaagttttcaaatccgagtagaaagttttcaaatcttgagttgaaagttttcaaagttgagttgaaagtttttcaaatttgagatgaaaagttgaaagttttgaaaatttgagttaaaaaaattaaattttgagttgaaagttttcaaatctgagtttaaaattttgaaactatgacttcatatgtagatttctttttaatttgttagttaaaaaatctcacaaaaaaataaaatcttatctactaccgtcattatcctaaactgttattatctaatagattagtataactactgaggccgaaaaaacgagcgccggcggcgcgtacacgccagctagcgatgccctgaaaagattgggactgtgcgatttgtcctagggtagggccccctgctggaatcctggaaaaacatcgatcttcttctggactactggggggtttacgtgagggaatctctccaaaaacctggaaaaacgcctagctctaagcaaggcctgaaattagtgatttaggtgtgtctgtgctctaaagttggtgcaaaggggtgctctaaggcctctcacagtgcggtgagctggaccagtgctacaccatgccagctgggattttcgcgtgcatggcagatggatgcgcggcctagctgagctcttcgcccccaagcagagccgcgcagaacctggtccaaacgaggcccataactcctagcgaaatcttcgattcgccctccaaaatcctctcccgccgcacctatttcctttttcccaccaccgaaacaccctaagcaagaactcccaagcaagaactcgatccatcccaagaacacaagaggaatcaccaagaagcaaaaaaaacaaagaaatctcgatccatcccaagaacacgaggaatccaggccccagatctcatattaaccaatgaacaacacatctcacatgcacaaaaacaacaatcaataaccggagttggagccaatccatcatcagatcaagccgccgcgccaaccgctcccgccggggacgtctcccgctgccaggccagccaccgccaccgcccgggccggcaaccgcggctgccggcgccgaagggaggagatccgacgctggccaccggggacgccgcccgcttccatccttctcccgcgcccacttcctcctcaccgtgccagtcgctcccgctggggacgtcttctgccgtcgggccagccaccgccaccgccaccgcgcgagtcggcaaccacggctgtcggcgccagagggaggagatccggcgccggccaccggggacgccgcccgcttacgcccttctcccgggcccgattgctactcgccgtgccagccaccaccgacgaggacgccttccggcggcgcgccagccaccgacgacggggacaccttctagccgcggctttccgtcggcgtctcatcgagggagaaggtggagtggcggagtagtactcgactcgaggatggagn

SEQ ID NO: 249 - DNA, 2772 bp, Oryza sativa
  unsure (1)..(2772): unsure at all n locations
agatgtccaggtaagactnggnanaacatgcatnnnnnnnnnnnnnnnnnnnnnnnnnnnnnnnnnnnntgttttatgcatttaaaaaaaaagactttcacaaacatagctagttgaaaattccctacaagttgaacaaaaacacacacgagtaacgcgcggtagaaaagataatagacaggcagcaacagtacactaccatacgagaagctaaaatcccggagcattgtcatagaacttcttctctacttgtcagcttataatggcgcatatactgccattggaggagtacgagtagtatcattattttcagactacggcctatttagttttcaaacaaaaactttttacccggtcgcatcaaatatttagacacatatatagagtattcaatatagaaaaaaattaattatacagattacatttaaattgcgaaacaaatcatttaagtctaattacatcatgatttaataatatggtacaacagtaaatattcgctaatgacaaattaattaggcttaataaatttgtttcacagttttcagatgaaatctataatttattttattattagtttacgtttaatacttcaaatgtgtatttatatattccatgtgacatgtaaaacaattttttttgcgaaccaaaaaggcccaggattctattgcagtgcagtaaagtaacgcgtggccggccacagggagggccatcctgccagtttgtggggtcttgaggtgttgtggaggcacatgaggaggtggccgatgataggtcaaaacctttttacccccacatgccactgtctgggaggtaatcacctcacctcacattgatcttgccaacttttacttttaactggccggattattattattcaactcctctgggtcacaggatcacggcgacctagctaaataatgtccttttgacacttgacagcaacactgcctcccaaatattcttaaaaaaatgagtaacttggtgaagttactagactattgtcacaaatttacttttgaagacaaatgtatacactgcatatggcatctaatataaatattttaaaatatattgctccaagtaatgtttaaagtagtaataattattttttaaaacacaaaacaaatataaatgctcacaacgtacacacacttactcctatgaatacatacatgtacatcctacatatatgaacaccgtcgaaatactagatcggtatgttttgagattgatgaagtcaccacggacatctcgttttcgacgaaatgacaaatatgttgcctatcactgaaagaataattagccgtgaatatgagtacatgtgtcgagtttagaacttaggtgggctagttccataataaggaacgaaagacatgatcatacctcatatcattttatgttttaatgatcgttatttcaatttgataatatcgcaaaatggaaataaaagggttttttttactgttgtgacttgtgacggtatacggtttgtaaccttaattagtacttattatgggttttttttctcaaatctaaacatcaacttattcgttttctgttatcatgcttttcaacctattaaaataatggtgcatttttgacaaaaagtctctatatatagaagtttaaaaaaatcaaataatccatttttaattttataatattaatacttaattaatctaataagttttctcgctttgtgtgtgctgaaaatatctctaccaactaagagaacgaatcggcctaagggttgatggtaatgccattgttatagaaacatatttaaatttgaattaattggctcatcgtcttttacttttcactaatagttatatatgtcatgaatttgtaatctaaatctatcgtggtttgcttctttttaaaagaatattatgattttcttgttattgtgcggtgttttcgaggttccatttcaacccttttttttttatattccggtagttgatgatattgtattcggttcctcttcaagttattacatttggctcaaaatataacaacgtaacctatgtttaaaatatagtaacgtattactaattgattggacacctataaattttgatatggcacgcctagattgttatatcatggaccgatgaagtacattcataaggagtcctctagcaaagacaacctatttctcttaaaagtcggaacttcctagacagcttttacatacgttcaatcttacaagtatgtacccactttcaattcttacaaattttgatatcttcaaggaaagaaaagtttaaatattcttcctacggccgttttcccctttccctggaaaaaaggatatgtttccggttacctgcgggagaagtaactgttaccacatgacacacccaaaaccccgggcaaaagtaaccccacacaaacacaaaagctgaaccctctcgcttcccttccctcccctattacatctcttttttgccttttccttttctttttttctcgaggggttaaaactttgccatccacaattgagactcggtgggacccagacccaggtgggcccaccctcgagtcctcttgtcatctcccccccccacacccccccttncctctaagtgcgtgccccccgccgcgtgtgccccccatccggtcctcctntnctttcggttcgctttccaaaaaaaaaagacgagagagagaaaaaaagttcttcacgaggaaatagttttaacgagacaagaggagaggagggagcttgaggaggaagtaggcggcggggaggtcttgagctgcggt

SEQ ID NO: 250 - DNA, 1937 bp, Oryza sativa
  unsure (1)..(1937): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccattcccttcccctgcatatccgctcgctctacggatgtataccgtacacgtatacgtgtacgtacgtatctacgcccgccaagtacgtacaattggggttggcgggcgtgcgctttcgtttcgtgaactggaaagcgcgggtgtacgcgtgctgcgtgtggccggctggctgctgcggagatcatgtgtggtctgtggcgtggtgaggtgttcgaccgcagatgcgattgcgagcgatgagatcatgtcgtctcttctctctctctctctctctctgtttttttttgggctgctttgtctgttctaccgaattttttgttgacgtgggtggtaagctcgaaggtctccggctgctgctgctggtgccgcaatttgcgtatgtgggtgtacacgacaatggcaatggtcgttgatactacagtactacttgctctctcgcctgatgtcattccatgtgtgccgtcagcccgtcactggttttgggcacgattaggctataaaatagtggaccgggaactagtttaagtgggggaaagcagcatggtgatgttgattctgttaacagctaactactccggggaggggtttctgacatgtttgtactgttgctcgatattattctaggatgccattgccaatttgctatagttcttaggggatcattgcatcgtagcaacttgtgtattttacatttacaccagctggttagtacttgcaaattaagaaggatggttttttgttttactttaacattaggagttgcggagattttttttttctaattcttgcaagggttttgtcctaattgttgtttgtagtccaaagttccattaaggcaagtggttgtgcagcatcacgctgcattatgaccacaaagtagatctggtgtgcttgatccattgaaacctgtactcatgagctatgtttctttgcaaccaagattggtatatattgtactttaattggttaggtgctataattaacgagaaaagagactgcacctattgatcagtgtagtcttcaaatgtattaatcaattcaatggttgatagagaagttctgtttgttacagaaagttgttaggaggggaacctgagtggtttgaaacctgagtagttgctggatgacagcgtttgaactaactttaacatatctatattgggatatattagagtttatgcatgtctatcatacaattctaacaggtaaagtctttatgagaccctggaccgtattttcaagttgcaaacaagttttatgtgctgataaatcatgaaatcttgatatagtattttctggttaggaaactcaagtgtatgaatgttgaactgttcttggttggataggaaaaggctaaaccaaattccatgggatgagcagggattttgattcaattttttgggcctaatctctcttgatcaaaatgagccctaagtattggtctaagaaaaacatccaaccaaatccatattctataatctatactatgcagtttttgttacatgtttttttttaaaaaaaaaaactgattttgtggcttgacaaaaaattcccagatttgacgctaagttgctcctggagaaactgaggaacaaacgactgatgtttgtgggggattcgctgaatcggaaccaatgggagtccatggtgtgccttgtccaatctgaggctccctgggagaagaaatcacttgtcaagaatgactctctaaatgtcttcggggatcctctagagtcgaccgcnnggcnggcnggcaggnngagggtcacaacgg

SEQ ID NO: 251 - DNA, 976 bp, Oryza sativa
  unsure (1)..(976): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaatagaaacaaaaatccacctaaccaatttctttctgctagcatctagtctgccatagatgcctttgaggctttgaccatgcttagctaaagagattaaatgtattgatatggaaatatgcatgatgacgaatctaataatatcactaaatttggtgactctaaatgtctatgtgaatattaaagtgaaagttttaaatatgtgcatgcctcctagggtgactacggaggagcattccagagtacgacattgacctggaaatgcattgtgcttatctgcacgctgaaggtaaaatgccctattgcgctcacatctttgctctttgaccactagaacaaatagcagcatataaaatatagaagccaatacgcagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 252 - DNA, 6037 bp, Oryza sativa
cgggcctttgatgatctttctcttgcctgcctgccgggcgactctagaggatccccatctccagggggatttcctataattctgagttctacacttttcactattccctccattctgagttctatatgtcgatttgactttgggtaaagtcaaactgctccaagtttgaccaagtttgtagaaaaaagtagtaacattttcaacacaagacaaatatattatgaaaatatattcaattattgatttaataaaactaatttggtgttgtaaatattattatatttgtctacaaacttagtcaaacttggagttgtttgactttgaccaaattcaaaacgatttataatctgaaatggagggagtatattggtagcttcccttgttgtaaacaactaatgttctttgtatggtactgtaaataggcattcaggcatctgtatgtaatagctacagaacctcgatggattcagacagtagatgttgacacaggacttccggtgtattgtcctcttgaagtgacagttgctgaaacggagtattatgacgagactaattactgtgaagtgacaccttgtcttctgccagagcgctcagtggtatgtggactctaacaacatttgtttgttgcaaaaaattatgctgaaaacgatataaagctttcagacaagtaaacacatctttaacatgtcagatgacactaaattacagcaaatttactgatctatctacaaattattttccaactgtgaacaagatagcattactattttcggtttaccattaacttataaacttatgaatagaagttaatggaaaaccaaaaaatagtaatgctatcttttaaagggcaaacatcaagtgcaaaacctattatgtgtgcacttgtgtggatgccctcaggatgcaaaaaagtctgaaattattggtgtcgctctgttagagaaatgacattaatgactgtgcagacttgatatcaaatatgatattgtttgggatacacaagaaaatccaaaagttatggtttacactgttcaacatcattccttttagatactccatctgccccaaaacaacttcatttttcacaatcttatttgtttcaaaataacttcatccttcaagcgatcattgcgttggagtttgtaaaagtagaggacaaaagcattaggactggataaagtggggagcaattgcatggggatttgataaagtggagggcattctagtctttttggttctatattggtatgtgaggatgggtaaaaagtgatgttattttgggacagaggtagtagatatttctctcacttagttcaaacacaatcagctttggtcatggaaatcaagatcatacagtatctcttctcttcatctataaatgtttttggaattttgggaattgtatggaaagttcatgcaggtttacacccagactgggtttctctccaatgaattgcacaatctgaaaaggctatttctgttgcagctgaagaacattcgagtttgtggacccagatattggtctcaggtgattacacttacacctgaaggtatgcaactcttctaaatatttcatgtttcttcagaaaacatatgtattcttatattttctctctttaatagataagccatggtggaaatctggagacaggactgacccattcaatggtggagtactctatataaaacggaaagttggatcttgttcctactcagatgatccaattggatgccaatctttgctttctcgagcaatgcatgaggttatattgttttcttgctcttctgacaaaagactatgtgtctaatatttctctattggcatgtagtttgactgttttgtatcaatctttaggtttgtgatacaccatccacgagctgcagtaatcaggcaaacagtgctactcgtagttcacttagagtcgatcagttagtaagcacattttctgctaatccaagcttgatagcttttgcaaaactgtgttgtcagtcatggaaggacaggcaagtgatatttttgatgttttctttgtttgattgttactttatatatgcagtaatcactacgacctatttggtgcatcagtgtctggcttgctttctaatgtttagttatcaatgtccaaatgcaggcgcaatggcagttttgaagagttctgctctcaaatactttatgaatgtatgagcaaggataggccagcactattgcaggtttcttactgaatttttgttcacattttgttaaatctccagtgcccatgaattatcatgtatttagtcatcattatctcttttccaggtgtatataagtttttacacaataattgagacaatgtgggagcatctaaagattggacattttcctttctctgattctcttttcctttccagcttgaaggttagtacttgcttttaagttctccagatctgcgatgttctctttgttactagtttgggttactcacagagcttctggaaagatggttccagcaaaattcctagtcccacctcaagaaattgactagtttctattttttctctttattatgctgtttctcttcttcttattgtactttgtcttttttaggattctgttttgccagcttctttgttgaagatatctttatctattagatcaattttcacatactttacctcgtttcgacaaaaaaaaattaaattgttctgtatcccagatttgctaggaactggctgttgtgctgagatttgaaactaatattttttgctgtgctatgatacacttcttggccatataccatagcagcttcacatacatcttctgctctgatgtgttgtacctttatttccttcttatagattagaaaatgaacaacatttggtaatgatattatgatctttctttgaacgtgcaggttgcatcagcctataatgaagcactgattgatggtagaattacaactggaggcattattcagtccacatttttggaatcacttatgaagcgcatagagtacatcttcgcagaattgccgaacctgcatgacagcttcatcaattacctgaacaaaggcaaatggcctgatgcacaaaacgaagcagtgctcctttcttggtatctccagtggtacagcatcccacctccccatattgtgtcatccgcaattgaaaaggtgaagcccagaactcggaccagcttgtccatgctcccgcttcttcggctcctgctgccaaccacacatctcgtggggctcatggagattgagaagcttcacatgactcatggtcacgagggcttgaccttgcactgaaaatgcaagaaacgtttagcaacgagtgagccgattgtgactggactgaatagtatcagggctcattgttcttatctactagtaaggatcatacctaagtgctggaatgccaaggctttgtgtggaggcctcaatcatgtgatcctaccttgcaatgctcatattgccatctgatattgtaccctatgatcctgttgcatttagatgtaagtgtccattttggctttagaataggaatgaccgaatgagtgagcctagtttgagcctttgataactgctacatttgggctcaatgcaacatgggttcccagtgtatgccgaccggtttcaataaactggtggttacgaattgagctataatagagcacattttgtttctcaggctagtgattctattatatcatttcgttttttataattataacctatttaatgagacttttcttgttggtataagtttttgaatattggtcaaaatcccggctcctaagctggtcaccacatgctggctgaaataatttaaatttaggggaccacctatatatatatttgttgacacattttctactaaaaatttgacagatgtaattatagtacaatcgtagtgtaattgcactgtaacttgcatgtaactacagtgtaacttgtatgtaagtttcacgtaattttgaatcgttagatctattacaagatttgttttggtgaggaagaaaaaaatcacagtacacatatgtgaaaggatttgttctcacgaccactattttactgaaatagtatgttactgagagattcttaaaagttacatacaagttacagtgtaattacatgcaagttacagtctaattacactacgattgtactgtaattacatctgacaaatttttgggggaaaatttatcgacaaatatatagcaaattcgcacagccaaacggtttattaatgaccaaaacataatttgtatataaaacttgtgtccttcgcaatttaaaaatgaaactactttgaaaatactcaaaaattgacttcaaaattaagttttaaaatttaaatattgacaacggctgattcttttttggaagcgacgaggctctttatctgtacatttcaaaaggaaacaagaaacattcaaatttgaaatgtatttatcgttacatttgtgaaatactactatataacctgtccctttttatgcttgtccctatagatgattgcattgtgattattattctactagcaaaagtgcccgtgcgttgcaacgggaagtgttaagaccagaaaattaaggaaaagtaaaaagatttatattatgtaattaattgaaatacaaattgtttacacccaaatttggcacctaggattaaaatagggaaattgccaaagtttggacgatctaccggtgtttcctctgggaggccggtctgactgccgtgtataggccggtcagaccgcggcctgaactccggttagaccgccggcatgtggccggtctgaccggcagagtccgagcccaagtctatttcgtcgggttttgaagtttccttgctctggaaggcatgtttcgggtttcctttggtttctatcccgagagttggacgtggaggagagcctgtagagggcaagaccaacccctatataaggaataaggccggttcattgtaaaaaataaataaatcaatcaatcaatcgaatcgtttttcatattgcttttagttttctcttagtttgtccatctttgtctatttacactgtaaatcgttcgccgccactgcgagagtgcgacacctctttgtaggtttatcctgaaaaccatccattttgcccactagacgggtagttatccatcgttctatctagatcggctccgctagctggtttagtttatcaaaacccaacttgatctagtgcttgctagattaggatggttggcgactctagaatcaccgcaaagctttaggtgctgtgattgtgcttgtcaacttgtcacaaaaagttgccaacacaaatttccttcaaaatttggatatttttttaagttggaaagtgtataattaaattaatttacaagtaaaataggtgctacctgttggatttattctttttaaattcttcataattaactacactctttggaatttcattgaaattttcaaagcttaattgctaattttgacaatacaaacataatttcagcatttattcttcagcctgcgaattaaaatttaccgttcgttctcttttgggtaagcgaaggtgaagtgttatttgatgcggattctggatgatttgttgtgtgttggacttggaatgttgcggacaaaaataggtgaggatggaagaaaatttcaccagaagaggttagagatattgaacgtataaacaatgaaatcgaatagaaatcagacttatttctgccctttttacatacaatcagacttttttctctctttttttcattttagatggacgacaaaaacattttcaaattttttaagaagtagagatagagattagccattttcgttttcttagggagtattgtcacggaaaacatagtaatttattaatatataacttattaaagtctcagtaaaaaatatttaaaaaaatagattaatatgcttttaaaagcacttttataatagataatttttgcgaaaaagggccccgttagtagtattagaagggaaagaactcagtatttaagggacctgaacttgacctattttgtgccgagcctatgttggta

SEQ ID NO: 253 - DNA, 1349 bp, Oryza sativa
  unsure (1)..(1349): unsure at all n locations
cactatatttaggttgatnatagggaccaataatcctgtatgctgattaggaactaaccaagaagtagttctcacaagtaattctaaattactcagaaagatatttctattgaaacagaggtaattaatagaataaaagaacagggagaggattaccaccactcccggaattcctccgacttcttctactctacctcttcctaattctagtatcaaaatagtacaatagagcctcttataattcagctcaagcttgaaagtgtgtgaaaaagtgaagtctatttatagggcaagtatgatggttggaatgatgcgaaatatctaaattgccccgcaatcgtcatcaggagagcatctggagcgtccctgccaaacccaagatccaacggaggaaaccagggttcggccgaaccccgaacctaggctggcccatctggctgccaggtttggtctgggcctcctccttgccctgccttatccatttcttctaattttgggctaattctccggagttttggtgaagtctaaaacccaactcttatatggatagatttcttctcacttttagtctaaatttcctcccaacttatgtggtttataacttgcatcaaatatgcaccaacactcatggaatatgttagaattaacacctatcactatattggatattttattatctgagttttacgcaggcgttggcggcacaacttttgcacttaacagccgccaacagcatacacgcggcccatgaggcggcctgggaaccgtggcccgatgtgggagaaggcgtagtcatccgatctgattgacggtctagattgatccgggtctatataaaagttcggcatcctaaaccctaaccctaaaataatttcctctgcctccctctctatctatctatctatctatctatctatctatctatctatctatctatctatctatctatctatctatctatctatctctctctctctaaatggcggcgcctctccctttctaccgcagcggcgccgctccccctccccctcccacggtggcgggtggcggcaagcggcaacgccctccctttcagtaggaggggaggcagcgggcaggggcggtgccctccctctggcggatccagcgagaggggaggcagcagcggcgcctctctctctctctctctctctctcaaaacgacggagccagcggcgccactccccttcctcaccggcgaaagcgttgttacattttcgcctcccccagcgggtggaacgagcggttcaactccctcaacctttgatgggttcaaaagacgggcccttcaatttgtgtttttcaaccgaaggtaggcaaaatttttcccg

SEQ ID NO: 254 - DNA, 1993 bp, Oryza sativa
  unsure (1)..(1993): unsure at all n locations
tgtgccatggaaatactanttcnnnnnnnnnnnnnnnnnnnnnnnnnnnnnnnnnnnnnnnnnctcctcctgtttctcctctgattcgtttgaccctcatctgctattcctgttctaaggggaacattgtgtaggttaggttatgtgttgtatctataagaagagtaaattgcacccacggtgtattaacttggcaggtgggtataatttggtgcaagaacttgaaaaatgagtgttctagtgcaacaacttgacatgtaagtgtaatttagtacaagaagtttataagtgattgcatacatgcaacaacttgcaagatatgtacgattttgatacaataagttaagaagttatccgacaacttaattatttggagcacttttttttatacatatttaatttttaagtacttattttgacaatatactagcgtggatttatatataagcatatttatatttttattctaataactaataaatgaaagtcaattaaactggatgtagaaattattatatttcaattgagatttgggaaggtgaaaaaaacaaaaattcttaaaggtaattggatgtaaaattgtcaagttttgtactagaacgcacccacttgtcaagttgttgtactcgaacggtcaattctcaagttcttgcactatatcgcacccatccgataagttgttgtatcgtgggtgcaatttactcttacaaggaatagtaaatggtgacttctatatataatggcacaaattatacacattaaaaaatccacatgatttctccttttaattgcctaatcaactctttctactcgtcccccttcggattccgatcaggtgcagtcacaatagtgactacaacttttgcagtaccgaatcattcaaccatccagcacacaagggatagtccagattttactgggtgcatgtgtcatgcatcattttagcaatttgatcaagcacagaatagcttcagttcaaattttgcctgcaatttcactccttttgatatgaattttcttgaacttcaagaaaatccaaatatagttaaaaaaacaaaatagacacatacttcatttcattatattgaacttcataatatcttgcacatagaattgacaaaatgagctagagtttaactattttctctggaattgggtgtcatgcatccactgagacaaaagctttgaaaatcaactagctaagctattgctaggttaacccaattagaaaagctttcacggtccaaaagtagatcatcatttgcttccaaaatcagcatgatgccttctaagttctgttgacctcttcgaatgaacttttaagataagatgacatcttcaacatcaatagaaccctagggaaaaaaagataatatccaaattagaataatttgttagcacatatatttatctttgaagaaactggtcagcatactagtagaagttgagcatagctgctaattgcttcatattcttgatgttcttccacatcagtttgcaagtttttctcctttgccttttcttcatgctgcataatagatttgagaaggggctcaatttatagtcccattttaacttgttacatagtagggtacaaatatatttacctttctattttttttttttgtgtttttgcagtttatcaatccaatttgttttccgttatgttacacgtttccggctctcttttttttctggctctcctttttcttcagaccagagacatatgtgccaagttctgagataactgggatgctgactttgcaactatgccatcattgtaaatttgttttattttgtcctcaacttttttactaacggcatgaagtgcttcttccacaagcaagtactacatccgtttcaagttataagacgtcttgactttgtttaaagtcaaactgctttaagtttgactaaatttgtaggaaaaaacaataacattttcaactcaagacacaattattatgaaaatatattcaattattgatttaat

SEQ ID NO: 255 - DNA, 4348 bp, Oryza sativa
  unsure (1)..(4348): unsure at all n locations
cgcgcgcttgagttccgttcgcgttacnnnnnnnnnnnnnnnnnnnnnnnnnnnnnnnnnnnncttctgtttgctgacaaggacaaacaaacatccaccttgctaaccttatctagagaagcatacctgagcatattgcaccgggtaaattgcaatcacggttcagacactaaataaaccatgatttattatctgttgcctatgtggtgtgaaatatggatgtgtgaagtagcgccattcatctgtatttttctataatccgcagtgatgctatgatacatccggaggtcacgctgtttattcaacaaatggcactggatatttagttaacttattttgccgtgaaacttacccattgtgatggattcatgctttaattctttgtttgtccatgaaacttactaattctgtgtcctgacatgattgcaaattacatggcacatgatgcacacagcttttctagatcaagtctaaggtaaggtggctgcttgttgcgccatgtcagcaaaagaagcccagatggaagggggcaagctaaaaacatgctactaagtgaagcattataccaaaatacatggtgcaaatttaacactttgcttaaacctggtgcgaactgcaacaaacaccctaatattaaactgaaactagaatttaatcatatacaacagaaaagcgcagctgctattatgactactaaagcaatggagaaccagatttgtcacatgaatgaactaaaggtcatgtacacaaaaagaaaggcagctgctaaggcattatttaggatcaaaatgtaaaggagcagaaggaacatgacttcataagcatatgagcatgatgaaagaacgtatgcctgcagcatgaccacagtgaacatacataaagaagtagatcattgtcaggagttagaatgaggatgtccgtaaagggaaggactccagcccatgctctgcaagatacaaatagcagcattaaaaatagttccttgaggattcagaaccatgtgctaaggcaaaccaccttgggcgagttacgacaactggtgcagcagctaatgcaggaatgttccagctcatgtgaggtttaatatctccaaaggattctccattattctcgtcaacttgaaatctcacagcaagcaatattttttgctcatgaagtaaaaaacaaattattggtgtaccatcgatgtcagttgccaagaaaacctggtaggaaattggagtcatttccaaaacatatcaaagaaaatgatggtggtaaaataattgcaaagtatgaacaagtaaagggaaacaatcccatacaaaaaagggaaacaacagagacagatataaattatgtttaaacggagtttgattatcttattacgcaaatttcataggggtacactagcgtcaggctcatggaaggcctctaagtcatcatgaacactccctacaaaaaaaaaaagtaaagcttcactaatgcccatttggtaaagtccttcaactggcacggagcacatttgacaattgcagaagagagggggaaaggatcaccattgtcctattgtacctagaattcatctattcaaagctacaaacagagaccctgcaacaaagaaatgagaagtatatatcggttgtggccataatctatccatgccccatttttcttattatgttacattacataatgaatatcatttcaaaacaacctcttcttttgtgttgatcttaacagcacaaaaaacgtgttactttgtctaatgaatcaatcagaaaacaagcaatacaacattgaaagatatggccatagatggaaaatggaaaatatgacagaaaaaagagctcttttcatgaagttggaatggagcaaaccttactagcagcagattgggagcatttcccctgccatatcttacggaatgcaaacttatgcatagaaatatcacatggaattgggggcactgcattgtcattgatttcttcctggtaagttgtaccatcaatttgccaaacagagtgctgaaattttcctgccacatgaaaaatcaattttcatttcaagccacaaaataatgggaaatgtaaagatcaaaaaattgaaaaaatagtacctttgtgatatgatgccattagaggtactatatcacttgtccatatagttttttcatcaaaatctttcatcatatccaacctgccccattcttcaaaatatgttgcctaaaaatatttggtcatgatgcaaccaacaaaatggataaagaaatcaatcagacttcttatatattcataaaatgtccagtgaacaatgcatggaatacagatagagatagcatatttccactgatattccctacaactacaaaatcatgaccacaagataatagttgcaaatacaagtgcactttcaaaatcaatatagcagcatatttttctcacagaagtattgctggctatgttggtgacaacttcaaactttagatctaaaaatgtgaggacaccttataaaaatcacaaaagcagtaaaataagcaaaatatgtgcacctttctggtttggcactcagtaatagtaaaaggaaaacatgccaccatggagaaatcaatgcatttgtaatctaccaaatttgaaggaagagaaggcaaattcatctcaaaaacttgcatcatggtcaaaaacatacacttcctctgtttcacattacaaaatgttttgggttttgaataaattcatgcatggatcgatgtatgtgcttcattcatatatgtgtctgaattcctatggatgttactgaatccagatgagaaatggagaggccaaaacgtcttatagtgtgaaacggagggagtagtacatatatatatctgaggcccttcaagtggatgcagcacaaatatacctgaggctcttcaagtggatgtttcaagatgaggtgagacgaaaaaatagccccatcagctttactgacagtctccaaagtattgacttgggatgaaacattgtaattcaatccaaattccttgttaggacgaattaaatccctcgattttagcagtgaagttgaggataataccatatggcctccatcagtagatttctgaagtagaaggccagaaggaagaggccatattgatgaaacagcatatggtagtggaatactggcaacctcgcctgcaatttaaatcatgtgcatgagaaaattaagggataatatttcagcgatcatttggcactacactatatagtaagagggtaaactcaccatttacattgtatatagataaagtatcgacctgcagaacacatagaagtgcgtcacgagttttgtccatcctacaccagcaggcctacagttcagttcaacatcagcaaatgagcacccattgtagatttttagtaatcagaagcatgctgctaaatgaaaagaaaatgcactgtaagctaaaaaaggatcgtattgcttcatgtcaacatgctcattttgttctccggaaagatcaacaacctagtactgtacaactaaaatgtgtacagagtagatagttgaagcattgaaggagcaattttcagctctagtaaaaacattgaaaacaatttagaggtgcaggagaataaagaaacatgtctgtacagaaacaaaaaagatcagattaagtactcacaggaggaaacacatcgagcacagagaaatcagcagtcacagttctaattttatgagcaattatatgaaaaagaaaaagataagggaagatagttacttgttaaacaagcaaaacaaaatagtcaaaataccattatgcctgtatttggtcagaggtatcttttgtggacacgtgagccggcactccatattatcctgcaagatagggaacacatgaacatatcatactgatgatacaagaaatcaacatttaccaaatgaaagaatcaattgaactacaaaattcaagtagttaagcacaaaatatagtaccatcaccaagatatataacttcatatccaacttatatattaaaaaaaaaactcgactctatggggaggcatccccagagcatttccactgtaagtcgaaaaacatgctggatgctggaggcccaggacacagtcgcatttaattctgaaagccttttactcagcgaggtcaacctttgttttgcacaacccaggattcaagccctgggcgggtagcaccacaactcggtgcctaaccaccacacaactagtgtgttcccgcttcacccaacttatattggtgtgttttcatctaaatcactgcaaacatgcaggtcaaactttggcatgaaagaannnnnnnnnnnnnnnnnnnnnnnnnnnnnnnntagaatgagcatntacaatnccac

SEQ ID NO: 256 - DNA, 861 bp, Oryza sativa
  unsure (1)..(861): unsure at all n locations
cggtccatgtatatcttatnnnnnnnnnnnnnnnnnnnnnnnnnnnnnnnnnnnntagtccaccccttcccaattcgctgcatgttttgcaattgatgttggcttgattatgcggtcaacgatgctatgcatgtttggatcatctgagtttgactcaactagaaaaggtgaccaatagaactcgatagtagcattgtactcctgaaatattccatataaatgttccaagttagaaatgtaagacattagccattattctttggtcggcaaaaatagaaatgtacaaagacatatagctttggaatctattagaatttttattaattatagtgatattttataaaaaccagttatagccatattgttagtaattgtctgtgactctgttttgtaaaccattaaactattccattatttgtcatgttagggaacagtgcagtagctaattacctcaaggcggaagacatttagagagtcattcttgacaagtgatttcttctcccagggagcctcagattggacaaggcacaccatggactcccattggttccgattcagcgaatcccccacaaacatcagtcgtttgttcctcagtttctccaggagcaacttagcgtcaaatctgggaattttttgtcaagccacaaaatcagtttttttttttaaaaaaaaacatgtaacaaaaactgcatagtatagattatagaatatggatttggttggatgtttttcttagaccaatacttagggctcattttgatcaagagagattaggcccaaaaaattgaatcaaaatccctgnnnnnnnnnnnnnnnnnnnnnnnnnnnnnnnnnnnnnnnntgatgttctacctccacact

SEQ ID NO: 257 - DNA, 3597 bp, Oryza sativa
  unsure (1)..(3597): unsure at all n locations
cgtgtccattggatgacgtacttcatcnnnnnnnnnnnnnnnnnnnnnnnnnnnnnnnnnnntgatattgtttaggtcataaagtaaaaaaaaaaaagaagaagaaagggctatccctcaccttgcatagattacaatttaccctttgtcaatgtaaggggttgtttagattgatgtcatttcaagccataccttttttttatataaagttgttaaaaatatgcatacatttagttttttttttgacaaactttggtaaatacataagaattcctgccaaaattttgttaattttgtcaacttgcctaaatttagtaagttttatattggctacaatctgaatagtgcatatattacaatctactattgtcaatataggtcaaaggaattctcttaaacgaccaccacaactaaaggccatgttttgaaagtttatagtagctataacttcttcatcttcagctcttaaaatatattttaacataaattctatagctctccaaacaaattttaacatagattctatagctacataatgcaaaaaataaattaaaagctagaggctagagaacctaactttttaatttcagattctcaaaatttagctagcaatcaattgcttcttagaattggaagttcaccaaaaaatacttaaacagcatgccaacctcaaggacatactataaatggaagtactactagtattcattttctttatgtacaacgctgtataaaaaaattgaaggtgtgtacatgttttgcacgtagtgggttagtaagctggttagccgaagtgagcgtagtttaattggttatgttcttttgtgatggaacgagttcacttggatttaagttctagacttaataagggtactcgtatttacgactatttattctttcagtgatagagacgacatatctatcaacatcgagacgcttgttatgacttcatcaatatgaagatatgtcggttgagtcttctgaatatgctcataagggtaggatgtgcatttgtgcatttataggggtgaatgtgcatgtgttgtgagcgcttatatttatactaacgataatacttctacgatatttttgaatactccatccgttctaaaatataagggatttttgtcagatatgacacatattagtactacgaatctagatggggagcttgtccaaaagtattaaaatatgatgtatcctagtactaagagatgagtcatatcggatcaaaattgcatatatttttggatagagggagatgtagtttgtcacatagaattgttgtgtgtttagttcatgccaaaattggaagtctgattgaaattagaacgatgtgacaaaaaagttagaagtttgtgtgtaggaaagttttgatgtgatgaaaaagttggaagtttcaagaaaaagttgggaactaatgccatgttttgaaagtttctagtatctataacttcttctataatcttcagctcttcaaacatattttaacataaattttatagctctccaaacaaattttaccatagattctatagctatagaatgcaaaaaataaattaaaagctaaagactagagaacccagctttttaatttcagattctcaaaaattagctactaatcaattgcttcttagaattggaagttaaaaaaaacactaaatagcatgccaacctcaaggacatactacaaatggaagtactactagtatttattttctttatgtacaacgcagtataaaaaaattgaaggggtgtacatgttttgccacatagtgggttagtaagctggttagacatagttgtcagggttacgggttaggtataccctttaccctttgatgtacgtcacatatcggtatggcatacccacgcgcatacggatactccccgcgtacactaaggaaatccttcacaaagtctacggaggggaagagttttactcggacaagactgggtcatcaatgtatcgtatagggtctgttatctccgagttctacttggaaaccgcctgacctgcgatataaaagggaccccccgaggaggacctggggcatcgaatctcagagccaacacaaccctcacagcctacgaagtcggagcctgcaaggagccaaatcgccgggatctagttgaaccaactcgaccacgatctcaccggatccgtcaagttccattattccctttgtaacctgtgttttccaccatataatcccatatcacctggattaaggctattacctatcaaggggcctgaaccagtataatcctcgtcttttgtttgcttgatgtcgtattacgtagatccttgtaccaacataccccaataccctctatatccggtctacgggtaccacccgtcgacagtggcgcgccaggtagggggacttggtactcaaggttctactactatgtcatccagcctcgtcgacaacagcgtcaacaccaacctcagccaagtattccctgcttcaacgatgctgatgtggactcaagtcggcgaaatcgtcttcccgatttacgccacgatgtcgatctcaaccggtccgccaatgaccggaaacgagaacgtagtggctacaaaccaaggcgactccatgtcaaaaaatccgcccgccgggacggagaacggagcatcgacgacatccgagctcgagaaggattctgatgcggccaaaccttgtcgttccgacatgaactgtgagccgacgaagatgacttccgaagcgacaaggtcctggtgtcctatccacaaaaccaggaaacacattttgcaagcctgctgggttttcctcaacgtccgcgctgaaattcgcgcctgcaaagagcgtggaattcagcttatttctccaactcgtgatgtctattgtcctattcacaagacaaagaatcacgacctctcaagctgcaaggtctttcttagcgccatgaaagcgccatcccctaaggtccaacagtcacacatccccatcagggataaagacaaggaacgaggagcgacgccaacttcagatcgatttgttggggtaatcgatattgattctcacgaaccatcagtcttgcaccttctcgaagactatggatcatcgacaacaagcgcgccgcgagaggtattggctatcgaggatgtcggcacatcagtgcgcaccaatgcagaagcggagaatcaattgaccactccagcccagcacatcagagccgtcaacgctatactgagggaaaccccctacgatcccgttctgaacgacggggtcgcgcgttggacagaacgactacgggaatcagtgaccaacctcagcaacgcgttcgaagaggccactgccgcagcacacccagagcagccaccaactcgcgatgccaatggtgaaaacctggaacggagggaatcgcctcagcgagctacccctccacctcgtggcactgacgatctccgagatcacatcaacggccgccgagagacacgacgcacacgagacaacgtgaatcgttcccgacgtcatgtctcttcacagcgccatgataacgaaaatcaaggagaccgctcaaacgaggaccgagaccatgataaccgcacaaccaccacgatcacacgatcgg

SEQ ID NO: 258 - DNA, 1559 bp, Oryza sativa
  unsure (1)..(1559): unsure at all n locations
acgggnnatttgagttcgtgtacnnnnnnnnnnnnnnnnnnnnnnnnnnnnnnnnnnnnatgtttggtgcttcaacgagtgcagaaatacaatccccaaaatcaccgacgcttctgtaattcgcgccttcaaatctggtgtcagagatcgctatactacctaggagttggcgacaagacgcatcacaactactcagagattgttcgaaattgttgagcgatgcgcccacgcagatgacgcgctaagacgcaagaatgataaaccgaaggccgggggagagaagaaaccagccacggacgcgtctgagtcaagcaagaagaaaaatcgcaaaaatgggaaaaggaaatctcaagcggaagttctcgcaacagaatacgcgaaccctcccaagcgtccagacccacagagcagcgacacaaagaaagcatggtaccccatacacaagacggacagacattctttggaagattgccttgttttcaaaaaatcgctcgagaagcacattgcatttgaaaaaggcaagcgagtacgcgtggtcgaaaaggacgaggaggcggttcctcatgaatcggattcagcatatccagactccgacctccacgtttcacacatcttcggaggttccacaacgtactcctcaaagcgagaatacaagaaagtgaaacgcgaagtctattcgacatggcagggggctgcacccaagatgaagtggtctgaacagaagatagagttctcggaacaagaccaccccaagaccgccgtcatcccaggacaatatccgatcgtggtcgaacccactattcggaacatcaaggtagcgcgagtcctcatcgacggtggcagctcaatcaatcttcttttcgccagcactttggacgcgatgggaattccgcaaagcgagttgacaccaaccgatcaacccttccatggaattactccccaatcctcgtccagaccattaggcaagattacgttgcccgtgactttcggccaagccaacaacttccgaacagagcagatcacctttgatgtcgctgaattcgatacagcttacaacgccatcatcgggagaactgcacttgcgaagtttatggccgcatcccactacgcgtatcaagtgctcaagatgtcgggaccgaagggaacaatcactgttcaagggaacgcaaagctggcggtacaatgcgacaaacggagcctcgacatggtcgagcaaacacccagcccacccgccacgacggagccacccaagaaagtgagcaagaaaaacaagacgccgaaaccggacggcgcaatcaagatcgttccactctccagtgccaaccccgacaagaccgtcaagatcagggcgacacttagcgagaaataggaactcgcgctcatcatcttcctccgcgataatgctgacgtgttcgcttggcagctgtccgacatgccaggggtccccagggaggtgattgagcacaaactcatggtacgacccgatgccaagccagtaaagcaagggtaccgagctcgaattcgccggatagtgagtagtgagatntcagtngcgcgcg

SEQ ID NO: 259 - DNA, 3051 bp, Oryza sativa
  unsure (1)..(3051): unsure at all n locations
ccggnnnaaatgagagcacactnnnnnnnnnnnnnnnnnnnnnnnnnnnnnnnnntgccccaaggatcacttccctcttcctcgaatagatcaactggtggactcaacagccggctgtgagctgttgagctttctcgacgcttactctggctaccaccaaatcagcatggcaaaagaggatgaagagaagacagcattcatcacgccattcggagtattttgctatgtcaagatgccgttcggactaataaccgcagggaatactttccagcgcacggtccagggagcacttagcaaccagctcggcaacaatgtcgaggcctacgtcgacgatatcgttgtcaagaccaagacaagcgacccattgattgacgatctgcgggaaacgttcgacaacctccgacgatatcgtctcatgctcaatccagagaagtgcacgttcggagtaccgtcgggcaagctgcttggattcctcgtctctggcagaggaatagaagcaaatcccgagaagatcaaggcaatcgagaacatgaagtcgcccacaagactcaaggaaatacaaaagctaaccggatgcatggcagcactgagcaggttcgttgctaggatgggagaacgagggcaacctttctttgctctgctgaagaaacaagacaaatttgtatggacacaggaagccgaagaggcattcgttgcactcaagcgctacctatcaaacccccttgtacttgttgctccccaacctaatgaagaattattcctctatattgccgccatgccatattccgttagcaccatcattgttgtcgagagagagaaagtacaacgaccagtctactacgtcagcgaagctctccacgacgcaaagacaagatatccacagatccaaaagctactttacgcggtcatcatgacatcaaggaagctacgccactactttcaagcccacagagtcacagntgtctcctcctgtcctctcggtgaagtcgtgagaaacaaagacgttgtcggctgcattgtgaaatgggtagtcgagctgagccagtttgatgtccactttacgccacgaacagccatcaagtcccaggtactcgccgacttcgtagccgattggactatgcctgataacaaatcagacaaccaaatcgacaacgaaacgtggacaatggcgttcgatggtgcactcaacagccaaggagcaggggcaggatttatcttgacatctccctccggagaccaattcaagcacgcaatccacctcaacttcagggcgaccaataacacagccgaatacgagggactactcgccgggataagagctgcagctgtacttggggtcaagcgactaatcgtcaaaggggactccgagctagtcgcgaaccaggtgcataaagattataaatgctctaaccccgagttatccaagtatcttgcagaagtcaggaagctagagaaaaggttcgatgggatcaaagtccgacacgtctaccgcaaagacaacatcgagccagatgacctagcacgacgtgcgtccagacgagaaccgctcgagcccggcacttttttggacatcctgacgaagccatcagtgaaagaagttagcggcgaagttagcccggacacccccgacgttagctcggaggccacaaaggcagaacgcaccgttgccgatatcgagaccacagacgactgacacatcccactaatcaaattcatcaacagcaaggagctgcccgaggatgatacagaggccgagaaaataacccgtaaagcaaagatctactgtatggtcggcaacgatctatacaagaaagcgctaaacggggtacttctcaaatgcgtctcgtccgacgacggcagacacctcctcctagatatacatgaaggcatttgtgggtcacatgccgccggtcggacattggtcgagaaagcttttcgacaaggttttttctggccaaccgcccttaaagatgcatgcgacatggtccagcgatgtgaagcatgtcaattccatagtaaacacacaaagctacccgcgcaagcgctccagactatccctctgacttggccgttctcgtgctgggggctagatatactcgggccattcccacgaggacagggcggctacaggttcctattcgtggcgatcgacaagttcaccaaatggatcgaagtagtacccacggggaaaatcaaggccgacaacgccatcaaattcatcaaggggatattttgtagatacggactaccgcaccgcatcataaccgacaacggctcccagttcatcagcgtcgatttccaggattactgcattgggctgggagtcaagatatgcttcgcctcggtctctcaccctcaaagcaacggacaagtcgagagggcaaatggcatagtactacaagggatcaaaacccacgtctacgacaggctcatgtcacatgacaaaaaatgggttgaagaactcccatcagtactatgagccgtacgcaccacaccgacaacgtctaacaaggaaacaccattcttcctcgtgtacggctccaaggccatgctccctagtgagctacaacatcagagtacacgagtacagaagaactccgacgaggaccaggaggaacagcgaaacgtcgatctaaatctactcgaggaacatcgcgaacgagttgccgttcaagcagccggctatcaacaggccctccgccgttatcacgagaagcgcatccgagcacgcatactttcgatcggcgactacgtcctccgatgagttcaaagctaagcagggcgaaacaaactctcaccaaaatgggaaggaccttacacgatcacacaagtcttgcggccaggcgcattcaaaatcgcagaaggcgacggtcgcgaattagcaaattcttggaacattgaccaactacgtaaattctatgtatgagtcaatatcatccgtacctgtaagacaccttacagtatcaataaagcctattcttaggnnnnnnnnnnnnnnnnnnnnnnnnnnnnnnnnnnnnnnnnnnnnnatatcaannntcaatnnncccg

SEQ ID NO: 260 - DNA, 4571 bp, Oryza sativa
  unsure (1)..(4571): unsure at all n locations
gcggcttttgtagttccactcatatagggcgaattcgagctcggtaccctacctgtaagacaccttacagtatcaataaagcctattcttaggcccatattacaatcaaactgttttcacccgatgatcccttaccctaatgacacctagcgttgaaacctatcctcatgtccctttacgccgtcttaacaaggccttcgaggaacctaagggatcttcggctggggacgcccagagccaataaggccttgtcagatcctatagagacgaaagaccatgtaagatctggtcgtgtaagagttctcgccgtgcgtattaaccaagctgcgaaatcggaaattaactttccaacttcacggctgggggctaggatcagagcttattcaaccaaggcaggtcaaaggtccaagagccttatcctccgagaaaatttctccgacgacaaggctgggggctagggagagtgtacgactcaaacggctgactaaagtcgtcaactgagaacgcactcttacacacgacatccggagtaagaaagatttgttaaagatagatttcttttctatttcacaaaatacttcttacagtttttacacaaatccaaagctatattacacctttttcctgagatatctatcacagggtacgaagactaccaagaaggccaacgccagtccatagactggaagatcttctccgccaacggcgccatcgacctcgctagatggtctatctccgctggagtcctccgagaacgagcaaaaccctcacggagaaaatcgaggtccatgcgcgggcgatgatctcgtaggcaagccaacacgtgccctccggcatatcggctcgatcgacgacactcctgcttcaaggcctcgtcaatacgcttgccgatgccatcgagttgagcacaggcttcgttcagccatgagatgtatccggccgccgactcctcgggatctccacggggcactcgaagttctctacagaccctggccatggatgtgcagcaactcttcaagtacgagttgaaccacacctcacgacctcggagtgtttccacagcctgctctttcttcactgcaagcatgggtctctcgagttccgctacttcaaattttgtcttccaatattagatacgacgatcttggccagcaagagcactctcgagatctgctcaatgtgagaacaactaagccaagctatacgcctctttcgagaacatagttgatctagtcgggagagcatcaagggatgaatggactactaacctaaggaagtcgtcgccatctccgtccctgtagcaagggtctggtccacattgtcgggcgacgcatgtggttcaaacgcgagaaccggaataatcgccggtgactcgggctgcccgcgctgctggacatcctcgtcatcaacatctctacaaaggacaaaagctctcaagatcaacatacaagagtaagccagaataataattgcacgcacaaaggcggttaagattcagttttacacagcatgtcttgggagtacaagaggtcctactcttcaaatagggggagaacggattcccccagatcaccgacttcttccatcacctctttacgtgtgttgctagccgccccctgatccaagatctcgcgcagatcgagttcgggatgcgatagctttacacacgcgaggacgtggcacgctccggtgtagatcccgttcgatgtttcctccccgatcttggccgcatgcttggaggggatctcccccatcgccgtcgccagttccgcaagagaagatgtcagcgagaactcgtcgggattcgctgggatagtagacttaatgccgcactccctggcgagctgatgcaggccagtgtatgtgacccgcaacgagccacggatttccaacaggttgttcccgagctccgacatgcggtcctcaagcccctgccgttgtcgctcgttgccggccaccaactccctcatcttcttgaggtcttcacgagcttccgccaactagcgtaccagccggtcagcacgctcgttcgccgacgccgcttccgacctcgcctccgcaatctcgcggccgatgccactagcaccggcctcgaggaggcgccccatctcgacctggagctcctcccaggtgaggacagcagccggtggaccacgaccagccgcgggaccgctgactgggccgcttggtgttgcctcgcgactcccgggcgcaagcacgacatccgtcgaggctacagcgggagacgcgccggaagtccctccggactcgtcttgcgccgccttcgcccatgccgccctatgagacaactatgtttcagaaaatgctcgaacaaaatcacggagacgtaagttcatccacttacttctcgccaattgtcacaagacgttgtcgtcgtggagggcgggaagacgtgtccgaggcctaaaaaacggtcgatgcgaagtaaggcgaaattcttttggctgtataatctgacgacaggatagcttaccgagggggttgatgccttgcgacgatgtctgctcacagagaacttcctcccctttgtcggaatattgccaccacttgtagtagcagcagcagcatcagacgcctccttggcgaccttctctttcagagacgccgccacctgatgatctgcgagcggcccgatgatgttagtcagaagaagagcctacgcttaatcaagtcacaatgtgatctcggaaggaaaacgcagaatgcctgtcgagtacacttacattgatggcggcatcacgttcagccgtccctttttcacaaagggaaacggggatggcactcgccgttgtcggaccactgatcatcacctggccaacacgacgttccacggcttcgctgttcagacctgtgaatcgagaaccaaatttcggtaaatcgagagaaacgcgaacatgagcatgtcaggataaatgcgagaaagataccccgaggagaaacccgggtcgcgtcctccggtccggaatagtcaaaggctggatgggcccgagcctggagcggctggatccgcctaccaacgaagtctgcagtgactttataccccgacaagcctcgtactcggagatcgtcgataatgtcgataaacgactggagagagggggtcaaagggggctttgcggtccaagacgaaatcttgagcctcgtactcggagatcgtcgataatgtcgataaacgactggagagagggggtcctagggggctttgcggtccaagacgaaatcttgtccagttattctttgggaacaacgaaggcagggtccgagtctttgatctgaaggtagaaccacctagtccaccatttgctgcgagaagaagggcactggaaggggatataacacgacttcaggctatcccgaagtcggaacccgatgcaaccagacaccctgttggactccatccaacgcagctcgtagtagaagcgaaagagatcaagaaagggctctaccccaatgtaggcctcacaaagatgagaaaagatgctaagaaaggcgatagaattgggtttcaaatggagaagagaaagaccatagaagttcaaaaccaagagaagaaattcagaaggcggagggagaaaaccgcagagaatatagtcttcgatcgcaaccatgtgacctaagacgggctggggattagtacctcctgcttccctttccatggttccgcgaccgggaagggcgccgtcttcctaaagcttcttcagtgacgcactggtggaggatgatttgctgagatccatctctgatcggagatcgccggagaaagagctcaggtcgatgtactagggtttcttgtgggagcggagaagacgaagagcgcttgcaggcgggatgttttttgcatggggggcgaacttcaaaatggatcctcaaaattcctttaaatagacgcactaccgacggtgcgaattccaaggaacagagagagatgcccgccggaaatttctgggtccgttacgcgcggcggttttttggacttcagtttaaattcgctcgtgaccgttgggcttcaaatggtgctctcgactacgttttgtctctacggtcctcgcaccgggaacgacaacagtctcgacgccagaagtcgcgaatggttacacgagctcattttaagcagaagtcgggggctactgtcagggttacggattaggtataccctttaccctttgatgtacgtcacatatcggtatggcatacccacgcgcatacggatactccccgcgtacactaaggaaatccttcacgaagtctacggaggggaagagttttactcggacaagactgggtcatcaatgtatcgtatagggtctattatctccgagttctacttggaaaccgcctgacctgcgatataaaagggaccccccagggaggacctggggcatcgaatctcagagccaacacaacccttacaggctacgaagtcggagcctgcaaggagccaaatctgccggatctagtcgaaccaactcaaccacaatctcaccggatccgtcaagtttcatttgttcccttgtnacctgttgttttcaccatataatcccatatcaact

SEQ ID NO: 261 - DNA, 3711 bp, Oryza sativa
  unsure (1)..(3711): unsure at all n locations
cgcgcagagtaggacgaacnnnnnnnnnnnnnnnnnnnnnnnnnnnnnnnnnnnnaatcccatatcaactggattaaggctattacctatcaaggggcctgaaccagtataatcctcgtcttttgtttgcttgatgtcgtattacgtagatccttgtaccaacataccccaataccctctatatccggtctacgggtaccacccgttgacagtggcgcgccaggtagggggacttggtactcaaggttctactactatgtcatccagcctcgtcgacaacagcgtcaacaccaacctcaaccaagtattccctgcttcaacgatgctgatgtggactcaagtcggcgaaatcgtcttcccgatttacgccacgatgccgatctcaaccggtccgccaatatccggtttacgggtaccacccatcgacagtagtgagtgtaggttaattggttatgctctttgtgatggaacgagctcaccttgatttaagttatataatatagacttaataagggtactcgtatttacgactatttattctttcagtgattgatgacgtatccattaacaacaagacatttgtgatgcctttatcaatacgaagatacgtcactgagtcttccgaatacgctaataagggtaggatgtgcatttgtgtgttcgtaggcgtgaatgtgcacgtgttgtgagcgcttgtatactgacgataatacttctacgatatttttgaatactccatccgttctaaaatataagggattttggtcagatatgacacatattagtactacgaatttagatggggagcatgtccagaagtattaaaatatgatgtattctagtatcaaaatcgcatatatttttggatagagggagatgcagtttgtcatttaacggccggggcctcccctgctgtgttctcttaaagaaaaagaaaaaaaagatgctgtgttctcttaaagaaaaagaaaaaaagatgtagtttgtcacgtggaattgaatgaaattgaaatggttaagtcaaagttggcccgggatagacggcggcctgtcagtggtacgtacgtgttgatccaaacctgcaacgaaagggacacgcacatccgcaattatgcatggcgacggtgacgcgcggacgcacctaagcacgggctactactggtactagtaactagtgtaagctagaactaacgttaggctggccagccggaccagctaagctagttgctcacaccaaacagcaaagcaatccaccgcgacgcaaattctttgctttcgctctcgatcgggaagagaagggaaaaaaaaaaggagaagcttttgttgtcgagggtcatggccagttttgaccctgttcttctggtggcatccatcggcctctcaaaagccccaacgtgagtcgcacgatattgtcgtacctacggcggtgcttttggccttatatgattattatggacttttttctttaagaatttcgctctatttgagctaaaactgtcctctaataaattattaggagaccctctatcgcccctcctcttcattctagcgatcgacccacttcagcgcctacttgacaaagccaccgatctcggagcgataagcaaattgcgaggaagagctgtgcgcttccgcacatccatgtacgccgacgatgcggccatattcataaatccgaacaaggaaaacgtgagtgctttcgctgagttgctaggtcactatgggcaagcgtctggcttatgcacgaatctgcaaaagtcccatgtagcaccaattaggtgcgacgatttggacctcgacgacatcctacaaggcatgccagcaactagagtaaacctcccgatgaaatacctcggacttccgctgactactacaagactaaggaaagtagacttgcagccgctcttcgataaatcattgaattgcatagccggatggagaggaagacatgttggcctggtaggatgatctaccctagtgaaggtggtgcttacctcgcagcttgttttcctcctgacaggcctaaaagcgtcaaaagggtcactcgagatcctagataagcagcgaaggaaattcctgtggacggacgaagaaaccttgacatatgggaaatgcaaaatcaactggacacaaacacgtgtccctactgcttcgggtggattgggcatcctaaaccttgaaaagttcgcaagggccttgcgtctcagatggctatggtatgaatggaaggtatgaatggaagtcgccggataaagcatgggtaggatctggtacaccatgtgacgacactgacaagctcctctttgctacaacaacaaccataaaatttggagacggcgcaactactagcttctgggagtcggcctggtggcaaggaagaaggttgaaatacgtggcgccactagtctacgcgcagcttcaaagaaaaagaacagatcgctccaacaagcattgcaatcaaatcagtggctactcgacgtgacccttccagcggatacaggatggacaccggaactgatcgaccaacttgttatgatatggagcgctacccagacagttgagttgtccgagcacgaggaggataaaataacatggaaactcaacagtcacggtgaatacacgccggcgtcggcatacaacgtacagcttctcagcacaacggccaccaacttcaacaccctaatttggaaaccttgggccccatgaaaatgtaaaaccttcgcctagctagtcattcagaacagagtttggacttcagacaggctagctactagggggtggccgaatggctccgtctgtcctctgtgtcgctaggcccaggaaatggccctccacctcttggcgaattgccgctacacaaggcgaatttggatggctatggcgaactaggtggcatgcagtaccttgcatcctaaccagtggcaacaagcttcgtcgatcttagaatggtgggaaataatcacaagcaccaaagaagcccccaagaaggccctccattcgttgacgcttttggtcgccggggaaatttggaatgaaagaaacagcagaaccttccagtaaaaggagctctcgtcgaatggcctgctaacaaaaataaaagaggaggccagagcatggatctcttagcaggagcaaaacatctggaaaattggcttataacttagttcgttaggacctttggtcatgtttttccttttatactgtacagtttactccttctctattcaatgaaattggcggctcgccgattcattaaaaaaatatttttaggtctctttcactcatgacatattttttatgatgtctaccaacaacttatacaaattttaactatcgtatagcaaaatttatcttttgaaatgtagaaaggacatgtgaagctaaagggtttacatgtcaaccacatccaccacaaactttattacttcttttgaacaaagtacaatacaaagcatatatacataaattaagagatgatgtataaaatataatgataacaacatcataatgataaattttattaactaaaatcctgttacaatgcacagaaaaatgctagtttacataaaacagctcatacataaagttacatacatagtggataagcacgttaaatgctgtgattatatataagatgaaatatagaacatacatannnnnnnnnnnnnnnnnnnnnnnnnnnnnnnnnnnngttcgtcctaccctgcacgg

SEQ ID NO: 262 - DNA, 738 bp, Oryza sativa
  unsure (1)..(738): unsure at all n locations
cgttttaattaaccggctttatggcttggccgaaaatattgtcaaatccacgccatgtgttagacggctattttatagtaccccttcactttgtctaggtcaagtttcaacccatctaagatcgtaagtccgatgtgtaaatgctatggacagattaggtgtatgtggtcacacagcttttctcactttgagtgagaacattctccatttcacagtagagaatatgttacagtgctgcccatagacttaggctttccaaagtctttcatacgatttccacctcttttctagtatcgtccgctacttaaagaatgttgtccctagacgccactttttttccagcgtcaaagcccgtatgtaaagtcctttgagggtgtcccatgaagccatgcatccgacaattaatgaagagcactacagggtgcaacacttctgtgataattttacaatcctcccaccgaaccctatcactcccctattcctctctatcctctgccctctttcacgtcctctcccctatcacctctcctccctctatctcatccctactcgacgggagcatggctggcaatagcaccagcgacgatgggagaggcagtggaggcttcgtcgcggctcacgtctagtggatccggtgacggtaccctcatgcaggtacgggagaagcgcgccgggggggagggnnnnnnnnnnnnnnnnnnnnnnnnnnnnnnnnnnnngttcgtgccaccnnggcgc

SEQ ID NO: 263 - DNA, 1435 bp, Oryza sativa
  unsure (1)..(1435): unsure at all n locations
gcggccttgattgcgttctnnnnnnnnnnnnnnnnnnnnnnnnnnnnnnnnnnnnnnnnataaagtacatgtgaaccatatatttcatttctgatactatcttgtccgcacagatgatggaaggagcacaaataaatgtggatgttactgcacctggagcaataattgctctagccttgatatttctgaaagtaacatcacttaggcctttgtatcctttttaaatcctctagaaacagtctacattttagaaaagattcttagggttttgcctaactaatgcccattttacaggcagagtcagaagaaattgcagctagactcagtgttcccaatagtcactttgatctgcagtatgtgagacctgattttgtaatgcttcgcattgtagcacggaatttaatattgtggaacaggtaatcttgcaatttcaatctgaaatcttagtgtggctttgtgataaatcatcaacggacttccagtaaactggcataaagctaagtattgtttttatttcgtagaatacaacctaccaaagattgggttgagtctcaagttccttcatttgtcaactttggtgtttccaatacgagtcaagaggctatggacagtgatgaattggatagcgaagctctgtttcaagcttatgttaatattgtcactggagcatgcattgcacttggtgagaaatcaacatttgttctgtaaatccctttcttcaccctatccctgccagtattactatactgcttgctatatgtgatctgggagtctggaaatagcatttatatgtgttgactttgtcccacgtctgcttgtataagtgggtgaatgattatctgatgattctgagtaaatctgagagcaggattgaactagggacaccttttctctgaaatacatgttgccctttttcacttatccattgaccagtgcttgtctaattagtctaaccatacctacagataggctaaccctcttaaccttcattttcccctctggaattgttgagcttttcttttgcttaaaagttgactttaaagctgtccctcttcactgttttggacgggtggatcaacatcgagtacttctttcagttgagaagagatatctattggcttacgttaactcctagggaaggaaacacagaagctatagcctattatatagctcaactctctcccttcctgaatttgcagcaaagcttctctatctgtcattaaaggcatggcctgttgctgcagtatgccatctcctttgccgaactatctattatttattgattatgggttcattaaacaccatcctggttactgcattcgaacttctggtggcactgcatttcattgatagaacttacttaaattgggtaccgagctnnntttcgcgntnttgtagaggggtactcaggnntcggcaantcaaagggccagtc

SEQ ID NO: 264 - DNA, 4705 bp, Oryza sativa
  unsure (1)..(4705): unsure at all n locations
ccgcgccttggatgcacactnnnnnnnnnnnnnnnnnnnnnnnnnnnnnnnnnttacaagttggatttagctgatcacaacaaaggttttactgttgatctaatattgtggattttatgacatcggacctctagccgatgtatgctttaaccttcggactaatacttattctattatgtcattattagcttattggtttctactggattatattattgttatttatcatcatgagccgattgtctttttacatcaagtgtcagattctacatcaaacatatagttgatagctcaaaaccttatcgctatcagttggtatcgacatcggctagaattactacatcggcctgtcaatcgatcggctcattgatctgctatttgtatatcttgtcaattacaagatcaaattgactggcatgcctgcatctcatcaacctttggacctacactggagctaagcagatctcccaggccattgtgttcgttgacttagttcgcgccaacacagttccggcaccatcggccgagcgcggatttttcgttaacaaccggctacattggtgttgttcaaggctgcatcgctttgatctcttggattgctctgattcggttgatatatttgcctacctaatttatcatatatcttagttaatctagtttggtagctcgatttacttatatcggctgagattcgctttagggtttatgccagtatcgactaaattgctttgccatattagattagctaagatatttgccaccctaaaaatcggtcaagggcttgattgtctagatatatattttcttttcatacttagtgctgcatcagttgagtttgatctactaagtcgtgcttagaaccataattcctagcctgcttcttgattgccaataagggtttcatcgggttttccaccgatgaggtatccagacgttgtatcagcatacaaggatagcatataagttggatttagctgatgacaacaaaggttttactatttatctaatcttgtggattttatgacatcgaacctccaaccgatgtatgctttaaccttcggatgaatacttgttctatcatatcattgttagccgatttgtttctactgaattatattgttgtcctgttacattatcatcagccgattgactttatttacatcaagtgttagattctacaccaaccatatagtcgattgatcaaaaccctatcgtcatcggctggaattactctattggcttatcagccgatcggcccattgatctgctatttgtatatcttatcagttgcaggatcaaattgactggcacgcccgcatcttatcaacctttggacctgcactggagctaagcagatctcccaggctgttgtgttcgtcaagttaattcgcaccaacacagacttggcatcgttggccaagtgcagatttctcgtcaataggtatttcaatcacaaaatttctagaaattccgagaaaatttctggaaagtttccaaccgattccgagtttcgacgaaaactgcccttatcatattagattctgttttcgagaatttttttttctgaattcgtttccggttcccaaaaattcaaaaaaatcttgactgacagattccgttttcgaaaataggtctagaattcaaaaaaggttcccgaccattttcacccctatctcatgctccttagcagagcaatttgtgcaaaataaaattctatatatgaatttgtcatgggtatggataccgcatacccaatagtaatcgactaagcttggtgggcccaccatataccaagtcttaaacggaattgtacctcgtatatagaaggagtttcggataaggaaagaaagtagagttctatatgggaacgacaatgactactcggatcgtatccatacttgtctccctagttctacttgtacaaggggacatctatgggtataaatacaaaaccccctatgacgagaggggacgacagacacgcaagctagaacaaaccaatatgccgccagacatcgacatgagagattagcctagacagacttaatttggtgtctgcggaggccgacaagagggatctagcgccatctctgatctcgacgagttcatattagaggaggaagagtactaccccattgtcgactacgtgttggtgttcgtgctgtcatgtcgacgacggctagataggttatcccaaatattgtacttgtgtgattatgatgaatatagagcaacactagcttcggtcaacaggagtagggcttttatctgtcagataaggggaccgaacctgcataaaaattcttgtctctgactcttttacctcaatctcgcatataccctgataccaacgatctccatactatgcaaataccatagtcgtgatctcaaacgtcgatagaatttgttataaaaatgtttagatccatttttgaactttaaaataatatttaattaatttgtttgtaccctccaataattatcacaaatcattcatccattcagctattcagcagaaaagtacataggtaaaaggataattatgctaagcctatcgttttaattaatgtaccaacaaagtttgttgattaaagttttcacaataaaagttaagatgcatcaaatgaacaaaccaaaaataatttcagggcaaggcttttatacttctataattctattccaattacaaagataagtctgaaaataatattaaaacccccaaatcaactctaaattaagttaaaaaagtttatgttttagttgtggctataagacaacgagcaaccaatgtcaattaatttcatgtaatatactaaatgcataataacttcattactaaaataactccaggttcctgactaaaatagctcatagattcatgagagattccactaccagtccataataaggttgctataaaaattgtccctgcaaaaataattaataaaactgtcgtgcataaaataaatgtaagggcaaaattgccttttcacttgcctactgttgacgaaaaatccgcgctcggccgatggtgccgaaactgtgttatcgacgaacacaacgacctagaagatctgcttagcttccgcgcatgtctaaaatattgatgagatacaggcgtgctagtcagtttgatcctgctactgacatatgtaaatagtagatcaataagttgatcggctgacaagccaatggagtaataccaattgatggcagccgatagcaataggattttgaattatcggctatatggttgatgtagaatctgacacttgatgtaaataacaatataaagacaatcaactaatggtaatgtaataagaaaacaatttaatcaagtagaaaccaatcagttaacaatgatatgatagaataagcattgttccgaaggttaaagcatacatcggctggtggtccgatgtcattaaagattagataaacaatgaaacctttggtgtaatcggctaaatccgacatgcatacaatccttataagccgatgcaacgtccatataactcatcggttgaaaccccaatcaaacccttattataatcaaagacaggttagcttttatgattttaagcacgactatggatgatgcatcgcaaagtatgcaaagaagcataaagtctaaacaattaagcttttgactagttttcagggtggtggataccttagataatttaatctagtaaaacgatttagccgataccgacataaaccctcaagcgagaatcaaccaatatggctaaattgagatactaagactagattaactaagatatatgataagtaggtagacaaacataccaaccaaaccagagcgatccaagaggtagcgttagacaacaccaacgtagccgatacgattgtcagggccagcggaacgtagggcttaccccttcgctggagatcgaaagccgatgcaaccccgcgtcaggtgccaagttccaccggatgataagtaaaaacctcagtaaagagggtggcgatgggccgagaatagttgtattgatctgtgagataatttacaatgaccccggatatacatatttatacccatggatagatactaatccttgttggacaagaaagaaactttaagttcttatcggacactcaacacagtttcctaaagataaaaggaaactaacagactattcctaattaatagataaactgacatgtcgcatccttcttgaactcggtctcttatggataaacttcctttagtaaattaatttccttatccgaatacagtaagaatctgactattagcgacttgataattcccatcggttgattccaggactttgaagccgatattgactctatgccgatgatgacttcggagtttaccaaatttcactgttaacacctactaacgctaggtaaaactaacggaataggcatataaaggataaaagttgagaatgggggtaattagcgagagatagagagcgccaattttgcaatggtaaatgaggaaatcaatcaacgttagagcacaaataaaaaatttctttacaaaatattttcaaaacttttcatgacaatttgcagaaaatattaaatatatctatatattttaataagtcttatgcgtttgcttggtaatccttttatttgtggcttataagccgnnnnnnnnnnnnnnnnnnnnnnnnnnnnnnnnnnngtacttcagtgtcnntatnttgcgcgg

SEQ ID NO: 265 - DNA, 976 bp, Oryza sativa
  unsure (1)..(976): unsure at all n locations
tatcaaaaaacaatctgagtttcggggtaaaaaattttgaacaggcataagatatatctttgttggagccacgtcagcggccccaggattttaattccggttaagcagccccaccgggaagaaaagctcttttacacctcttggcgcgggtgttgaatactttcgggcactcaagatcaagattgagtcgggatggagtttataaaccgggagcaatatttctctcccaatcctatcgggttaagtccacatatttaaataaaattggatccctctcttatcagatccaatccctttactcctcccctctcctctcctcctccccgggttggtggtaccaaacgggactaaagatagcgatcccggttggaaaactgggactacaaaggttctaaaccgggagtaaagaacatttctctaccagtgacattatgttaaaaaaataaagcctacaaagtttcttttttgaaatttgaactaaaaaattttaccaaaaatatattttcataatttagtacaaacactcattaatatttttttaaagaatatattgtcagcaaaaaaattttatatgcctgttcgtagcggattaaatgctaatggtgaaaatgaaattatgatcaaaacaaaaattaactctaaacttaagttttaaatttagatcttaactacatctagtaagctaaaaagctaaagagtaaacgacagaactactatgattcatgcagttaaacccatttagggtcttttttttctgcaactttaaactacaactttctcgttcttggttaacatgatttttaaattgttaaatgttgcatttgtttaaaatttatataaaagtttattttaaaaaaataaatttattttctaaatttatgcaataattaatattcaatcaatcatgtgttaatgattnnnnnnnnnnnnnnnnnnnnnnnnnnnnnnnnatcaagtgctcntatcttggcgcgtg

SEQ ID NO: 266 - DNA, 1049 bp, Oryza sativa
  unsure (1)..(1049): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtagatccatttgaatctctaagaatggagtctgcatccataagctttacagcccaacccagtcgacaagcaaatgatgcagctgcctgaagctgatacaggtcagcctgcaacgttttagccaattcagcaactgtagcattttcacttgatacaacaaatacagcatatagtagtctgcaaacaagaaaggcgtaaaatcattttaatagctacagatgattcttgcaatgcactatagtttaatagggaatggagctcagttgtgtggaagaatactcaaggcaagtactcactcttcaattggatcttcgtaagactgatccttatttgacacaaaaccttcaagccttgatactgaaacaacaggacaagtacagaactgaaccaattggcatttagggagaattgagctgtgttgtagtttcgtgtctacagaataataccctcaatatacacacactgttagtgcctctaaggatgttataggtttctaactgatattgtacttatcagcagtttaccgttacaagcttgaagcaactgtgccattgaattataggccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtacacaaacgg

SEQ ID NO: 267 - DNA, 1108 bp, Oryza sativa
  unsure (1)..(1108): unsure at all n locations
ggggttttgaatacanatcctaagcttgctgcctgctgttgactctgaggacacccaagctcatgcgtgaccttaagatacaccaccggatatcttagccctaccactattgcaaacggtgcccaattgtccactctttcattttgcaaaacttcattcaaaagaaatcactgccgtctagctttgagcaatgctatctagcagtaattatggaccgcttcattcaaaagaacattttgtgtctagctggagatttgtcgtaaagtttagtttgggcaattgctactgaattaattaggactagtaaccaactgttaacgaaggaatatgaaagaagtgcagttcaagttatacaagtcgaatccaacaccttgcaaggatcgcaacttttcttgcccaaatctttgtcaattccatcgggctaattaacaatcgatgtcttgcacgaaaggaggaagatctgtctatgcaaattctccagccaaccgctgccaatagattatttcaagaatctaaacatgggccagaactgggccatgcaaagcctgctctcctagctaggttgggccggtctggctgtaaatgataggaataagttcactttgtgaccctcaaaatgatcgaaatttaatccgtgaccccaaaccacagaaccggatatctcaacccctaactctcgaaaccggtgcaatttgactccctgggtggttttggatggcggtttcgctgacgtggcgcctacgtgacggttttaactcggtcttctttccacgtgacgttgacgtggcgcttacgtggtattagaaataaaaaaatatgtgtaggacccatttgtcatacacacggaaaaaaatgtgggagcccctgtcatgtggagcccacataattctctcctccccatcttccttcttccttctctactctccacggacgatggagtctgcgccgacttgccgccgggcaccgacttggcctgccgcacagacggtattaccaacacccctcttccgcgggtgacgtccgtcttccccaacccatctccggggagacgttgtcagcgcacactggcggcacgctgtaaggcgggcgctcgaacagcggccaccat

SEQ ID NO: 268 - DNA, 1484 bp, Oryza sativa
  unsure (1)..(1484): unsure at all n locations
tggctttgaanttaagttgnnnnnnnnnnnnnnnnnnnnnnnnnnnnnnnnnnnnnnnnnnctccttccttcttcaagcggtgtggcgacgaggagcagccgcggagcatgattcctgcggcggagatggcgatggcgcagtggaggccgatcggcctcgaggtagcgcgtcgtggcggcccacggggtgaggcaagcgtggaggacgcggtggaccgggtggaggaagaggtggaacgcatgtgggggcgaggaggaagcgaccggcatcaattatcacgacgagctgctttgggtgttcgtccacgccgatatcggctactgcttttctgactcgcgccaccacagcctgccataactccaatccagcatccaggtacagctcttactatacaattaaactaaatctgccattagttagtaactaagcttgattatatttgataatcagccagatgtacagcggatcttggctatctccgagatatacagcggtgatgcctgcatgacaatcaccggtgagatgaatcaagaactaatatagaatttggccagtcactatgccacggtcaagagaaaggcacccgcctgccgccgccggaatcatgctccgcggttgctcctagtcgcaaacccgctcctcctcgtcgtttctgtttcgccggaacatctccgccgctggcccccatcccacggccgccgctcgccaacggaagagaaagagagagggggaggatgaggagagaatgatttacgtgggccccacatgtcagtgggtcccacccatacttttggtgaatgacaaatgagtcccacatatattttttatttctaacatcacctaagcgccacgtggaaagaagaccgagtcaataccgccacgtaggcgccacgtcagcgaaaccgtcctccaaaacaagggagtcaaattgcaccggtttcgagagttagggggtcgagatatccggttttgtaatttagggtcacggattagatttcgatcacttttgagggtcacgaagtgaacttattcctaaatgatattcacattttaaattttgtttttgagaaggaaaaagtacaccgaaggtccctcaacttgtaatcgagttacaaaatcatccctcaaccgaaaaaccagatatatgacatccctcaatttatagaaccgttcactttaggtctctcggtggttttgacactggttttgtccgatgtagcagctgagttagcgtgggacccacgtgggtcccacatgtcagtgaaccctcgactttttcccctcttttctctattctctccctcccgtgcacgcctgaaataggatggagtggcggagcgggcgggcggcaggtagagtggcggcggccggagcagctggcggagcacccccgccataaatcacacctcctccagcatcgggagnnnnnnnnnnnnnnnnnnnnnnnnnnnnnnnnnnnngtacgcgaactcaaaagcccgcg

SEQ ID NO: 269 - DNA, 1403 bp, Oryza sativa
  unsure (1)..(1403): unsure at all n locations
gcgccctttgagtactnnnnnnnnnnnnnnnnnnnnnnnnnnnnnnnnnnnaacggttttataagttaaggaatgtcatatatctgtttttgtggttggggaacaataccttcggtgtactttttccttttgagaatgatttatatttgtattatttttatgtggcacttaataaatatgtttatatccgtggataaatatgttctattttttttgaggaaaaagatgtggtaaatatgattaacaaggtcaactcctttcttttgcattgtactattggagagttgtgtatcatattgcaatacaaaaatacaagatcaattcgacttttcgacctgaatggacgatcaagaaaaccggttctcaaccgtcgatattaaggtgaaggaaacaaacacgcatcaaatttattattcatcaaatcaaaagacgtacaaattacagattgttgttacatgaaatcagcactggtgcgtgggttgtagaaatcaatatcaatatgctacagtactattcactattcaggaaattaaaaagaaaacacaacacatctttgaactcttcagcaacgtttgcctgtgtccagtcaaaagctgctcgaacagcagcaatcaatcaggccatcagccttgttccagcccagacgattagcagagaggaaaacaccctcgtgaggctgacagtgggcccagctgctccgctggtcggataacccggacgctttaccgccacgtgtgagcctacatgggcacatattcatcaaacaccaatgtttagatgaccagtgtaaagcatagtaaaaacaaataacccttccttcagaaatattatttgatatttataacaaatttgattggaattttaaattgccgctacatcttcagacgtgacatattgggacggatggagtaatgatagtgattttcaagccgattttactctttttatttcttgtcttaaacaggtcaaaattttaaagatttaatcaaatcttatcaaacatcgaatatatttctaaatggagagttaagagtaactaattagctggtaatctgctagcccaacatttttacctgaattaggagaagcattccccgatccagcgccaccaccagtagcaccgcctgcgccgtcgtcaccaccaccactaccgncggaggcttctgcactgccacccgcaccgccaccggcggtggcgcccgcgcccgcctggccattgacgttgccgcaggccatctggaagaccgcctggactccctgcatgaggcccgggctgtagccggcgaagttgccgaagatgccgttcacgcaccccatcatcatggtcatctgcccgaagcacggcgcgctgcacattggtcgccccgtcgacccgtttgccgccgtcgtagccgacctggtgg

SEQ ID NO: 270 - DNA, 5852 bp, Oryza sativa
  unsure (1)..(5852): unsure at all n locations
nggccgatgcataatttgtaataataatgttaaatataagaaaaaaaatgcagtattactattatgttaattttatcctaagctgaccaaattgtagaacaattgtccacgctgtaattatggaaaaagcgaattgaacatctgataacttattataaaaaaaataaacctttttggctatgagcattgtttgttttcaaaaaaagttaatagtgtgtctatttccataattatattaaaaattggttcaaaaactaagagaagtgctagtttgtttttgaactatatacttccctccattttcttaataattgaaagcaagcactatttatttatggatacgtcactttgtaaatatttgcaaacaataaaaaaagatgatttgttattaaagtgtataacgtcctaagtatatgtatggagcttttgttcactttagtctaaccatctaagaataattcgcagccgaatttcatatagtaaagttaggattgccagttgtttaaaaacgaagaaagtaataattttcaggtatttgactgtcgtgtacaaaatgattgcacatggtgtaccagcctaatttaaacaaaacaatgtaaacatctccatcctttaatatagctacatcgaccttaattttttccaagttgaagtgtacacactaggagttgcttttggggctgaaggtcaatgcttattttgcactagtgacacagtgacaccctaattaaattaatgtttcaaggccattatacatcccaattggttgaactaatataatttcactgaagagtgccttttgcattgatctcacagtatgcatgccacgcactcagtcactttcattctgcatagtttttggtcagtaagaatctctggatccatagaaatgttctatgatgaaattcaaagtgaagagaagagaatggaacttacttgtctattgtcaaagcagagagcagcttgtgccacaatctggattgcatcctgtgtccctggaactactgcaccaccaccacctgctccccctcctccttgccctgcattgttcagataaatacagttacttaattacttagaaccaaacagatggagtgatgatacttccaatgcaaggatcgtaaaattccttcagattatatatgctgaaaaatccctcaatacccctatctggaaacgttaaaactatggcattttcaaatttaaagctgatcatttccaaacaagaccaaagtcctacttttgaacaaaaagacaagaagccatgcatcccatatgttaattaaaagtggatctaagatagattaattacctctacagctggagataccaatggagaagagcaccacagtgaggcacacatgtctgagcttgagacaggccatggcatgcaaggacatgcaactgaatgaactgatcaaaattcagttactactccctcacagcttgagattctgcttctagcacacctagcctgcagtccctctttatatgtgcaggttatgcaactgaattggcaacaaagctgcttataaaatgcagcactggattaaagaagcatggcagccttgcttcttggggaactctggatggctactgaatatgaagcaaaatgtgatcccttgaaccatttggtgagttaatattcaggcagaggcatatggatcactgggagatgattgcaagctagtcccaattgctataaaaaccatgcatgacatgggtaatggccattctgtgcaggtgtttggtacacaagaaccaactacccctcactagtttcctagacttggtcctgtgttggagtgtgcacaaatcacacctaaactggacatcgattaattggttaagttcttaagtttccagcctagttttgttgactatgctggaccttgatgtactttggatgtctcagttgcttccagtgagctttgagctcgcatgagaatgattcgtatcaaattaagtgcttgtttttctaccatggtagacgagttctgtctggttctggtaattgtgacgtatggcttaggttatatgcagaattgaattattgaaatatcgctaaaacggactatactgaaatttttattgatttgatttcttccaaattaccaagcaacgacatagtatatatagctagtgaaaatgaacaagaaattgaaatacaccctccggcaatgaataattgacgtttacagtaagttttggtcaaactttaaaattcacttctatcaatttcatattagaatcagtttaattataagattcaataggtttataatatcacggtagtacttttcgaggtaaatctatatatatacaatttcatttggttttaaactacacatttgagaaactttcgacggtttaaattttaaaactttgatcgaaccctactctaaacgtcaaatatttataaatgtgctttctccatcttaaaatatatagttcaactttgaacttaaaatggcagctatatttttttttagtgatagctatattttaaaacatagaaagttaattaagacgctgatcgggttagcggtggtggcagcggttattaattgacatgatgatgagtcatgggctcatcaagcatgtggagtggaagacatgcgtacacagatcgatgacagtaggcagttccttgtgcttgcggggggaggggactgaaggggatgccaatggccgttgagctcaccttgactcgcctgccgattgttgccaacaaccacaacctgccaagaacgcctctcgcaacctgattcccagctagccgctatctcgcaacctgattgcctgcaccgctagctgcacgtatggaaatacatattctaacttaatatcctttaactttaaaaggtttatatgtgagtcccacagattatggatccacatgccggcgatccatattacagaaccgacgtcggaggagcctctccttgaacgcacttacataggagaaaaatggcttgaaaatggactaacaccaactctgccatatctgtttttatatctttttggaatcggaattgaaataaaaaccgtagataaaaaacataatatgatactgatgaatatagatacggagcgaatattgtaactaatatttatcggaatatgaaaatagaggttgttgcttcttctttagcgaagagatgtgcctcactatttttttctaaaacaataaattaaaattcctattttttatcaattaataatatataactagttttacactttacttttcatgaaaattacaataagcaagaactatatattagtcagtacggcatggtctaataaaaaatagttattagacaagagaaaagcatatctaaagcattggtagaaaaaaaaatccattcaactaaccacctcagtactgtgtacaaatctgagcatctaaagtagagaatgatcaagctaatcagctacataaaaataatttgtttatgtttgtgagaaaaaaaatacaaattcgtttttggaaagcttgcaaccgattctggtttccaacgaatattagccttactatattcgttttcgtttttgagaaaaaaaaatctaaatgcatttctgtttccgagaaaaaaaatccagattttggaaagtatctaaccaattccagcttttgacgggcagtagtcttcctgtattcgtttttgttttcaagaaaaaaaagaatttctaaatcgttgttgttttcaaagctttaaaagaaattccaacacttttcgttcgaaaaacactagttgaagccgaaaacttttcgaaccgtttgcaccctacgtgcgtacacgctcgatcgagagcattgcgtcgccaccaaaccatcggacttgggtccgtcagaactcagatcgatcgatcgatgcccgcagctaagctcccaaattaacctacctaggtcgggtacgttcgtgctacctgcctgtacgacgctaccaatcaaattggctactgatcatcaatagaatctactacatgcgtagtgacgcctagcttctctccaaacctcacacgagcctgcatgcaggagctacctacaaacacgaccagagcagagagtgcacacgaatgaatgcgacgcggtaggtaggtccttggatcgatcgatcgggcttagcattctagaagggttttgctctcaattcccggctgatctctcacctaaccatcgatcgatcgagctagctagcgttttacatatactcctatgtgcaagctttaaattgttcactgaggcacgaggcagcacgcgttggtaatatactaggatgcatatatgtggtcactggccataagcgagcagatcgaaaaaacaaccaagaacaagaacgagataaaaccaatctgataaaaccaacacgttacaaatagtaagttggagctctaaataacaacgcgtgctgcaacgtataacaaatgataagttgagacgcacgctgccggtgaatcaaccctattcctacaagcaaatcaaagaaataagcaagaacaagataaaaccaatctaatatagcaaataggaattgaatacaaatgataagttggggttccaaataacaagtagatgggtggtctagccaacacgtgcctgcaagcaaatagcaatggctaaactttaatctaacaaacccaagaaatcctggagaggtacctagctattttataaaggtgggaagaacgatttaggggtccctagggtcgtgcactcgcgctctacctggttaggatgcaccccacatgggccccacttaagccagggtcccaaacaaaattacaatccctctagggcgaggtcggggagcgcgagcagctcggcgggcaacgcgcgcagcgcgtccaccagcggcgtcgccgccacgagcgggagatacaccgacgtgagcttctcgaaggtgtggtccaggtgccgtgctgccacgtgctgcgccgccgtggtcttgccccgtgcgtgagcagcagccgcggtggccggcggcggcgtctctttgcctcaagcgaagtcaggatgcccaggtactagatggccaatggcggcgtctcgtttactctctcttgaggtatcacgcctagtacccaggtactatggtctgatacctaggtaccagctcgataccagggtatcggataccaggtaccaactggtactcaggtactgggtacaaggtaccaggtaccagcctataccaggtatcagaaaggagtcacttaaggccatattgctaaggaaaaagtgcattgaaggtcccttcacttgtcatcgggatacaaaaacgtcctcgaaccgcaaaaccagatatgcggagtcccttaactatacaaaaccggtcacccgaggtccttcagtggtttggacctctgttttggtctacgtggcggatgagttagcgtgggacccacgtgagccccacatgtcagatgtccacgccaccttctctctttcccttcttctctccctttctcatctctctctctctctctcacttctgtgcgagctggcccgggtgaggcgggagggcggcgccgcgacggccaccggcagaggcggcgtgcgagcgcgacggcttctccgctttctccgcctcctcgccccgctcgggcgacgtggggcgcgctcttgtcggcgcgtgcgccggcgaacgcgtcggccctgtcagcggcgccggcgacgagtacgcgcagtggaacgcggcggtggggtgcagcctcaccggctcgtggtccagcacggcgcgcccatattctcaccgataaattaagcagccaatcgagctagctagacacannnnnnnnnnnnnnnnnnnnnnnnnnnnnnnnnnnnnnnnnnnnnnnnnnnnnnn

SEQ ID NO: 271 - DNA, 719 bp, Oryza sativa
  unsure (1)..(719): unsure at all n locations
tagttaagggaccctgcgtatctgattttgcggttcgaggatgttttttatcccgactataagttgagggaccttcggtgcactttttcctattgctaattagcccgttaaaacagctcgatcagggcccaaacaatgggccgaatttcggcccatccaaccacgggcttagggaagccatccccctcctggcctcccctatataaactcgccctcgagtccaagccatccccgaaaccctagacgccgccgccgacctcctcccgtgctcgcgacttctctcgacgccggtaagagaaccgtaccatctcgtctcctcgcgcatccgcccaaaatctcctcttcctcctcctgtttctcctctgattcgtttgaccctcatctgctattcctgttctaggtggagtgagagagagagagagagatcggagatggccaagtcgaagaaccacacggcgcacaaccagtcgtacaaggcgcacaagaacggcatcaagaagcccaagcgccaccgccagacctccaccaagggggtgcgtctctttgctccttccctctctctcactctcagatccagattccctgcaatcctgtagccttgccttggtttcttgcaaaaatgatgttttcttcatgtggacatagtaattcactgcaaannnnnnnnnnnnnnnnnnnnnnnnnnnnnnnnnnnngttcaacaatngcaaacaaaccgt

SEQ ID NO: 272 - DNA, 715 bp, Oryza sativa
  unsure (1)..(715): unsure at all n locations
ccggctagngttgccgacctactatgggcgaattcgagctcggtaccccaaggtagcacaaatgtggaatggcataatcttgttagataactcaggacaattatttttggtttctgacctagtttcaggattttcagagtattgtcttgcataatgcatttgggtgtttcttaaagatgtatgcctgatgagtgatgaccagcttcctaaatacattgatggcaggattgtagattattgcatacgaaaacgattgccatggacctcctgtttcgcgcgcaaaatttgcaaagagggagaatactatgaggagttgatgcgctatcttcgcaggaaccttgcagtatgttgctcaaatttctctcaattaattagaaccagcattcagaagtagtggagaaacaccttttgcatctctttgttttcatacttcaatttgtgaaatggtatgttttgactgatttcatatgcaatatacacttgttgtcatttttgttaataatttttttctttgggttgtattcatgcatacctnctgcagccatattaacaatttgttcaactagctaggaagtaattgtattaatatgattgactagtttttttaagaagctttcatgacagctacatttttgtaaaatggtttctttgggttggatccttggatacctcttgtgcccatacattaacaattttttcatttacctagaagtac

SEQ ID NO: 273 - DNA, 730 bp, Oryza sativa
  unsure (1)..(730): unsure at all n locations
gcgtgccttttganaannnnnnnnnnnnnnnnnnnnnnnnnnnnnnnnnnnnnnnnnnnnnnnnntgccagtggtaaaattatcttttagattggatgaacaagattaggtactttattttctcaattttatcttagttctgttagggggttagcttagttttctgtaaatgctgggtttataccatcttgacaccaatacttggtcatgacaaacaaattaagaaaaaagaaaaaagaaaaaaatagtctttttcttttgttgcaatcttcacttatttgaaccttcattcatatttgaggcgtccatggcactggtaagtcgaaactgtatcagactgcagattcatggttttactatgctatctacaaatatactaaaattttacaaatgttgaacatattcccctcaacacatattgcacattcctgtgaccttccaatgtagaagcatttaagttcatttgttcagtgaacattaattacaagctgctggtgctgctcctggccactcatactgtgcaagtttgatgcgtttcttctccgttgatcctgcagaaacagaggaagagaaggtatcatgactgcggactattatgctcctataagccattgagcagaagtcagtcaagactaacctgaagcagctgcaaccgaaactgtcgtttgcccttctgaatcatgcggaccatccgcatgagagcatagaacggcaacaagattccaccctc

SEQ ID NO: 274 - DNA, 1326 bp, Oryza sativa
  unsure (1)..(1326): unsure at all n locations
tggtgccanattgaanacatgttgcaangccncctttgtatggacnnnnnnnnnnnnnnnnnnnnnnnnnnnnnnnnnnnnnnnnnnnnnnnnnnnnnnnnnnnnnnnncaattattattaagagtattttaaatcgtatataagtgtgccacatcatcacccactagtaattattatctagagtattttaaatatcatgcaaacataacatatcattcataattttattggatttttagagctcaatatgtaaataatgtcaaatcattatcttacattatttaaacatatacatctaccatttctataatatataacatgcattcattcacatatcccgtagcaaagagcagagtatcaactagttattagacattagtatgccctaagctcttaacaagttagcatagctttggtccatgtggcataggtcgttgctttaactcagtatccgaataagtattccagtcgaatagtatttgcatctgtcttagtacgtattcgctgccgatgatatttgtgtttgtatttatacccgatactatccgtatccgtcctaattttaattacggttagaatatgggaagggtaaaatccaacccaacccaatttctcccgtcatcacgagggctgaatcctcaccctcgcgacacgactatggcgattactacggaaacagtttcgacaaaaggctatgtggcccacctctatccaggtgtgtgcgcgtggaaaatgaccatttttgtgtatggggcacttagccgagtggggaaatagattattcccgacagaccgcttaagatatctgattgcgataataaagtttgcaggcttctacgttaagcggtccacctaggatgatgtttttcccatgcggccatgccaaattagggcctcctgagaagatgcttcttagatatatatatttctcagctatttttaatcaaaatatttttttaactgaaatttcccagttttatattggcacaattctgtagtattactatagactctagtacttgtcaatatataaatattgaatatgtacaagacatataaatattgttttgtgaacttgattacaaattatcattctcagaccgcgtaatagtaaagtttcattacatgtgttttctttcccactatataaacagaagataaactttttactcatacgtgcacaaatttatatcagtttgtcctaagtttattcaatttatgatatatatcgagttcttttaattaatgtttttaataannnnnnnnnnnnnnnnnnnnnnnnnnnnnnnnnnnnnnnnnnnnngtgttcaattcatggggggggc

SEQ ID NO: 275 - DNA, 1162 bp, Oryza sativa
  unsure (1)..(1162): unsure at all n locations
tgatcagattgaaaccttttgcagccncctgtatgacnnnnnnnnnnnnnnnnnnnnnnnnnnnnnnnnnnnnnnnnnnnnnnnnnnnnnnnnnnnnnnncttaaaatagttgtgttcttgaggccagttgagacgaacagaggatacagaaacaatctgggtcaaacacaagactgctatttttttttatttgtaggaattctacagcagaatggtttgaagttgaatcctaagataaaaccgacctccccagatgtaaccagtgttaccgggacacgcgagtccaaaaaaattttccatgtcgacacgcatccccgtgtcagctcgtgtctgacacggttcgacacgcatcagacactactagcggtgtctctctcagctgccataggcgagcagtgccggtggttgtctggcagacctgtgggagaggatgggaaaaagaaggcagaagagagagagagaatgggatgggagagctcgatgggaaaagtagctgcgtgcgtgcatctacaatgcacaggcatactagtagtactccagagacaactagtagtactcatgagtagtattggtagtggcatgtggatggcaggatagcagtgggtttttttgtgcacaactgcacaagggatcctctacacatgaaattcacttattttggctgtcagtctttgtcctaactaataagaagataggatcttctgtgcagaataatgtgtgacaccatatgttttagtgttttactgactaagagtatgttttatttgatgatatatataatattttcactaaaaatcatatttatggagcgagtccccgaatcctattttttcttagcttgccgagtcggactccgacacccgtgtcagtgtcccggtaacactggataagtaattagcataatctatttgcagtaacctagtcgaatttatgaattgcttgtgaactactacatgagtataatataaaaattagtagagcgaatgaaatatgaccatgtatgtgcctataatcgccatggtgattaaggaataataaaacattcaagccatccatgggcgatagtctactacagttgtacacagccgcatcagtaatcaaannnnnnnnnnnnnnnnnnnnnnnnnnnnnnnnnnnnnnnnnnnnnnnnnnnnnnnnnnn

SEQ ID NO: 276 - DNA, 621 bp, Oryza sativa
  unsure (1)..(621): unsure at all n locations
gccgccgnngattgaagaccctttgcnangcanccatggatgncnnnnnnnnnnnnnnnnnnnnnnnnnnnnnnnnnnnnnnnnnnnnnnnnnnnnnnnnnnnnnnnntttgccgttttgcgctgaaaaacggtcgtgcttctccacgaaagcgagaagattatcctttgctagtttgctcggaaactagtcgttcgtcgtcacgtaagtacgatatttatcctctttgctaatttgcttgtaaattagtcatgtgattccgcgaaagtgaattaatctcgaaatcggtttcactagccgattttgatctatcgattttggcgactctattgtttacaccgcaagtcgttaggtgatcttgtgttggccatgaaaaagcgtcaacaccgccatcgcgtcgccgtgtccaacacctccgcctccctctaccgccgccagtccaccgttcgccgcctccgtttcagaccaccgccgtcgccgtctccatctccgctcagtgtccgcctcgcgccactgccgcttccgctgttaccggccacctcccgtgcggcacgccgttaccgtcgctgagcgcacaacctccgctgctgtcgaccgccttatcgggctgccggcgttcgg

SEQ ID NO: 277 - DNA, 625 bp, Oryza sativa
  unsure (1)..(625): unsure at all n locations
ccccccgncgttaagacactttgatatacaatcaatagcagccatagcatccccgggggaacctttcgggattccaacctatccgttttcaaacccttttgaataaacattatttaagaaaggcaagggtattgtttttgggagaacggaataaggcttatatacaaagggatagaacaataggttcaggttgttcctttcaatatctccctgtgtactgttgttggaaacaggattgaaaattctagactaccaataggcctactttgcagcaacagtcatcattgtactgaatgctttgaaaaaaagaacaccttaccatgcagatcaaatagagttgtccatatactcacatacggtttgtatgaatgtgcggttgtgccctgtttggactcctcatctgaaggtttttgttcttctcaagagataaaagttcttccataggcagcaaaccatagacgccgagaacagtgttattcttaacaacaaaactaaaacaagaaaatacaaaaatacacgactaatctcttctgttccacatatagaagaaccagaaaaacaaaactatttaagcattttaattattgaaagaatactatttaagtggatagcttcaggactataa

SEQ ID NO: 278 - DNA, 633 bp, Oryza sativa
  unsure (1)..(633): unsure at all n locations
tgtggtgctgaagttgcaggtgtactactccaaccatcaagagtacttaaattaagtcttggtgtttatgattaaataaatatatatatcgataaacagtttatttttacctttcattgaagccaaaaattcatcaccctgtatatggaatttggtaagactttttccagagagtttttcccacatcgcgatcaactcgttctaagtgaggcagttatcttgtggtcttatgtatattgtcttgttcaaggtgcggggatcatcgattgatttgattgtatatgttcccacatcatcttcatacacaaaaaacactgcatataacattgcagcttaattggttagtatagttgaaattctaaactgagtgtaatattactaaagaatggttttcaatagccctaacttagttcttatggtttcatcaaataatgagtagtgaaaaggatggtgattaatgctttattatttttcacagaaaatcatgccaaaaaaatcttaataggacatgatattttcactagctagctacagatgaaaaacataattatttacaatannnnnnnnnnnnnnnnnnnnnnnnnnnnnnnnnnnnnnnnnnnnngcgatatcgaaatcaaggggggggggggg

SEQ ID NO: 279 - DNA, 603 bp, Oryza sativa
  unsure (1)..(603): unsure at all n locations
ccgctcnnatgaaacacttgctnnnnnnnnnnnnnnnnnnnnnnnnnnnnnnnnnnnnnnnnnnnnnnnnnnnnnatcccctcgtcccctcatggtagtcactcccgtggaggagcagccacctcccgcggccgacgcatccacattggaagaggctgagcacgccgcggccgcagccaccgagggcgagggcgagcacaagagtgttatgcctgtgccggatgagctactggcaacgaccgaaggaggtgtgccgaactgaagacgtactatgaaaagacgttttcgagtggctatagcgtattgagtctatgcactgatttgtgacactggcttgtggggccaagggttgttgagtcgggtgtgtgttgtataaatcgccagcctgtaggtatgtgacatctatcgaaaaggagaaagaaaaatactacccgtcctctgcttctctctttctttctattgctctgttttcttcttcctccctactactcggttcctatcagatctccggtgagcatcgccaccggtgattggggtcgtaacaattttggtatcagtcacttacggtcctgcttgctccctcgcactctcttgacctttgaa

SEQ ID NO: 280 - DNA, 732 bp, Oryza sativa
  unsure (1)..(732): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatcgggctggccgatttgactgcacaacacacgtcggtctgaccagacccaaactaacaaaactcattgttcatcgtcaggtcaattcatcatcagaaaatcttcaaaaccaattatcttcaaaatcaattgttcatctcttctctattattataaaaattgaaaatgtttccgccaatactttgtacgttgtccgtatttgagttggttattaaattcgttcacttttgaaaatgcaccaggagtcgtataagaaatccttttaaaacactcacagctaacttggaacgagtaccgctaattgctttagaattcttgtcaggccctaagaaagcaacgtacagtatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 281 - DNA, 610 bp, Oryza sativa
  unsure (1)..(610): unsure at all n locations
cgatgcnnnttgnnnnnnnnnnnnnnnnnnnnnnnnnnnnnnnnnnnnnnnnnnnnnnnnnnnnnnnnnnnnnnnnnnnnntgaaacatatacctcatttctttttaactttagaccttacaaccctaatccacactggattatttaattgaaatcgatccgcactgagtcaactcactcccgttctaaatatgtatccttgagatataatagggttgtttgtttttgttgtgacttataacttaattttgaatttaaagagggggggtgtgggtttgggttgtttccattattttttatttgcctttgggccgaagagtaggagtataaaaaattgtactctcagaacttgtttttcgtatatgtctatggtttataagtcactgttcaaaaaattgctttccgtgaaagcctgttatacaatgtcatgaaaccactaagaaaagtatggcatttctataatccaaatgggaatttcatactctccattgtaccttttctcaacaatcaacagccatttttcaatacattcgtcacaaccatacgcggccattcgctgaaccacacaagagnnnnnnnnnnnnnnnnnnnnnnnnnnnnnnnnnnnnnn

SEQ ID NO: 282 - DNA, 611 bp, Oryza sativa
  unsure (1)..(611): unsure at all n locations
cccgcccnnnatgatanactctttnnnnnnnnnnnnnnnnnnnnnnnnnnnnnnnnnnnnnnnnnnnnnnnnnnnnnnnnnnattacagtgtgaatcaaattaggaggttgaagctaagtggttttgttcaagttaaagtttttctataaaataatctaccaaaaagatatatatttgatttgcagatatgcattgaaaattacacatttgcttggcagttatactgttagtccttatgaattgtttagttatttaagatgaaagggaaaatcattttatatcacaaatttggattacagacctgttttctgttgtttgatccctccaggaaaaccagctgccattcaatatggcactggttcagttgatgggtttttcaacgaggatagtgttacagtaggtgatctggttgtgaaagatcaggtatgcactatatatctcagtcactgactatctctgatcatatactccaaaatattttagcactgttgcttcaccgctttaggaattgcttcaccgctttaggaattcattgaagttataaaggagccaagccatatactttcatggttgcaaaattcgatgacattcttggtctcggatttcagaa

SEQ ID NO: 283 - DNA, 595 bp, Oryza sativa
  unsure (1)..(595): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnacttccattttcaccgctcaagccacgcaatcttcttcaagaagctccgacgatttctccagtgttccattgatctactacgaattactttgtaccgttcaattgttttctccttttttttaatgacaggtaatttgtggaagggttttttctaataagaaaaaaggggggggaaaaaaaattttaaaaagggcgcgcctacaagaaactttggtaagtttgcggtttcatgtgcaaggcaagaaattgngcnannnnggagcttnaaaagggtatgatggcatggnnncaaatatgtnggattttgtattgggtgcttttngctccccattttacgaggtatatgtgctaaaatggcgaatatgtgatattctggggtagcctggcatatatttgtcatgattctgaccataagagggcgttgctagtaaatcctgaggctagctaatattctgaattagtggattgattctaagtccaccttagcactgatggggcataacaaaatcca

SEQ ID NO: 284 - DNA, 22789 bp, Oryza sativa
  unsure (1)..(22789): unsure at all n locations
gcctggtgnnnntttgaatacaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatataagaatgttgtggatagccagaaggcttagataaactttaagtaaactcttaatgccttgacctacaatcacattcattaccatttacctcttgggttaatgctttcaatggaacttatatggaagtggatcatagactttcattgtaaggtcaacgttcctccttgtttcatgtactctgttagccatcctgttgcctgttgtcctttgggccaaagcacaaaatatttttttccaactcgccttttctgataacttgacaggaaaaggtttggtcaccactaaagggtttaaaggctcgtttgctgatgctgcatcttctgctaaggtaatgattcacattacacatgttcattttgcagcagatgtttcattgttcacagctcatgccattattttgtcttttgctctagatatttgctgttcttgctggtgttcaaagtttggttgcctgcactttgagacaactacgtgggaaagatgatggtcagtcttgatatctattgtgctcatttctttctctaggaaaccatgtcccaatccttaggatgtactacaatcaaatgtcaagtacaatcattaacttgtgaatccttttatatctgcagttctcaatgctggaattgcaggctgttgcactggccttgccctgagttttccaggtaacgttacaacacacaatgtagctgtgagtgtgaactgtttaaatttacaacttgttcctggatgtcctggctaggactggtattaatatcaacaagagcaattttcattatgctgagttatggaataggtgatctcaaacggtcctgacattgttcattaagaatgcatgcagcccttttgggagttattaatctctggcatccgtttcaagtttgatgattcaatctctacaattttttcattttcatgttcccttagtttgttcatataggcatttgtatctttatctcctatcttgttgataatgcgtcctaaactaatttggtttggatgcacctgaaatatttgtttattttcactacagttgttattatttttgttctatatttcatttttcttgtcttttgctgtattggtgtgcacacagttttgcatttagagttgtccatttatgtcttcatttttgcactggtaaaatgaagcactacaaaatcgacaatttcttgtgagatcatgagtgtttcttatcattattgagaacacacttttgtcctgtgacaaaatagctccttattcgcatgatgataacattactattaacagtgatatcggattatcggttcttcctatataggaaaatgttaacaaaaagatcatagtttcgtacctattcattaactgatggtcctttttcttcttttggttccaggtgcaccacaaacaatgattcagagctgcctgaccttcggaactttctcatacatcatagagatgctcaataaacaggaacctgcacttgctcgtccatctatcactggcacgaaggatctcaaggctggacacagagttcttcctcccttcacgctccctcttccgcaagaggcaatggagggtttttcctcgtttcaaaactttttgtcgaagttccaagggaagtgaaccaagtgaataacctcaagagggatggtgggtagcttcacctctttcctccgttggattttgtccgtgtaaatgcctcgtcttgagtttctcttttgttccacgagtgtaatgttctagggagtgacggattatgtgaatgttgatgtcattcttactcttttgaataacagctctgtgaatccttatcgtgcttcagctagtgttaatttgccacttgcttcaaacggtttctttactgactcgttgagtacatgatttgattattcgtggtttgttcgcagtagatgttgtcgacactgtcagcgagtttttgggaaaacattttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagcttgtctcttcggagacatccgataaaattggaacgatacagagaagattagcatggcccctgcgcaaggatgacacgcacaaatcgagaaatggtccaaatttttttgcgaattctggccaggtccttgcgcgttcggtattttgttcgttattttcgttgcacatatgcccctgggctctgatttcttacatccaggtccttcaagctttgcactttttccctcaaagtttccagatatcgaattatggccaggtccttgcgttcttcattttcgttgcacatatgcccctgggctctgatttcttacatccaggtccttccagctttgcactttttccctcagtttccagataccttacagatacgcctctccttttgcaccctcatctttttgcaacatcctacaggcaggtccatgtcggttcttgatgcgatcttcaggcttcttactgttgtacacaattcactatttctttgcaacaagatatatacggctgtgccttttgtaaccccttctagtttttttaaacaagtccttgtgggaatatggagttttcacttgtaactttctggtttttcgttctccatgattgaacaatttgttcgtttatgtttgccagaagtactggcaaatctccattcaagtgtgcaatcatgtgattggggtgatttttcctcctaagtttttgtttatttccatcggagcataacgccatttttccttgttggatactctcaattgaaatcctctactgttcttatgggagagtgactatcctagttccattttattctttatcatttatcaatttataacaaacaacatctctagaacatattttacctgttttttagaggcatttaactttttgccacttttaagatgtggctattaaggatttgccactcgtagcttagtggcaaatccttaattgttactggtaagtgacaaatagttaattattacccttttctatactaagatataaaaaggaagaatttacccttccaatccaacatgtgtaatctctgccgtccatctgcatctgtattgccctgatctgatccctaccgtccaccgcgatttaaccctctccatctccaccgcacgaatactacgcctccgtgcgaacaccgcacgaagatgttcgcacgaagactgcacctttgcagtactcgctcctcctctcacctcctcctcctcgcgtgtattgctgccgtcggagtgagttcttctctagccgccgccatacccacactccaccgctgcccccaccggagctgaggtcttccccagctgccactggagctgtggctgaccctttccgccaccgccggagccgtggtcgtcccttccgccgctgccgaagccgaggtcatccccagccgtcgacggagctatgactccaccactgcactttccccacgctatgattctgccgccgcgctacttgccgttgcacgtccttgctccgtccgactcctcgcttgtccccgccaccgctgcgctacaccgcatcctgccctcgccgacgtcgtggtcattcctgacggcaaggtccttccccaccaccgacgcacttcaccgcaggcgccgtggtggttcctgacggcgaggtccttccccaccgccgatgcaatccagcacaacatgcccccgccgacgtcgtggtggttcccgacagcgacttacttccccaccaccaccgcactctaccgtagcctgccccaccagcgtcgtggtggttcccccttctaccggagtcccatttgggactgcccctgatggcaccgtggtggaatgcccttccgtcggacccgctgtggaattcctcgttcgtgggtgcgcaatcgtcggcctcaaagccacttctttttagtactcataaaaggagagaaaacctgaaaagtagaatgcaagttcttgcgccaaattcatctgtgtgctcttcgttctactttcgtgcgattgtgtattcgctagggaaatttcactccagggcaccgggatcaaggatccttggttacactcaggagatcacaggtttgtaagatcgccagcaagaactaagccaccaaaggggagtgaatggttgaggtactcacaaatcaaaacttttagcggaattaaaagttactctcgaaacgatgaaggtcggtctgaccaaagtagatgcaccggtttgaccgcacggagacctccggtctgattggcgaagtagcttcggtctacccgcacatcgcgctgatgtcgcttgtcgttgccgccattctaaccgccttaaagccaccggtctgactgccgcaatgctgtcggtgtgaccgccgaacccaagcatatacaaattgaagatatttcaaaagtagattgaacttacttctactcatgtttacaaagtgcaacaacaacactcctctcacaaatctcgactaaactcaaaatactaacttttttctaaactcaacttgcacaaaatcgatgccgggaagtctcaaccccctctctatttatactcgaagtaagcagtctaaaaccacaaacccaacttgtacaagaagtcctaatctcctaggaaaccttcccatacaataaacaaactttataaactacaatcataccaaatttggactccgcatccatacgcacacaatatcttcatggtataccatatggaatcttcaccaaccatgatatcctgatcgtctggacatcatcttcttccaagttgactcccgatcaatcactagtaacactctccccaggcattaagagacacctacatatgaatcaaacaagatacaatatctgagcacaagtcctctccaacttgacttaacattagttcacaacagcattacatatgctgtcggtgtgaccgccgaacccaagcatatacaaattgaagatatttcaaaagtagattgaacttacttctactcatgtttacaaagtgcaacaacaacactcctctcacaaatctcgactaaactcaaaatactaacttttttctaaactcaacttgcacaaaatcgatgccgggaagtctcaaccccctctctatttatactcgaagtaagcagtctaaaaccacaaacccaacttgtacaagaagtcctaatctcctaggaaaccttcccatacaataaacaaactttataaactacaatcataccaaatttggactccgcatccatacgcacacaatatcttcatggtataccatatggaatcttcaccaaccatgatatcctgatcgtctggacatcatcttcttccaagttgactcccgatcaatcactagtaacactctccccaggcattaagagacacctacatatgaatcaaacaagatacaatatctgagcacaagtcctctccaacttgacttaacattagttcacaacagcattacatatgcataatattcatctagaattcataaacataaattaatcacaagtataaaaaaacaatccgaaaccagaaccgacacagagccgtccgatcagaccatcgggctggccgatttgactgcacaacacacgtcggtctgaccagacccaaactaacaaaactcattgttcatcgtcaggtcaattcatcatcagaaaatcttcaaaaccaattatcttcaaaatcaattgttcatctcttctctattattataaaaattgaaaatgtttccgccaatactttgtacgttgtccgtatttgagttggttattaaattcgttcacttttgaaaatgcaccaggagtcgtataagaaatccttttaaaacactcacagctaacttggaacgagtaccgctaattgctttagaattcttgtcaggccctaagaaagcaacgtacagtatatgaccataatcccaacaaaggttctaaattagatatcaatactatcaaaatagaaatctcatatactttttagataaaaaaaataacaataatacgattaaaatagccttcacccgtttcaacgcacgagcctttttttctaatcacaaaataataatcaaaggtcatcttcgcaaatggtgatggatgcacactccgctttcatgagagagagagagagagagagagagagagagagagagagagagagagagagagagagagagagcgcgtgtgccagcaccaagaataacaccacgacgaccagcgtcagcaggcggtatagtgtagtactcgtacatcaccggcgactatgttgggcgagtaccagttccaggacaaactcgtgttgctgtaatgctgcccacacgaccggggacgggaagatgcccatgatgcaaaaggagcagttgtaagcactgacaatggaggatagaagaagtaacacgtggggctgaacaaactagacataattttaaccctcattttataagaaactcagtgagggcttacatagttctaacgatgcttgtgggggcttgagcccctccgtgcccatagtagatccgcccttggcgtcggggttcgcctggccatctggatcgttcgagaggaggtggggagaggtcgatgtgtgcaagccgggatgggttcgaatggaacaagcaagtcagagggagccgatcgagaggagcgatgctgattcgcaactacagatgaccaaatgagccacccggcccgtgcacgaccaggcctaggcccgatataagttgggcaagcacaacccgcttaatgaccgggtcaggttgtgcccgcccacgggcacaacctacggcctaggcacagtcctataagaatcggaccatgctgggccggcacgtaggcacgaccaacacactgtgctcgtccttagaataggtttattttgcattcctcctctttgggttgtgccctatatatggcttgaataagtctagattgcctccctcctctttggactgccttatacacatctgaataagtctattcgcctccctcgtgtgtcgtgccatgcgaagccagcccactgtgccaaggtagcgcccccaggctcagcccaactgtcaggccgggccggcataggcttgacaccaattaggccatgtcgtgcctggccggaccaaaaggtcgtgccatgggacgggatgtcgggccctggaccttttggccattatattcgcaactgcgtcaagtcaagcggagcgaggaatcctatctcacacagacgcacgagcaaactaactcgcacgtgatttggatccactaggccccactctagcctacagctctacactgcagtagcacatttctttttttcctttctttcgcgtgattttttttcacacgtgcttatctccctctccgtccttcgtttttgcgtgcaattttttttctcatgtgatttttcctttttctcacgcgattttttctctttttttcgcaagatagctaggtaagtttcaacctcattttattttgaaaatttttgactcaaaatttaaaaacttctaacacaaaattgaaaactttcaattagaaatttgaaactcttaactgaaaatttaaaacttttgatcaagatttgaaaactttcaactaagatttaaaatattcaactcatgatttgaaaactttcagcttaaactttaaaatttattaacttgaaatttaaatatgaaagataaattttgaaaattttcaactcatatttgaaaagtttcaacttgatatttgaaaactttcaatccgagaattgaaaacttttaactcgagatttgaaaattttcaagtcaagatttaaaaattttcaacacaaaacatttgaaaaccatgtgttgaagattaaaaaaatcgtgaaaggaaagaaaagaaaaaaaaatcgtgaaaagaaagaaaaggaaaaaaatcacttggggggagggggccagctggcgcacgcgttgccgcgccaatttgccacacccgagcggagcaccccgtcggatccgtacgtaatacacgcgtcgtccatcgagagcggtgctgcagaggtggcgtgctgccgctgggatgcatcaattttttttatttacattttgaggcttttcttttcatcgtccgctctgttccattcgccgccgtcctccattccgttcttcctcagctcccgtcggtggtgcttgaaagagtccgttttggtgctggccttcttcaggtcgtcaagttcgccttggcgcgcggtgcttctcttcttcatcgtcaggtggttccctgcgctctcttcatgtcgtcaaattcgtgtcggtgtctcgtgctgctctccaacttgctcagatagagatagttcggtgctggttttcttcaggtcgtcaagttcatctttgtggtacgtgtttctcttcttcaggccgtcaagtgtgtcttagtggaagttcaagttcgtcttggtggttctctgctcttttccggtcatcttggtgtctcggtgctgcccttcaacttcattgccaggttcggtgctggtcttcttgaggtcgttaagagttaagttcatcttggttgtgctctttttcagttccgagagttctcggtggtcgtgtgtcgtgaagcgtcaggtcccattgttggaacttggaagctccttgaagaagaacgtgtcccggttttgaggtagaagaaacaaaagctaagcctgcaaaacatggcggcgagggtgagctgggaaatggccgcccggcgtcggcgtgtggcggaggatattgctccgccctacgccgtgctgttgttcgtcttgctgttggcgtgctgcgtgcggcgccgccgcctcctcctcatgccggaggatttattccggatcggtaaccaatttactggtataataaaacatccggattagttccacaactcttaactagtggattgattctcggtctattattgtccatatcatgcggtccggaataaatcccgatctctcgttgtatctataataaatttcttactattcttgtcactcctagccaggattgaatcatcatgtaaccgaacaagtcctaaggtggtcgtctcctttttaggcggagagggatgacacatatctggttttgccacaaagtgcctcagttttgtaagttgagggatgacacatattttttcggttctggataattttgtaatttggaaacaagatgagggaccttatgtatactttttacacttttatgtcgggttttgtaggcctcctctctcttttctggtcgaagccaaattcagggagatgggcctcacagcccacgttcacgtttattttcttctcaaattgtttttttttatctatatgtactaactttattttcttctcaaatccggcctctacaccaacaaggctgtacacaaacacaggaggtccttcagtacaagtttgaactttacccaagatcacaactgaaagggaacactaaggctctaacccgaaacaaaacaacaacgaagtgcatcgaccaaaggacatacacggctgcaaacaagaaaagccagcaaactatacccctcaattattttcctcatgttccaacccttagcaaagaagtgcacaacggtagtctccaacagtttgcaaccttctttcatcaagatgctttctccctcttttaataaaacagactactgtctcattcaatatattttcctgaaaatgacatttaattaacgaagttgatttttatgccattgagacaatgccatttctagagatccacatcgcccaacatatagctgcaatccaaataaagagatttagtattttagcctagattaatccaaacctttgaactaaactccaaacaagttagcaaccttatgaggcggtttgaaccagaaaggtaatgaaaatgacacatttgaaacacatctaaccacatatatggcaatcaatgaaaagatgttgtatcgtttcatcttgattacaaaagagcacccaacatcgtcgccattccatctccgttttgctaggttatcctttgttaaataccactagaggattttaatttttaacggaattctcagcttccaaaagtggattgatgataaaaatgggatcttcagttgactgcttcttgtttctcttgttgcatctggcgctccatcacatttggcttcttttatagtaacagagaagggaaggaccagaacagaaaaatgaaaaaaaaaagcattgcaatgttatactttgccataccttttatctaaaaactctggctacaaaacatcgcgtggttcgctgatgggccggtctgtgttgcttcagcgatcagcaccgcaagtaaataaagagagccgccggaatggctcaacgactgatacaacacgagctgcatgaatgcacggcgtaactaatttggagccaaattagtcatgggattagctttccggccggatagaacatagtacagaaacgagggtaagcctcactacaccggattaggtcacctgtgatgggtcctaaccatcacctttgaagggccggtttgggcctagtcagagactaatggtcactgttgagtctcagtcacctttgatggtgcccgttagaggtatcaatcacctctgatgggcatgtatttcatgcccgttagaggtatcagtcacctctgatgggcatgtatttccgagcccgtcacaggtgatgatgaccacaccgcagtccgtggttgcaaccccacaggtgacttatctttgaggctgtgacgggtgcattatattcggcctgtcataggtatatcatctttgacggggtatagtatcaaagctgtcacagatgaggtcacctgtgatggattttgttatgacccatcagtgatgaggtgaaattcgaaaaaaaaaacaaattcagaatattagctagcctcaggatttactagccacgccctctgaaaaacagaaacatcacaaatatatgccaggcaccccaaatatcacatattccccattttagcacatatgcatcttaaaatttacatcattcacatatgcagttcaaatgccacatatttgcacaacacattcataccacattaaagccacaaacttgcacaatttcttgccttgcacatgaaaccgcaaacttaccaaagtttcttgtatcctattccttttgaacctccacaatgacctgtcattaaaaaaaaggagaaaacaattgaacggtacaaagtaattcgtagtagatcaatggaacactggagaaatcgtcggagcttcttgaagaagattgcgtggcttgagcggtgaaaatggaagtaacggtgtgaaattttttagggtggtggttgttatttgtaaacatgtgcttaatagtcgaaaggataacactagcaagttgcggactgaaagagataattccactgtgttatataacacatcggaattgggggagcatgtgttaacagtgaaatttggcaagatagactcggatttggagttggatatcgaaacggaatcaaaggagattgatttttgccaaaacagactacgcatcgacttgaaacagagtcggaatctggttgagccgatctggtgggaagccgatacagcctaacttgggctcggtttgggcctcaattgagataactatcattgccgtttagagatagatctcatctaaggcaattgtatctattaattaggatatttatcttggtttgggcctcaattgagataactcttttcttttactttccaacgagttcttgcttcaagtcggggtatcggctgcgatctctcgacaagtggtaacttgtcttgaaggcttgcgctatcggggctattatatcattttaatgtatcaatcattttattgtggtcatttttatcacatatcttagttaatatagtcttagtatctcaatttagtcatatcagttgattctcgttttagggtttttgtcggtattggcttaaatcgtcttactagattagattagctaaggttctaccatcccgaaaagttgttaactccttgattgttttgactttatgtttctctgcgtattttgtgatgcatcatccctagccgtgcttagaatcatagaaactaatccggagttaatcataattaaggatagtatcggagtttcagccgatcttacctaatatacatgacaatgcatgtttcatgatctgtttatgaatatttgccacttatatagatagattgatttatataaatgcatcaagttagattgatctctcttaaactttatatctggtgatcgattgttatttggtacgtttatatagattgatttctttatataagtctgtattagagtattagtcaatacattatttgtttttgctctaagtactggtctattgactattttttataatactgtcttaaaatgattgacaaaaaccaaagagatggtattacaaccgttagggcatatttagggtttgcactttatctattcatctaaaagccacaaccgatttggtttaactgcatcggctgggtcctgacgatacgtcatcggctctatcggccgatcggctatcgttcatctaattatgttttctgttttatcttgctgcttgccgatctcctgcaaaagggcgtgatcgatagtcactcggttcatcctttttgcgcccaggagcttgaaacgacgaaccatatcctcctacactgtgtgttcatacgtcaagtctggcgcctcgtcctgtcttctggttggcgttggctcgccccttcccatggctgctctctttaggtctggtggccgtcttctagggcctgtctaccaaagtgtcttcgcaagggctttgacactctggtcctcctggtatcctggcagctgtggaaggagcggaaagccagtgtttttgattcgtccctttcgccggtctcggtggttctggagtccatcctttagaagaatcgtctttggtctcttgctagtgccgcttcatttggggacctgttgggaacatagggcagcagttactccaccacctctctccctctttataggagcagcattttcagcttgtttttcctcccttcgcggtcctttaccttgcatgcggcaagggtctatctgatttattgcgttgtgaaactaaaactctattttcttctaatatactgacgcatagtatttttgtgcattcatgaaaagaaatctgttttaaggagcgatgcaatattgcaatggtgtgtcaagattatgttccgattaacatttgattagaagtaatcatctgaaacctaatcacattgggcattcaggcatgcaaattctcaaatttgttaagtgtgggcactatatattttaactttcgttcaattcatagcgaacgaaaatcgcgcgcacttccgatggaaaatcccgtgagaaaaaaaaatcaacgcttctacattgatacggtaccatgcaaaaatcgtgcaaaaaatcagcgttccccaacctttggacgcacaaaaaatcatcgtttaaatggggaaaaaaagggcagggttccacgcctagagagagatcaaataatatggcagtaggggtagctcttctagcgcttgttcctctctacctttttgatgaagtttctggtgcggtccagtgtgatagcctggccaattagggcaagtattataatgtttcatatgctgcccctaaatgtgccatattggattgagtgatgaggtagaggagataagtgaggagagaaatggtaaaccacccctaaatgaagaggcaacctccacacaaattttaagaggggtgtgagagtataagagacattggtatttgtgtactagaggtgacatagtgtatagattgcctcttaatttatgagtaaatgatgtggataaatttagatgtggtagtcacatctaccataacacttgcccttaggataaggtcagtatagctcatgaaggtgtgtgcatatgtttagtaccaccttattagtttagtaagggtaaaatcaacttataagtgctcttcctttcaaacatatcacttccgggttaacccttttacacgaagcgaggacgaaagtgtatttgatccagaataggatatgcatatcccattccaaaatgatctattaaaaattatataaagagctattaaaaatcaagcagaccaggtactactgtctactactataccaagcagaccgatgcaaaaacatactactaccaccaagcagatcgatgcagctacggaaggggatttgcgtgtcaaacatacgacgactgctaccaagcaccgtgtcattttcaatgtctagatggtgtttgaatctcctgaagataaaaattatgtattttacgtaaaataaggtgataataacgtgtgattaattgagttttaattattacaaacttagaaaatagattaatctgatattttagagcaactttcatatagaaagttttttatgaaacatacagtttagcagtttaaaaagcgtgccacaaatatccaaaatttcatccacttcttgcagtggaaacgaacaggattttccttggaaaaaatactactagcattacctagttggggggaaccatttttcattgcaaaaaatatggtggtaggggaggctgttatggcgctcgttccgctctacgccgagctgctgctcggctacgcggtggcgcgccggagcggccgggtcacgccggagctgcgcgacttggcggtctggctggtgggcaacgtcgccaaccccttgtccatcttgcacctcaccgtgagggccgtctacagaaatttaaggcctcggagcgaaatacaaatcaaagctctaaattttaaaaaaattcatatatctaatttaatatagagggcataatttcagttttagtatgtattatttcgtgcaatgtttaaaaatatatcaaatattaatgctaaaagagtaggtatcactgctgttctaccgaaaatcatcatctgtatagtgttgtttaaataaaatctttaattgttcataattaataatgttgaagacatattttcagcacccgaatcatactttatctttctagaaggcatgatgaggtgattgacgaaacaaatctattatttttttatcaacaaaagcaaagacatgtgtttgattcaatcaggaatccattcaattgtttgttcactcacaatactgtaacagtagttcgtcaaattagtaaattacctgatgaagtgattagtgaagccggcaagcgcccgctagaagttgctttaggctcggcctccacgctcgcctccggctgtcctcctcgctgatggttgccacgatttgcaccaccaccgccgcccgctcgatcgacgctctgccagctgcgcggcgcctcgcgccctcgccgtctcgatgcacgcacgcacaatacctgggaattataggatggactgctccttcattgacctgcgacacctcgatctaactgacgcatgcgatctccaatcgtttgacgcttgcgatgccttggctttgcttctaccctagctctcattagctgatcgccaggcatgtggcccaccctagatggtggtgtggggcccccaaaagttgggggccctgtgcggtcgtcgttttcgcactcccccgtcgacggccctgcccaccatgagtatcgtccacctctccgacctcgactaccatgtcctccaatgctcaactcatccggtccacgagtatcactcgtcgacatatacttttatcgtatatataaattactttttgatttaactaaattatctcatatacatacataatgctctgagttaattacttttattattatttttagtcaattccattatttgtattgattaaatttcatttctgacaaacccatcactggtggagaagtggttttaaaccacggttcacaacccctagtagtcctgttttgtaaccgggactactaatccgagactaaagatgcatttctttagtcccgagtgaaataacgggaactaaagatggatctttagtcccgcttagtgttaccactaatcgggagtagatattttttttttcctttttttcattaattttaactgcttgcatattgatttcactccatccccaaatcacgaaaaccccaaatcacctccgaatcatagatcaaatgcatcacaaattctaaaagaaacatcacacatacatcacatattcacatcaaaaattcccaaaaacaaattcaacaaaaatatacaaaaacaaattgtaaatccgcccatccgccatcgctccaccaccgcccgccgcctccccagcccagcacgtgccccccaaccccgcccccgcccccgcgcgcgtgccgctttcgctcgctcctcgctgctgcttcaagaaaaggagaggataagagagagagagagacaggaggaaagggaggaggaggaagttaaagatgaggaggagtttgcgatcgaggaggagaggataagtgtgagggattatatacgacgcgttaatttttagtcccagttgataatatcaaccgggtctaaagataataggggacttggctagttcatgtaagaaatactgggaagctgcaacctacgtcttggacgagcaagtaagacggctcccaatggaggtcaagttcatcatccaagttcttcgaaacgtaaacatactggctgctcttgttggtattgtattggctgttttcaaatccactactaaccagaggtacgtacgttcgaatgcatgcattcatgaagaacatctatcataatgaattaattaatgataggatctatcactgtctgtgcctctctctgaattcaattataacaattagagcacccgcaatggtaaagtaaggtgctatctataaaatatgtacatctcagcaatagactagattaatattaaccatctcagtagtatgtctatatgggtatctatagctctctaatacattgcctcgtttttctctatagactatctccaggttagtagatagctttgctctctctttttatttaatctctttcaagtaggaaaatatgctgacatggatctcttatagagagcctatagataaccattgtgggtgcccttagtcgctgaagttgaatgagattaacaattttattattttgttcggataaggcgttcaggttaattcaagatttcaagtagttgagagaaaccatatatacgtatgttttcccctcgcatatggattcatctatgtacgagttattcagccgtagtatctgacgactattgtatctccctccccccccccccctttttttttaaaaagtctttttcacgtataattagcattaatcagttaagctggcgagatttgtcggtccccaaatttttgtcgtttgttgaggttgaatttgtagacggtccacgaagaccaaaactcgagaagccaaaccctatcccctcacataggctcgatcagcccggaggacaggattctcctggattttacttatctttatgatcatcgatctatttttggtagaattattcaaactgaattttgaattttcattcaaattcggtgaaattccgctgtttgtcttcttcttcttcttctttccttttttaagctggaaccttgctccacagcagggttcaaaattttggatttgttctatcggacctcccgatgtgatattatttcggccgaaatttttattttttttcattttttcgtgaatttagtaatattttgatcaaattttattcaataattcatataatttcagaccaaaaattcggtatttcggccaccccgatacaaatgaccaaaccgaaagattaaaccctgcttcgtagtgattccaaaggagggcagccgcacggaccctaaatcaataataaaactataatatgagtggtgagatggcactaaatatcaagtgccaaaatgaaatatgtgctgactgatttgtactcccttgtgtcttttttacttgtctagtacaactgagagagtatcaaatgcacatgttgttaccattctctttgtctaatcatatatctataagaattagtagaaatataactaaaatgccaaatttaacaaactcatttccacatatcaaatcttattatttttttcgatattttagctggtaaagatttttgaggtttgcatgtattctaatacaacaccgaaaaagaacagaggggttatgcattgtaaaagttgtgccttgaatggtttacgctgttctacacggtacatgtgacatgttcaagagcttgggagtgcaactcttgcagtgtggatggcctcatggcaatccagtaggtctgaacagaatcaagcaatattttcattgtcattaattaagcaatagatgccattgtttccatgaaaagtagctgcactggtctgtcactgtcattgttaagttgtccgttagcataattcacctctcaagaaaacccctacattttgatcctgaattcattgctgacatgtcattgtcctgattgacaggctaaatattatactaggctacttggagtctttgatccactggtggagaaaccatctttcgtcggtcggccaaattccacaatagtcccggatgcaataaaaaccgaggctaaagatgatttttagtcccggttcaaaagggtaatgggcatatttgatctttagtcccggttggtcaccatctttagtcccggttcaaatgctgtcagggcctgtcaggccccccgggatctttagtgatcgtaactttagtcccggttggtagatctcggggatctttagccccggttggtaacaccaaccggaattaaagtcccacccctatatatatatgtcttcttcctcctccagctgcccgagcaagcttcaaaatttcttcaaaaaagagggtaggtcatgccaaaatttctagtgaatttattttggtaattacatacaaatcggaggtgcctaaaaagtttgcaacttcatcctccaatgttttttttgtcatattacatttgcagttatgttttgcacacttttttgtctctaaaatttagttgtaagttgatgagagagaaaatttgtgtgggttagaaagaatatatacaaatttagttgatttgataaagaaggttttataaaatagttgagaaggaaaactatagtgaaagttaatcttgaatactagaaaacaaactaaaatgaaaattaaaagaagtaaaacacattaaaattagtttaaaactttagaaatagtaaataagaattatttggtgtaatattttatgatttttgtatgaataaagatgtgtcattattgtatgactgttgaaacagtttgtaattatcttataattattgtatgactgtcattattgtaagaataattatttgtgtacgatttttttcgactcatgtagatggatcggcaatggatgtacgctgaccggcggtccaaagagtttattgacggcgtgcactattttttgagagtggccgaagctaataggcaaaggggttttatttgttgtccatgcaataagtgtaagaatcagaaggagtattctgcatccaggactattcatttccacttgtttgagtcggggtttatgccaagctataattgttggacatcccacggagagcaaggtattgaaatggaagaagatgaagtggaagacgacaatattccggactttgctcagtacgttggatttgaaggaaatcaaacgggcgaggaggaaagggatgctgatggtaacgacgttgcggatgatcttggtcagatgttgcaggatgccaaggaggactgcgaaagtgaaaagggggcccataaattggacaagatgttagaggaccacagaacttcgttatacccaggttgcgagcaggggcacaaaaagttggataccactctggagttcttgcaatggaaggcaaaaaatggggttagtgacaaggcatttggcgatttattgaaactcgtcaagaacattcttccggagggaaacaaattgccccagacaacgtacgaggctaagaagatagtctgcccgctaggactggaagttcagaagattcacgcatgtccgaatgattgtatcctatatcgcggtgaggagtatgagaacctagaagcatgccctgtttgcaaagcactacgatacaagattagacgagacgatccaggagaagttgacgggcagctaacaaagaagagaattcctgctaaggtgatgtggtatttccctataataccacggctaaggtgtttgttcaggaataaggggaatgctagaatgatgcgatggcacgctgaagagcgtcaacaggacgggatgctgagacaccccgccgatggttcgcagtggcgaaacatcgacagaaaatttaaagaatttggaaaggacgcacgaaacatacggtttgatttgagtacggatggcatgaatccttttggagagatgagcagcggccatagcacttggcccgttacgatgtgtatctataaccttcccccctggctatgcatgaagaggaagtacataatgatgccgattattattcaaggccccaagcaacctggtaacgacatcgatgtgtacctaagaccactggtcgaagatcttaaactgttgtggaagaaggaaggtgtccccgtgtgggacaacgacaaacaggaggagtttaacctacgagcgctgctgttcgtaaccagcaacgattggcctgcacttagcaacctatccggacagtccaacaaggggtacaaggcttgcactcactgtatggatgaaacagaaagtacgtatcttaagcactgtaggaaggttgtttacatgggtcatcgtcgattccttgtagcaaaccatccggtacggaagaaaggcaagcacttcgaacataaggctaaccaccgtacgaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttacccaattgggaattcttggacgtacgccacgcaatcgacgtgatgcacctcactaagaacctttgcgtaaaccttcttggcttcctaggtgtacacggaaagtcgaaagatacactggaagcacgtaatgatctgaagcatatggaagaacgcggcgaccttcagccggaaccaaaggagaaaggaagccattacttgagtccagccagctacactcttagtatggcagagaaggaaagtatgtttgaatgcttggagagcataaaggtaccgtctggataccccacgaatatcaagcgaataataagcacgaaggaaaagaagttcacaaacctaaagtctcatgactgtcacgtgttgatgacacaactgctaccagttgtaataaggggtatccttccagacaatgtccgggcaacgataacaaagatatgtgcattcatgaacgcaatttcgcagaaggtcatcgatccggatagattagaagcccttcagaatgatgtggtgcaatgtctcgtcagttttgagttgatatttccaccttcatttttcaatataatgacgcatctgctttgtcaccttgtgaaagagatcagtattctcgggcctgtgtacctacacaacatgtcctttcgagaggtacatgggcattctgaagaagtatgttcgtaaccgtgctcgtccagaggcaagcatcgccaagggttatggaacagaggaggtcatcgaattttgcgtagaatttatcgaagatcttcgctcaatcggggtacctgaatcacgccatgaaggaagactacggggaaagggaactctcggaaggaaagcaataatgacggtagacaacgatttattccgtaaagcccatttcacggttctgcaacaatcttcattggtagctccttatgtcgaggagcacttggctctagttcgcgccaggaacatcggtaagtccgatgcatggattacatggcatcacattgatactttccccgcgtggctacgacaacatttn

SEQ ID NO: 285 - DNA, 2749 bp, Oryza sativa
  unsure (1)..(2749): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgggttaggttgactggtggaggcgtaatgattgatgacagtgggatgacaacggttgaccttaacaaggttggatactcggacgaaccttttgtccttgccaatgatgtaacgcaagtctttttcgtgaaggacatgtctagcaaaggaaagaagggcagatggcctaacgagcctaagtgtcatgtggttctcccaagcaaaagaaaaatcgtcggagttgaggacaagactgacgaggattacgatcagttggatgggcaaccccctttcacggtgacgattgaccctagcatcctcctatcaaatgaagacaccccttactcacgtagcgatcacaagaagggaacaatagtgaggagaaagtacgtgcggtcaaccgtcaccgccgatgtattgccgtaattattgtgtacacgatgtaaactattttggatgtattgattatccatataaatcaattgatgtatggcatatgttaattacgcacgattattagaggttttaacaagtttaaatcatgtatatgctagttatatgcgatacttacaatttttaaaagttttaaatcacgcaggtggcaatttcatatgttaattagagtttttaacatttaatttactatcattcatatgcatgtggcatttacatatgctaattataattgactagagaatttttaaaagtttcaaatcatgcatgtggcatttacatatgttaattagagtttttcacaatttaatttactatcattcatatgctaattatatatgactattcgaatttttaaaatttttaaatcatgcatgtggtatttacatatgttaattagagtttttaacaattaatttaatataattcctatgctaagtatatatgatgattacaatttttattaattttaaatcatgccgtatgtatatacatatgttaattagagtttttacgaatttaataatatcattcatatgctaagtatatatgattattagaatttttattaattttaaatcatatatttgcttattacgatttatccacttaatttattacagacaacagtaatttttcgaagtaattgtcattaatctttgtactttaaataattgtaatgcattatcttctattttagaaacacatatgtaatggaaaataatattcagtgcgcttatcagtagtcccggttcttaaccctaaccgggtttaaaaagaatttgaaaatagcgggaaaagatctttagtctcggttgatgagaacaaccgggactaaacaaccgggactaaatctttagtcccggttgttctcatcaaccgggactaaagatctaggggtatatatattcccgatgcgcgccctcgtcttctccactaacacttagaagtttttgcccgatcaatctctctcggcttctccttcgccgccactgcctagggcatccccgcgccgacgccgccgccgtatctcgccgtcgtctcgcgctcgtcgtcgtcgccgccgcctccgcctcctccgccgccgccgcatctttggggtgagagccgccgccgtgcagcgcccgttccgtcatggcgcctagcgggaaaactatctcttaaaaaccctaattgcgaaatctggatctttgcttgttgtctaacgtctgggccatctcagatctcgaatccccgatctatcgtcaagttcaatcccgaatccaaatccttcccaaatcaattccctctgcaaaagtctattttgcctccctcgggttcgatgggccgaatttctctcggaccatctgtgcctacctccccatgtgtatctccctctctctctctctctccccgctctgcccgtgagccgcgccgagccctccctctccactctcgctgccgttcccgccgacgccgccaaatcgtcgccgcgcgccgttgcttcccgcgcgcacgcgccatggtggccgaccggccagtcgccgccgccgtcagatacaacattaagcaacacttgacagatgatgggatcagccaggcctgggtggccgtttgaaagctgttggccggatgtcaaccttgatcaattcaaaagactgataccttgcacatactccgaccggacgagacgcactgtctcatccgtgtcgtttgagaagcactcacttagttgtttcagaaaagagtttaaataaaatcaattgcaaaaacaacagcctttccgttgaagcctgcattaaacacttatttcccacggcttgctgagtactcctgtactcacccttgctctatataaataatcccccccagttgctgaagaagatgaagcggatcccgctgacgaggagttcttccaggagcaagtcggctacgatgagttttcgggtttcggcctagttcccaagtcgcgcctgtgatgtttggtccaagtcttggcttccgcttcccttttgtaatgccagtgggagctcgg

SEQ ID NO: 286 - DNA, 16494 bp, Oryza sativa
  unsure (1)..(16494): unsure at all n locations
agcggntttgttgtgatacaacnnnnnnnnnnnnnnnnnnnnnnnnnnnnnnnnnnnnnnnnnnnnnnnnnnnnnnnnnnnnnntgagaacgagcgaacgaacgtgaacgataacgtgaacgagcgaacgaacgtgaacgtgaaatgcaattataggcagatgaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcagagtcatctctcaagccggagtggtagagctagccctcgaaggaattcgcgcaggcaagtgacgtaattatatatatgattgttatatttgtaatgcaattaagattattagatttgtaattagacttagcatataagattgtgtagtgttctaatatacgacagttacacttagcatacatgactatttgagttttagtataagattatttaagttttaatacaagattattatatttgtaattagacttagtatataattattgactagctagggtcctataatatatgtcacctagacttagcatatatcactatttgagttttagtataagattattagatttgtaattagacttagcatgtaagattgtgtagggttctaatatacgacagttacacttagcatacatgactattttagtcttagcatataaaattatttgagttttgatataagattattatatttgtaattagacttagtatataattattgactagctagggtcctataatatacgtcatctagacttagcatatatcactatttgagttttagtataagattattagatttgtaattagacttagcatgtaagattgtgtagggttctaatatacgacagttacacttagcatacatgactattttagtcttagcatataagattatttgagttttaatataagattgttaaaacataaatgtctcatgacttagcagatgtttcctgtatgaacagatggctaatcgcgatgaggaacaaatattgtacgatacaatcgcggagggaagtagccagtactggaacgaagaagaggggaacgaggatccaaaccagtatttgaacgaggaagggaacgtggagagggatgcagaggggaaccaggaggggcacgtggaaagggatgtggaggggaaccaggaggagaaggctagtggaagtcaaccctccgttggacagaagagggcacgcgggtaacgaggtaccacgaagaagcttgagggtcggcacatcataacggaagtggaagaagatggacgacctagtgccccggcagaagccgccaagaactatgtatgtcacagtggttgggttgtgcgggataacgtgcctgtcagtacggtgtactggcaaagaacaagggcacgcagagatcatgagagctttgtcccagattcgaagaaagagatgctgtggaccacaatgctcgagacattcacccttcccgcgggtagagaggacaaagtgaaaaggtggactctgaagaaaatggcagaacagtttcagagcttcaagggagatctgtaccagaaatatatcctgaaggggcagacaccgaacttcgacacattcccaaagctaagggatcactgggacgagttcgttgcatataagacaggtgaacaagggcaggcgataatggaaagaaacaaagaaaatgccgccaagaagaagtaccatcaccacttggggtcaggcggctatagcgttgcgatgccgaagtgggaggagatggaggcaagcttgcttgagaggggtatcgaaccggccaccgctaattagccggaacgatcgaagttctggtactatgctcacggtggaacgctcaacccagctgatggcccactggtcttcggcgatcagatacaagaggctgcgcgttgactagcagacgcagtggaagcctcttcttagggcacgttccgaccggacagagagagggacgagctgtcactcgccctgcagactccagagcatccaggacgaacacgagcgaaaggggtgattccttggaagattaggttcaaggaggacatccacacgtacaggagtcggatgaggagcaagagagataccaaggtgaagattgcagatctagagttcagggtatcgagctacgagcgcagcatgcaagaggaggtggcaaggaaggttgatgaacgcatggccgcacatcggtcccatgatccccagccgaccattcctcctgcaatggtgagcccgtcaggaaaccgtagcagctgcgcctcaatggggcaggtaggatcacagagtatggacgccatacaaacccaggacgaatccacttgccccgttgatgacatcattcagtggacaccatgtgagctgcatattcctttcaagaacttatcaataaaggtaagctcgtagtttatatattttagatttggccattccgctagttgctgcttatatatgttgattactaataaataacctctcaccacatgaaggtggcgtcgggcatggccatcccaatggacctttcaggtacttaccactgcaggccgattccagcaggatactccaaggtcgaagttgagttggtcgaaggcgcgtacgaggacctcgcgctggattaccctggaggagacggtgagacgcatctacgagacacaagccatgccattattctatggcgcaggcggtacatcatcctccctgggcgacaagcggcgtctcatgcaccatctcctccggctctgccatctcctcctcaggcttcagcaccgtctccacctcaggctcctacaccgactcctcctcaggctcctgcaccgtctccaccttaggctcctgcaccgactcctcctcatgctccagcaccgtctccaccttaggctcctgcaccgactcctccgcaagctcctcttccggcaccttcaaagtcaagggccccccaagctccaccgcttgcccacacaagggcaacgaagaaggcgaaagttgacgccgccaagaacaaagacctaattaattaaaggatgacattctctggatcaatttcaagggaatctacgaactataccagctggatgccctcgacgtctctattatgagttgctggattttgtaagtatatcgttcagttagatttcttactacgtctcctttaattaattaggtccttgtatataagtagactatagaaaataatatactcccttttatcattgtagaatggagattcaaagggcccgacggcggggggttttcgatactggattcatcgaccctcggaaagtaaacgtcgcaatgctcgaccaatatccgcaagccacagaggacaatctcgtccatctcctaaaggcgcagcattacaagacgttcatactgttgccgtacaacacagagttagtttaattttactgtcttcctataccaaatttcattcccgtatgaacttgctaagtgtttcatatgtaatgcatcccacgcacattgtagattccactgggtgcttttactcttcgacctgtcggcctgcaccgtcaatgtatatgactcaatggataaaaaagagtctacgtttgacaaggttttcgaacttatagacaggtactgtcataagttcctctgttaattaagaaaatcttgttatgttaattgctactacgaatcatagctttaaactccatgtagggcttggtatcggttccgtcatttggtccgcggcaactggagagaaagacttaggcggaagttcaaattttctgtgagtacacatgctctacatttatatttctccgattcaaatacatacaagtgtatattaattagatctctcgtcgtttgtcatttatttgtagtgcgcaaagcaaaagcagttcaaagcacttaggtattaacattaaccactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattattataactaggtatatactcacaatttgaaaattttgaaaaatttgagtgattttgtgcatttgataccatggtgccgggcaccatggtgccctatatgagtgtctatatatatatatatatatatatatatatatatatatatatatagacacacacacacatacatacatatgcatttgcaaaacatatatatgtataaatacatatatattatgcatgtacatatgtattgaaacatatataaatataatatatatatatatatatatatatatatatatatatatatatatgcatatattatatatgcatatatatgtattgaaacatatatatgcatggtttatatatatatatatatatatatatataaaccatacagtaatagggccatacaaaaaaaaaggttagctcgatctttagtcccggttgatgttatcaaccgggactaaagatcgatctttagtcccgattatttcacccgggactaaagatagcgatctttagtttcggattggtagtcccagtttagaaaccaggactaaagagaagttacgaaccgggactacaaagggtttctccaccagtgaatatcgcgtccttgtcactgggcataggagcgctgcctatgatcagcacgggtaagtacaaatttatactcgcattaaaacattgacatgtgctcatacatgcataaatataaattgttctgcctatgtatatatcataggagtatatgatacaccaggtacaggggatatacattatttttcctttttaaatttcccactaacagtaacagattgtcttttattttcctttgtaacaaatatgcatgtcttggacacttgtttttggggcggggtcatgctcattttatctgcaggtttgtccatgggaagtcaggaaagtatcatagcttgtgatctgtgcggctgcatcctgggacaggttttgaagtttgctcttggacccattgcgatgaccattgcatccaaaattgttggccttcacggcaacaaactccgggctgccatcatacaggtatctaattacaatgttatttgtagtcagacgtttagagaccaaacgcaactttctcacgacacatttccatattaccttccaactacgctctttaatctttttcttttcttgcttcgatgatggaaatccaacccttcttaattacctgcttgaatattcagaaagcgagcgcggttgataatggttgaaagtagcttttctttaccatggcaagacgattgataattgttaatctttttttccctgagattgataacttttaatcttgatcacttcctagcttagatttactcaaatagttaagttcacaatggtcagatttttaaaagaacataatggccagttttttctgtgttcaaacataatggtcagagactcagagttaatcttagctttacccaaattggaacgtttcggactctcctatgttagctcgccattgtaatcctgttctacgcaaggaaaactgatgatctcttgatctgtgcaaacattttgcaggctgctgtaccacaagccatttcatcattcatatttgcaaaagaatacgggctgcatcctgagattattatcaccgcgtaagatcttccaactgatttactaattaagtgagaaagtatatactccctctgtttctaaatatttgacgccgttgacttttttaaatatgtttgatcattcgtcttatttaaaaaaattaagcaattattaattttttttcatatcatttgattcatggttaaatatactttcacgtatacatatagttttacatattgcataattctttttaataagacgaatggtcaaacatatgctaaaaagacaacggtatcaaacatttagaaacggagagagtcctcgtttcgacgttaccatcctaactgcttaattaattcaatctgcagggtgattatcgggatgcttctcgctgtgctgttcctacctctatactacgtaatcttacggcttactacataaggcaaaatctcctgcctttccttaaaaaaattcttatggcttactctatctagacattcagatgacagcagggagtatagatacagaaggaaaagagagataccatgtagtgggtgaaatgcgtagacagtgtatacgtactgtatgattgtaatttgtaagaaaaatagagctacttcctccgtccctaaaaaacgaatctaatacatgtgacatattctagtacaatgaatttggacggatgtatgtacagattcgtaatattaggatatgtcacattcagtactaggttgattttttataggatagagggagtacgtgtgaaatgtgtggacagcgaataagtacggaatgattgttgtaacggtttgctttaagcgaatatacagatttgaatgattttttcctcaattttgatgcaagccatttgcgagcgcgcgcacacacagatagcgttggctctgtgatgaattctcgaataatactccctagctcagttttatgatataagtcaaactgttttaagtttgtctaagtttatagtcaaatatagtaatatttataatactaaattagtttcatcaaatcaataattaaatatatttttataataaatttgtcttgggttgaaaatgttactattttttttagaaacttagttaaatttaaaatagtaaaagtcaaaaagtcaaaacgttttataacctaaaacggagggaataatacattttgtgttgtccatgcaatcgattagtgttaagtaccagcagtacctgatcaacaattaagcttcagcttgagcggttttcagctctgaacaactgttcgtcgtgttctgttccatcttttctctatgtctcttgcagggtttacattaccgtcggtaatcacgcggttaccagttttatcgtggggtacggtaaaaaaaccacggtaaccaccttaaatttaaataaatttagaaaataatttaaattttaaattagaaaataatttaaattttaccgtggttaccgtgcctaccgtcggggaaaccctggtctccggtgatgaaggaaaagggactcgatctgcaatttttcagccccatctgtcactatctgaaaactgaagcagcactgaactgcatcagagaaggctgggcctaaagtgggctctggcccgcatgaaggcctgctatgaatcttgctgttggtggaatggactcaattagttagcgatccaagagagcgtcctccttgtaattaagccatttgggccattactatcagtttcaaacccaatacacacttgggctcagaaacgaggtaaggctacatttagaacaggaataattctgacctaaaatttcagctgcatcgcacacaagtcaggaagaaagattcattcttgcacattctgattctggagttggcacctttaatttctaagttttgttgcacatgaaactctttcattattccttcaaaaaaaaactctatcagtattttctctcaattgagtgccaggttgtatgaaaaccaattcatctcctttattttattcagaagaaagggaagaaaacgttctttcagaaaaaaaaaggggaagaaactaacgaagtcagaagcagactaattaattaatttaattccacactgcaatcagtgggaagtactgaagaaagctatagcttgctacaaaataattaagtggtactattttttgcctggtggatacaacattaagcaacacttgacaaatgattaactaaagtttcaagaattaatcaagactggctgcacgtgactaatttatacagctccaatttaaggttgttagttagggcacgattaatgtcgtaatgaaggcatacttaatgtagtctctccctgcaaaaaaaataggtactaattttaatattctaattacatgcagggacttgctgcaaaaataggataacagcataggttatattgattcctgtttttcaacgaaatggtatacccttttttagccaaaaaaaacctatagagttaataatggaaatcccctagaaattaattatgatcactagctagctggtatctctgctagctagctaagccactctctaagcttaattaattagttggttcagtaccagtactatgccccgatgcaaaatagttaaggcatcgcttggactgcaaggatttttcacaggaaatttgaacaaaatctcatagcaaatatgaacatttctcgagatcaagacatgcctagctggctaattatttattgatttatgggatgtcttcactatttcctatagtaaaaggaagcatgaccaaactttaagctctacaagaaaaccatgatttctcaggtcgaggttccatctagaaagtgactttttgaaaacaaagatgcattatgcatggtccatagtcttttcgcgaatgaaacaaacaagaaagaaaagcaaataatcaaagaaagaaagccctggctactggaaaagtactagctggttaattacagatgagatctaaattaaagcatcagcccctgcccatatagatcatgaaaaatgaagtgggacacacatatgctaccctttttttacaaatcatattatgagatcagtgttggttttcaacaggtaattatttatattgatttatataaaagagataatctatcatattcagaccacaacagcactaattttcatattgctaatgattgaatttgacatctcgatattataatcttgctagcattgtgcaatgttaggttgatcatgtgtgtggctggtttcatatatatgcattaaactcatcctagctagaaaagcttttaaaaggatttctcatccagaatatatatatataggtttttagcaggtcaatgtatgggcaaatgaaatacttatgataaaacttttaggtgttgaaagaatacatgagactaatataagtgcaaaggtcaatgtgcaaatgagaattacaatccatgcaaaagaggattcttcttccacacagaaaacaatatgcatcattggttctgtaaaggtcacgacaactagccgattggatgaattaatgggactaataagctttagtttcaccagctctctcatcaaagagagaaagctaaaaaggtgcttagacttgcagggcgaaggctcccatttgagcatatctttttgcaaaaagcacgcaagaaatgaagcaaaggtgttgaagaacatggaaactgggtaccaaattgagcatgagttagttaggccttttcttgcacaatttcttgaattagcacacaaaggtggagtgaagatcaattagtactaattaattagtataattgtgcaatgatatttaattaccatgaatttaattataagagagatgatattataatgtatcccttttcatcttatttgtgtctaacaatgcaaaaggcatcaacatgcattccaaaccactggcttctgctccatcatgagtgcttcacttggcagttcctattccttgtgctaatgatgtgaacagtacatatacttctattatagagttgtattgggatcttgctttgtgctaacaaccaaaggtggtgatggccaaatcctagggggcaagatttcatacttcaactgtccaacacttgcttgaaggattgcaaagctatcgggcccttctatatatcaacaagccatgtctccatttccttttttgacacttaaaaagggattaattatttgtggtagaaaaatgctagatattgttgaagacagttgtatctaaagcagggatatttagatatacctaatgtggtatttaataagtcatttttggcatgtcaaaaaatctatgcaaactttgaagtatcattcacaagctatagcaagtttggcatatattagttttaccaaaatatgtgaatttcaaggccagtgagtgattctattcatatgtctacatatagtatatatgttcaggaactcaaactcgggatttgaagtgtcataaattatttattttattcaatttccacatattcttttagcttggatatactaagttcaaaacataaaacttgttctattcaatacaaatatatatgactgcaaacctagctagctagaagttaatccaatactgaaaatgcagatgtgaatccatcaatgcagcacacgattaaaattttcatatatatatgcgtgcgtggttagggatgttgcatgcatgattgcaactgctacgctgaacttgaaagcttaaatgagaaagcattgtccttagattgttggcccaggttggaaaacactccttttgttttcttccgtcttaccatgacctatatatggggacactcgatctctcggaaaaaatagctatcaatggcaagcagtctgttggtaaagagttttaccgacactcaacctgccacgagcatctgccaggggttcaacagtcaagaaaaatatttaccaacagacttcttatttattggcagatgggtgctgataattttatagttttttccgacagatattgtatttcggtagatggggatctccaccatgtcgtcctcccggtggctacaccctcgtccatgtccaccttgtagcagctccgttgcacctctacccactcgctcggctggcttgcttcgccgcctcctcgtgccaaaaccctagaggctacgccttgcctagcagtgtggtgagggagacaggtgttttttcttgtcacaggaaccttatcctatccaccccaatatctgacacgccctagtgatatagcaacagacagctcgtcggtccaagatctttaccgagtacctacagatagtccgtcactttcttttactgacagattgtttgacatagttatctttttaccgatagattgttttgccaggatatttaccggcagactgacttgtaccaatagtccatttttcccaacaaactattgccttctatttggtgttgcggtgtagtgtatatactgatcaccagatgatcaatgctatagtatgaatatatttaataattacagcaaatagaaattttaccgttcactaattcaattttagtgtgtcacatcactaggggaggggtaagaataaaagctctaaaaactcgcggctcagctcgaatcaagctcatagtcctaacgaggcaagtcaagctgcgcttttatctctttagtttagcgagctagctcacgagcatcatatcttctttttatacttgcttcttaaccaatacttagtcctttatttattttaaaactatttgtatttagtttttttattagttaatattttattattatattatgaatcggtaaatttaaaactatagagccagtaatattaatataaattagataaaatttattgacaaacctaacaatcttaatgaaccagtttgcaaaccgaggcaagctagcacgtttattaaggtatcgagcctaataagtcgagccttaatgaatcgagctggctcattacccacacttacacatcatagggtttgggtcaacaacatgagcatatgctgttaaaattaaaacttagagaataattatgtcagggttatggatacctaatagtagttgactaaatctcggcaggacccaccacataccatgttttatacggaaacaaccttcgggtatagaaggagttccggataaagaaagataaatagagttctacatggacaacatagacgccacaaagccacaagccaatacaagccaacatacgccaagtcaaactgccagatatcgacatcagagataagtctaggaaaaccccatatggtacctacgggaaccaaagagaggaatctagcgctgtctctgacctcgccggatgtggattcgaggaggaaggctaccctgttgttgactacgagtcagaacttcagaccaccatgtcgacaacagatagataagctaccccaaatattgtactggtgtgattatggtgaataagagcaacgaccggcttcggtcaacaggagtagggttattacctgacaattcaggggcccgaacctgtataaaaatccccgtctccatcttttttactacaatctcgtatataccctggtatcaacaatccccacactatacaaatatcggaatcgcgacatcaaacatcgacaaattatatatgttattgtgtcaaatgcaagaggacaagttgcacggtttattatacattcaaactccgatcaaattaattagtggtttgataaacaattttctacatgcagtttgcatagtgtcaaatagtcattcagacagggctcattagttatacatgtactccctccattccatataaaccacttttcttagatgttccataatactccataaggcatgcatgcatataggcaattaactatgaccccttctccattaaattattacttttttaatcctccactctcatgttctttaattctattggatgcatgcattgtatttattaggatgatccaaactacaagatgataataattatttcttagtctttgtgttaggggtggttatgccttatattttggaatggagggagtatttatctcgtgacagtttcgcatgaaacaaagaattaaattttaattaccagaactctcataatctttattttcaattggaacctatatatatttctctaatttcaagataaacccaatggagcctgctttattaaatttcttacaaattatttttatatttattaaatttcaggagaagctatcaaagctagctggaatatcctattaaattgtctcaatgtgctagatgacagcatgatattaggggtagagaaagagagagatgtgatggcaaagatagtacatggagtactcactttcctgcctccccttcctatctttctggaccctagcagctaattgcatctgctaacgacctgtaattgcaaccaacctacatatattttgaccagtgacagtgactgttcctcctacttcattcatgcatgcacatgatactcatcatctctctccaacaccacactgatcactagtcactcaggcaagtactagctgcatgcacctttcagacacttcaatatatttattcataagctcatcaatgtgacttcatgtgcaagggaagcagttggtgcatgaaaggaaagaggaagcaaagaaacaaaacaggggaaactttaccctgaagaaaatttttataaaaaggtgaagcattatctacagtgtttagccctaattctaaactaacttctaaacatgaacacccacataattaaggcatctaactatatatttaattatgatatcgctatatatgcaaggctgtcgatattctgatccgtatcctagtatcttatggtgctgcgatcctaccaaatcaaaatgataccgatctcatctagtatcttaattttttatagtatcttgatcttactatttatttccagacgattctatgaaatcttaggtagtatctcgattctacgatccatacaatcctacaaaatattatttaaaataaggtggattgaaaataatttgaataaatacgctcaagtttacataaaaccaattaaattgatcaaaatcaatattatatgctttaatttatacaacatactttatactttatattaaattatgtactttctaaaatctggtagtatttcgatcctgtgatactacaaataaaaaaaacgatcttacctagtatcttgatactgagtatatatacaactcaagttcttttagttatttgcatgactacataactctataattttgtgtacaaggatgaatttcaagatatttatatatatgcaagatcaaaagtggagttggtgtgagaaatcttgtacatttggaagagagaatatatgtgtcaatggaaaaaaatactaccttcaatgtgtatgtatgtatatatatgtataattgtatatatatgcaatgtactcctttggcagctatagatggggcccctccctctcaatcattcaacttggaaatcaaggaaaggcaaggatgacacatctttcatcagctcctccaagtcccactctcccatgacattcctgctcatgtgctgctgctgctgctgcagcatctgatgctgctgctgctgttgttggtggtgaccctcccaatagatcatgttgctgctgctgttcattaggctaatgcagcagctgctgctgatgttgttgttattatcactgttgttcttgttgctgttgctgttgtctgtgatgttgctgctcagtgtggccgcggtcgtgttgctgccggttttgttagggtggtcgtcgtcgtcgtcgagaatggtttggtggtctaggagaggtggcactgatgcgccgccaaagaggatgctgctgctgtgatggtgatgatctcctattaagcttgatccgtccatggtggcgatcgcgtggtggtggtggtgggcgccggttgatccgtagtatgcttgcttgatggagatggagtggtcgtggaagaacggcggtggcggcgaggtgtcgacgccgcagacctggtcggggagtgggaggaggccgccgtagctcctccccgccgccgccgccgccattatcgacggccggctctgcatcgacgaggaagacgacgacgacgacgacgaggaatccacccacatgctcttcatggcagcattagctgtcccgacaacgacgtcgtccgtggcgccgccgccgccggcgaggtcgacgacggcgccgagcttgtgctccggcggggaggcgcagtcggtggtggtggccggagacgccgaggaggaggagatcttgaggcgcttcttgatggtggagttccagaagttcttgatctcgttgtcggtgcgccccggtagccgggcagcgatctgagaccacctgcaataattccatgcgtcgtagtacggtagatttttcatcagtgagcaaacgagatgtttctgtcaagaattattatccaagcttagctatagctatggttgtagtacaaaagattaattaaataaaaaggttaattagctgcatgcacatatatgtcaatgcgccttaattaatcttctttttatgcatgcatgcatgcatgcataagcgcataagcatgattaatctagtatttacttccaaaaaaaaataaagataaaatatatatgattttctccgtttcaaattacttgttgttttacttaaaaaaattacttgtcgttataactttgcagtaagtcaaacatttctaaccttcatcatcaattctctagaaatttatacagttattaccataataagatttattttctaaattcattatatatgagaaatattttcataatatataattcacatgttaaactgtatacgaatttttgaaaatttatgatgaatatttgactttatacaaagctaaaatgaaaaggtttttttaggtaaaacgaaaagcatatatatatatatatatatatatatatatatatatatatatatatatatatatatatatatatatatataggttagttttacatgtgagaaagtacgtagaggtaattagtcgatgtcataatctcatttctggtaagacaaggattaatcaataattatggatgattggatccgacaaatttgcatatgtctttcagggttaattagaacgtatacaagtatgaagtatccctttcggtgtcttttcaggcaacttttagtttctacgttacatatatatcagttttgtaattatgcatggtgtacgacatttcatgcaaaattaagcagaagaaaaaaaagaattaatcaagaaatattttgattgatatatccaggactcatgttgttctcatagccctttgagacttgagacacatgtctgtatatatattaatattctaataatcaaatttttttaacttatgtcacatattataaatgtatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaatttcaatnnntggnccca

SEQ ID NO: 287 - DNA, 798 bp, Oryza sativa
  unsure (1)..(798): unsure at all n locations
tgcacggtnnnnnntttgaatacactacnnnnnnnnnnnnnnnnnnnnnnnnnnnnnnnnnnnnnnnnnnnnnnnnnnnnnnnnnagtataagattattagatttgtaattagacttagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgatgataggtatccagttttccgctcctaggtctgcatattggacttttcctcttact

SEQ ID NO: 288 - DNA, 621 bp, Oryza sativa
  unsure (1)..(621): unsure at all n locations
ggtccccccnattganatcgataccgcatnnnnnnnnnnnnnnnnnnnnnnnnnnnnnnnnnnnnnnatgcaacatccctaaccacgcacgcatatatatatgaaaattttaatcgtgtgctgcattgatnnnnnnnnnnnnnnnnnnnnnnnnnnnnnnnnnnnnnnnnnnnnnnnnnnnnnnnnnnctgatgaatcccctaatgattttggtaaaaatcattaagttaaggtggatacacatcttgtcatatgatcaaatggtttcgcgaaaaatcaataatcagacaacaaaatgtgcgaactcgatattttacacgactctctttaccaattctgccccgaattacacttaaaacgactcaacagcttaacgttggcttgccacgcattacttgactgtaaaactctcactcttaccgaacttggccgtaacctgtcaaccaaagcgagaacaaaacataacatcaaacgaatcgaccgattgttaggtaatcgtcaccttcacaaagagcgactcgctgtataccgttggcatgctagctttatctgttcgggcaatacgatgcccattgtactttgtgactggtctgatattcgcgagcaaaaacgatttatggg

SEQ ID NO: 289 - DNA, 603 bp, Oryza sativa
  unsure (1)..(603): unsure at all n locations
atttgannnnnnnnnnnnnnnnnnnnnnnnnnnnnnnnnnnnnnnnnnnnnnnnnnntaaatattgggcataattaagcagaaagtcgtgacacttaattagcgactttatagcaaagttgtcacatggtaaatttcgaacttcagttcctgtttgttctttctcaccgaaagagatcaagttgttccctctataaagaaagggccagtaggcgccactcgtgcagaacgtgttgatttgtttttgcatatttgcatatactatattgtttgaaaggcatgtttatatatattttgtctagtttcgtgcatattggcgaccttcagtcccactatctggtcaccccaaccaaatctggccccacttacataatcagtatggttgagctggctgtttccggttgggtcaattaagatgggacagcatctatatataggatgattggatttgtagtttaattaaatctccaaatagcaaaagtggatgctccacaattattggggaagatataatggtcaaataattgtgataaaatattatatcaataaaataaattgaaaaccctgtataatgtgtcacaggaaattaattagctttggttan

SEQ ID NO: 290 - DNA, 695 bp, Oryza sativa
  unsure (1)..(695): unsure at all n locations
cgcgcgcatnnnnnnnnnnnnnnnnnnnnnnnnnnnnnnnnnnnnnnnnnnnnnnnnnnnnnnnnnnnnnnnnnnnnnntacgatcttatctagctctccgagcctttacatttagttcaatagttgatccaaagccagtgctattttctggagcacaagggtacatgcttcgttgggactagagggatttacgacaggacctctgaacataatcagaatgcgtgtactgcacatttaaagagatcaagacatgggagggccgactctctattagccataggggcactcttacgctgggcccattgagcgctagttcgagatcggaaaccttttaactaacagtcaaaatctgacgactcctgatgtgaaaactgtggcgttacccatctgaatctattaacttgagattcacctttgatcagatcagcgtgtgagatattatgctcatatcggtagcgcttgcacttggtagttgaatacgttcggtgcgtgaactggaaatgtctaacttcataaaggacaattgtcgagtggccaattaaaagctttaacgataaactattcggaaacctagcgctcgagacttaaagtatcttgaatggatatataagcgaagagggtggctttcagagagaagaggcaacatagcggttggcgtggaggggtcagattaagcacgcgttgacgcgcccat

SEQ ID NO: 291 - DNA, 701 bp, Oryza sativa
  unsure (1)..(701): unsure at all n locations
ccttggggaaacattatccatccctggaagatccgctggttctttgcaaatctgatttccgcacggcaagttaatggtcacggccatcggcatgcatattgccagtcgcatttgtcgggcaggtaacaaacaggtatgttgccaaatacacaacggccttcggtgaaagtgtggccgttcccctaaatgaagctggcaaggtaactttaccgcttggacaggaggcagtccacccaccgagtgtaatgtccgatggcccccccagtcggcaaacaagtctatccaccagacgctacaggctaatatgttgcgtggtgttcagaccgtaaaccactatgtgcgagggtgtagtcacggccatgatgccgccttctttcatagatatgcctacaccatgtttgaagtatgcaacacagggtggcaagcaatatggtatcctgaccagcacattttataaccccggctgcatgttaggccatccacacaccaagcttaatagatgactccatcgagtaccagaaatatgcaatccaaacaaagagatttggcatcccaccctcgacaaggacttttcccagcacaatagaccaaactcgcatgccacataattacgtgtcttcagctcaaaacatnnnnnnnnnnnnnnnnnnnnnnnnnnnnnnnnnnnnnnnnnnnnngcatgcgcctttcaaatgcgcggc

SEQ ID NO: 292 - DNA, 695 bp, Oryza sativa
  unsure (1)..(695): unsure at all n locations
cgcgtgnattatatagatcataatcactnnnnnnnnnnnnnnnnnnnnnnnnnnnnnnnnnnnnnnnnnnnnnnnnnnnnnnnnnnnatcgtttcgagagtaacttttaattccgctaaaagttttgatttgtgagtacctcaaccattcactagtttttgctggcgaacttacagacctgtaatctactgagcggaaccaaggatccttgatcccagggccctggagtgaaatgtccctaacgaatacacaatctcacgatactcgatcgaacagcacacagatgaatatcgcgcaagaacttgcattctactaaccaggatttctctccttatatgagtactaaaaagaagaggccttgaagccaacgattgcgcacccaccaacgaggaattccacaacgagtactaccgaagggcattccaccacggggccatcaagggcagtgccaaatgggactgcggcagaagggagaaccaccaaaacgctaaccacgcagactacggtagagcacgctactggtgaggaagtaagtcgctgtcaagaaccaccatgacgtcaaccaccacatgttgtgctggatcatatcggccgtgatgaaagacctcgccgtcaagaaccaccacggcaccaaccacgaagtgcgtctgtggtgaggaaggaccttgtcgtcaagaatcaccacgacctcaatg

SEQ ID NO: 293 - DNA, 685 bp, Oryza sativa
  unsure (1)..(685): unsure at all n locations
gacggattgatgacgaatcctatgctnnnnnnnnnnnnnnnnnnnnnnnnnnnnnnnnnnnnnnnnnnnnnnnnnnnnnaaatcgtcgccgcgcgccgttgcttcccgcgcgcacgcgccatggtggccgaccggccagtcgccgccgccgtcagatacaacattaagcaacacttgacagatgatgggatcagccaggcctgggtggccgtttgaaagctgttggccggatgtcaaccttgatcaattcaaaagactgataccttgaatgcacggcgtaactaatttggagccaaattagtcatgggattagctttccggccggatagaacatagtacagaaacgagggtaagcctcactacaccggattaggtcacctgtgatgggtcctaaccatcacctttgaagggccggtttgggcctagtcagagactaatggtcactgttgagtctcagtcacctttgatggtgcccgttagaggtatcaatcacctctgatgggcatgtatttcatgcccgttagaggtatcagtcacctctgatgggcatgtatttccgagcccgtcacaagtgatgatgaccacaccgcagtccgtggttgcaaccccacaggtgacttatctttgaggctgtgacgggtgcattatattcggcctgtcataggtatatcatctttgacggggt

SEQ ID NO: 294 - DNA, 740 bp, Oryza sativa
  unsure (1)..(740): unsure at all n locations
ccgcgtttggatgactnnnnnnnnnnnnnnnnnnnnnnnnnnnnnnnnnnnnnnnnnnnnnnnnnnnnnnnnnnnnnnnnnnnnnnntctgcatattctacgtatgaaacatgtctcaagggtcattccatgcttaaagggaggcccctcaatctatacgcactgccgatagcccactaataatcaagctaatgctgaacgatacatatcctaatcgaactaatctgtacatactttcttctcaacatgatctgactatggctatgcacatttttacccacacaactttactgtctgatgaacttgcaactttatttttccgacatacaagcgtgcagtacgtaaacactgatgtcgtattacacccactacattggatgattatgttgcgaccgtatttagactctcagatgtctttgtaattaccaaatagagtaactcataataatttcatcaacgatcctcttgacataagaacttatgaagcttgcctcagcatctcgtggaataaaagaacgtacatatcatggggaggcactctgatgctgaccggtgagaccgaccggggctagcgattccgatgatgtagcaggcgctactaatctttccagtactaaatgttccagaccgtctgacatgtactatctgtatgagcatccgtgctacttatagggactatcccggatgttagactatatctgttcattaccctttattccccaagtatcaaatgtctttaa

SEQ ID NO: 295 - DNA, 860 bp, Oryza sativa
  unsure (1)..(860): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgaacttgctaagtgtttcatatgtaatgcatcccacgcacattgtagattccactgggtgcttttactcttcgacctgtcggcctgcaccgtcaatgtatatgactcaatggataaaaaagagtctacgtttgacaaggttttcgaacttatagacaggtactgtcataagttcctctgttaattaagaaaatcttgttatgttaattgctactacgaatcatagctttaaactccatgtagggcttggtatcggttccgtcatttggtccgcggcaactggagagaaagacttaggcggaagttcaaattttctgtgagtacacatgctctacatttatatttctccgattcaaatacatacaagtgtatattaattagatctctcgtcgtttgtcatttatttgtagtgcgcaaagcaaaagcagttcaaagcacttaggtattaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 296 - DNA, 866 bp, Oryza sativa
  unsure (1)..(866): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggaagtaagtcgctgtcgggaaccaccacgacgtcggcgggggcatgttgtgctggattgcatcggcggtggggaaggacctcgccgtcaggaaccaccacggcgcctgcggtgaagtgcgtcggtggtggggaaggaccttgccgtcaggaatgaccacgacgtcggcgagggcaggatgcggtgtagcgcagcggtggcggggacaagcgaggagtcggacggagcaaggacgtgcaacggcaagtagcgcggcggcagaatcatagcgtggggaaagtgcagtggtggagtcatagctccgtcgacggctggggatgacctcggcttcggcagcggcggaagggacgaccacggctccggcggtggcggaaagggtcagccacagctccagtggcagctggggaagacctcagctccggtgggggcagcggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 297 - DNA, 910 bp, Oryza sativa
  unsure (1)..(910): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctcatgaaagcggagtgtgcatccatcaccatttgcgaagatgacctttgattattattttgtgattagaaaaaaaggctcgtgcgttgaaacgggtgaaggctattttaatcgtattattgttattttttttatctaaaaagtatatgagatttctattttgatagtattgatatctaatttagaacctttgttgggattatggtcatatactgtacgttgctttcttagggcctgacaagaattctaaagcaattagcggtactcgttccaagttagctgtgagtgttttaaaaggatttcttatacgactcctggtgcattttcaaaagtgaacgaatttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 298 - DNA, 628 bp, Oryza sativa
  unsure (1)..(628): unsure at all n locations
aggcccncccaaatgatatctctttagctatgcactgagagatcccctcataatttccccaaagcgtaaccatgtgtgaataaattttgagctagcagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagt

SEQ ID NO: 299 - DNA, 752 bp, Oryza sativa
  unsure (1)..(752): unsure at all n locations
gtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagnnnnnnnnnnnnnnnnnnnnnnnnnnnnnnnnnnnnnnnnnnnnnnnnnnnnnnnnnnnatataacatgatactgtactatacagcattgtggattagggagttatttaattaannnnnnnnnnnnnnnnnnnnnnnnnnnnnnnnnagggtcggcacgtatcaaacaatnncccctag

SEQ ID NO: 300 - DNA, 738 bp, Oryza sativa
  unsure (1)..(738): unsure at all n locations
gctggcncnnnattggttagcgtcgcgagcaccccgcnnnagaatagaggaattcggcaccccaagaggggaaaacgagaaagaaagaagaggaaaatgtgacattgacatgtgggtcccatatgggtgagtcagccggttggaccgagtcaaagtgccacgtcagcgaaaccgccctccaaaaccgttgagggagccaaattataccggttttaatagttgagggagtcattctacccggtgttctggttaaagggtatgaattagattcggcgtactttgaaggagtcaaactggactttttcctttagttgatagacgtgggctggtgacctcttctttttcgtggtgagtgggtcgcgatggcctcgcagcgacgcggcccacgtacgccactttgactcggcttcggtgtgccggcttgagactttggcttgacgacgtacgtccgtcgcctacgcggcgggatattccgccgcacctcgccaatatcctcctcctcctccctgcatggagatctccggagcttcggctgttggattcttgcgcacggcaccctgcttttcacggtttttgtgttccatgagtgtacgcagcgccataagacgaaactccagattgtcacagttagctgttgagaatatagaaaaactacnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 301 - DNA, 768 bp, Oryza sativa
  unsure (1)..(768): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcaatcagggcgaaacataaagcaccatgtcaaccctgtcctagtaaaagggatttgtatgtgtgtgaaactaaacacacacatcaattggtggcaaaacagaaaagtacttcaaatttaaaagaataaaaatgaaaggcgcccaccgtggggctcgaacccacgaccacaaggttaagagccttgcgctctaccgactgagctagacgggccaggatggtaaatgttacattttcattgttgtatcctttacgttcattcctaccggcacaaatgttaacactagatagatatttaaccattttcactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 302 - DNA, 1135 bp, Oryza sativa
  unsure (1)..(1135): unsure at all n locations
tgtggtnntaagactgacgtcgtgccannnnnnnnnnnnnnnnnnnnnnnnnnnnnnnnnnnnnnctgaggctccagataaaatcatgacgctttgggatttcttctgtcatcaagacaggggagatgattccgctgnnnnnnnnnnnnnnnnnnnncatccaagttggctcagttggcggtggttctggcttgccttaacgaaaatggttgtgtgaacatttgcgcatatatgttgatcatatccctcttaatatttaccacacaagtgttttgattagttatagctatgtatttctaaaaagcaagaaagaagctatgcagcacatttaataatgatggtcgcaagatagctgttttacaaatgcaataaaatcctgaagcatacaaaatagtgagtggcatgacctctctctctaggcctgggaaaccactccaaatgaaattttggcgccatcccctctcataaagaaatgataccagcggagtcctgttccataatcaacaggaaataaatagtctaaagagaaataatctataaacaagtatacctatgtgaaagacaggcatatttcataccacatctccagatggtcgaacattttcaaggtttcatagaggtgcagaggtttctttcactacataactacaggctacagccacagaccacaaagcatgattttggcagttaattgtaaactctcaaacaactaatgcgagatgcttagctacattctgccaacaattcataagtcaggaatacgtcaatttaagcacgataggtttggttcctctcgtaatgtgatctgttcatctaagttcaccagttaacaaacttcagaagactctgttacctgaaaacttcagttgtcactgtcgtggattcagagtactcagtagaaccaactgctacagtcatatcccagtaatcccctctattgggataaaatttcttgcaggtaggcactgaccggcctgaaaagattcaaacaaataactatcaaacggggaagcgaagcgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnan

SEQ ID NO: 303 - DNA, 9107 bp, Oryza sativa
  unsure (1)..(9107): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcgcttcgcttccccgtttgatagttaatttgttgaatcttttcaggccggtcagtgctgcttctagttctagtcttgagtgttctacctgcaagaaattttatcccaatagaggggattactgggatatgactgtagcagttggttctactgagtactctgaatccacgacagtgacaactgaagttttcaggtaacagagtcttctgaagtttgttaagctggtgaacttagatgaacagatcacattacgagaggaaccaaacctatcgtgcttaaattgacgtattcctgacttatgaattgttggcagaatgtagctaagcatctcgcattagttgtttgagagtttacaattaactgccaaaatcatgctttgtggtctgtggctgtagcctgtagttatgtagtgaaagaaacctctgcacctctatgaaaccttgaaaatgttcgaccatctgggagatgtggtatgaaatatgcctgtctttcacataggtatacttgtttatagattatttctctttagactatttatttcctgttgattatggaacaggactccgctggtatcatttctttatgagaggggatggcgccaaaatttcatttggagtggtttcccaggcctagagagagaggtcatgccactcactattttgtatgcttcaggattttattgcatttgtaaaacagctatcttgcgaccatcattattaaatgtgctgcatagcttctttcttgctttttagaaatacatagctataactaatcaaaacacttgtgtggtaaatattaagagggatatgatcaacatatatgcgcaaatgttcacacaaccattttcgttaaggcaagccagaaaagtcctatttgcatccaaactgggtctagctcaatcaggtggttgggttaactgatggactgggaaccagcccgttttttcaacactggaaactaaataagtaagccaccagctgagtttaggagatgatgtactcaaaactctctacctataatatcaatcttggtgctgaacacaacttgtagccatggttaatttattaggttcaattttctttggtataattaaagcatttatgtatcatcttgtgcatgcaagcataatttcttcactttctgaaaaatattgcaacgcgactgcagtttgaaatggctcaaacttatttgaaaccgacaactggagggattatagttgatgcaagttgtggaagtggcctgttttcaagattatttgttaagagtgaactatattctcttgttgtggcactagatttctcagagaacatgttgaagcagtgcaatgaatatgtcaagcaggaaaacatttcagataagtatggtcctcagttccccaatcaccaacatttgtatgtaattcctttgtcatgcttaattcattaagtcgcaatactcatttgtgtccttcgcattgtcttttatgcttcatagcattttttcgtcattattgatttcttctaatgttgaatgctatacttgatgctaacgttgaatgctatttattacttctgtttcaggacattagccttggcgagagctgatatatcccgactcccttttgtgagcggttcaattgatgctgtccatgcagctgctgcgatccattgttggccatccccagcttgtgctgtaagatttctacttgaataacaattttatgtctgtaaaaactcttacgaccttactgtgtctttcagtattgttgagttctacaagctgtttgagttgtttcctatattatgcatttgctgactttgtctttctcagaagaaaaaaaacagaaaaccatactcatttcctcagtgatgttcttctatgcactcaaatacacgtggatggcatattctcttttgtctaattccatctgtagagcccattgaaattgcacatagtgctagaacaagaaaatgctcatacttgtttggttccaaccttcccatagccacatgtatgtgattacacaagcactaaccataggataaacatgaaccaccactaggatacatgaaaacttactcagggtacttattacacatgtattaaggttcacttgataacttactgaagaacaaggaatcatgtttatgaaaaatcacagtacattatttgtggcttttctgtgtgtagaatgtacaatatgtagacttctccagcaacaaatactttttagcaagttgtcaatcgataccttgtgaggaagcgtaacattattattgtcttctttcttttcaggttgcagaaattagtcgagtccttagacctgggggcgttttcgttgcttccactttcgttgcagatattcttccaccagctgtaccggtattgaggataggacgcccggtaatactggaacctaattatccacgactgatgattcgttttaagaagttaaattaatttgcttcctaatgatggtagttatttaaaattggagtgaacctttaatgcttgaacatgtagatattagcatatttaagttaacctatggagtatctggtcctgctatctgtagtatcaccttttggaatctgttttgtttcacacaatcacacttttctcatgaaattatcttgcagtacatcagccaatttaccggcagtaatatcttcttatcagaagcggagttcgaagatctttgcagagcgtgtgggcttattgatttcaagtttgtcagaaatggattctatataatgttctcagctactaaagcaagctaattgatcaactggacagtcctctcaaccttgtcctgaaaatcattgattatgcactgtaagtgaacacactgcattctaattgaatcttgtgaagttcactacattttatcaagtctaatcctttactgaatgttaaaatatattgttacaggattctccgcgccctttctagttggactaatagttttacctgagggaaatgtggtatagaatagtgagtacatacatatattttgctttacctaaccattttggttgcttgtacctcaatttttttgtgtataggactcggcgactcggctcttgcaatcctgtaacttttgtatatcgactcatgctgctactagtagtatatacagagcataaacaaatttattgtgttcactatttatttaggtccctttgattcaaagaaaattcataggaattttaaaggatttcattcctatagaaatttatcctatatagccctttgaagcaaaggaatggatcttatggaatcctatgaaattcctatggaatgcctaatgtcatgcaagttttgaaggaattctaatatgagatagaacctcgtggaaactttcctttgagtctttatctctcttctaattcttgcgtttttcctgcggtccaatcaaatggccattcctgtgttttgcaatcctctgttttacacttacattcctatcaaaatcctacgttttttctattcctacgttttctcattcctgcgatagtgtagggtccttttgaatcgtaggaatggaaaaacagaggaataggaaaaatacaggattctgataggaatgtaggtgtaaaatagaggattggaaaatacaggaaaaacataggaatgaccatttgattggatcataggaaaaacgcaggaatcagatgagagagatagactcaaaggaatttttccaagaggttggacctcttgctaactttcctccaaaatgtgcataggattacctattccataggaatttttaaacatgtattagtcattcctcgtaaaacaagcgattcattaatatttacatttttcgatgctcatgtagccaatcttgtgtggaagaatagagagtcacgcattaaattcaaagaaaaccattaagatgataagttgttggattgaaatatgcctatcaaaaataatttttttcagatttggaaatatgactatcaaaaatagatggagggagtactaaaatggcttcttggttcccatcaacaatttaatttagcatataatgactacaaataggacttagacttttggaaaaaaccaaagaataaaataagccttagactttcggagggagggattattaagatttcaaggacgagattacatacaccgaaaacctaagaagattaaggcgatgtcccgcgaaacagaggaaaacgaccgacgccatcggtgcagtataagctaacacactcactgtcacgccagccaaactccattgttttgctgcttctgcgatctccacaaaacgctagggacaggattttgtaccacgtttagagaagttcttcactgatctcgcaaatgttagatgccaacagcactacaatcgatacaagtaagttttcctcctagatgaggttagctattttcatatttctttcaggcttagcggcaaaaatgtcattatttgctcatgtcaggcaagttgatgaaacaaggtaaggcaacatggagctcaaatcattgttgttgctacatacgtatcttgttgtatctagcaggggttgcaaaatttttccattaagcattgggttgtcttgatgtcgaatgaggatgtatggcattaggtatgcgagttttttttattagctataccattttttgttaatacaacaaaattagactccccattttgagatatcacaaaactgtactgctgtcgccatttgaaagggttatagaatatatcgacatttcaaatggagatatatttcaaacgcctagtaaacaataaatcactactaacagtggacagctgcatgctgcatcgcttatcatagaataggcacgaggcgggcgtggaggttgactgctagtgcgtggtggctggctcttttgcctgtccttgttcggcccgatgtggcggagccatagttagtgccgactgccgagagaataccccaatcggcttgcactggtgactccaagtcgacagtggcagtgtttgtcgagagtcacaaaaagggaacaatgacagaaagatgagttcgttttcacaatcagatcaacgagatgcaaaacaaacctaggagttcttaccgttgttcttcctcggtctttgatagaacttatgctgataacgtattatgctactccccctactacaaattaggtattatgcaacccttcatgctacaaagtagtttaagagggattatataatgcttacaaaaatggagtcacaaagatatgagggtgtgacatgctttcttactcattctctttttaaattgtacaatagtgaatcttctcactctatttataggtatagcttcattcaccttttgtatttagtgatagactcgattagtaagtaatcaagttgggtttttgtgggctgctggtttcgtaacacacctcaccaaagaaagtgcaagggctgctcatatttgcaatgattggaatgtgtatgtgcgtttaatgtcataacatcgtccttaacaaacggttagagagaagtaaatactactaatatctaaaagatatagtcgctttgaaagggagaagcaacaattaggagggattctataaattaggaaacaaatactaaataagatatattaaaaccaatgcaaacgagtgatcaccatgaggattgctatggtccagcaggttgtactgggtggtactggtaccgtgcggtaccaaaacacatctaaccattgaatccgggatgggtaggatcgggatagaaaagatgagcaagggtggatgcggcgttcgagtcattgttcccggcgatggcatcatccaagtcgttgtcgttcccggtggcggcggcgtccaagtcgttgtcgttcccagcggcggcgcagagcaacaagggaacgccggcggcgcggaagaggataaagtccggtggcggcgcgagagagaaaaaagagaacagcggtggcgcgagagaggaacaagggaaggatgacagcgtgggagaggaacaagtccagcggcggcgtgatggaagacggcggcgccgcgggacaggactaatggagatgcgggagaggcaaattctagggtttctgagcatctaccgtctgctctctctatcattggcacgcggaattacattactgcccttccacctacattcaacacgaggtaccgcatcagggttagaactggtaccccgcagtaccaatctctgccagccgttggatctgcccggatccaacggtcgagaatcggtaccgcaaggtaccgctggatcgtaaaaatccttgatcaccataggtagtgtgaattgtgaaagtcacaacaatgaggtgtggcctccatgaggaatagaaatggcaagctcatgagaagaggacactgctaacatataacatcatgaattagttgtcataaggtacatataaaacttacattagcacaaataggaagacaaccatacaacaaacaatatacgtggggaaattagcatgctagaaatggcaagaaccaggcaaagatgttgtaacaaaagggattatactcgtaccatttttttttaaaaaaaagtgtttctgaatgctacaattctaatccctccatattatactcaaattagtttattcatcaagaatattgtcattgagttatattacataaatagtatgtattttggctttaaatctttttaatatttcggatcaccacattaaaaacctatatatatatatccctaatattaaggaatattctgaaccacctaattaacatctttgatacagcaatagcgtaacaaatctagccacataaatacaccgatcaccctgctgcatatataatgacaaacatagcacaaggatcattggatcaagtcaagatggggcagtcatcgatatttgtcgtgctctcttttctgttcttcagcaatgctgcagcaagaagcttggtgctctccaacgaagacgacttagcactggagagagaactcatgatgcttaacaagccctatgtgaaatctttcaaggtaatattgatatccacgtgaagaaactttgggacaccaataaccaattaccatgctccattcaatatttcgttcttttattattctgcatttgatgaaatggcaggatagctatggtgtagtttttgattgcgtggacatctacagacagcctgcattcgatcatcctcttctcaagaatcacaaacttcaggtaatagtcaggataaaaaatttatattctctcatgtgcacttattttttgcgttttagtatagctatttcactagctgtggtagagatttgcaacagaagattattgcatcaaagagatttgcaaaacaaaaaattacacaacggtaatctgcaccaaaaatgagatcatggagtgaagtgtaccctggagaaaatagaaaatagatcgatgtcgatttcaaaaatctattttttctagcaattgttctgttatcacggtatgattctaaaatgtctttctagatttgtttgtacctgttctttacaaggcatacacatcagatttagatcgatggcgaattataattcatagagttcaaaaggaagtcatctgttttgcagcatgatgtattccctgtactacattacagaagacaaactctgtagaatagaagctcaaaaaaaaaaaaaactctgtagaatagtatttattggttactagcagtgaaacctgtcagcttataggtttactatgtgtaaattcccaatatattttatgaagaagcctcattcactggactaactgtttttttactgaaatctgaaaccagattccaccgcgctcatactccaaaagtttgataactcattttggtctgcaagaaagttgccctgatggaacggttctcattcgaaggactctcaaggaggatctcctaagggcacgcgcgtttcgtggaccgttgaaaccacagaaagaccaatcatttacgccaatgagttacactagtacaattcctggacaacatgtaagttggcatttcaaaattcgaattttctctcagattttatgattctctacttcggaatattttttttttgggtgatacaccaaatcatcaccaaatgtatccattttgcatttaatctaggacaacattcctcttactttatggatattaaatggtcatttacaacattcaaaagcaaaaattgatgctaatttattatgctgtaaaatgaaggacaatgatgcttccttgagttagtaataaacttggcaaaatatcgagaaaaactgcctctaccagcaaaagtccaatttcaaattagatttggcaatagacctatatacaggttttgtattttcattttgaaatggaagttaagaaatacttcagattttgtttgcgattacatggaaataattcagatttttttattgtatttcgttcaaattttacataacatccatacctgtcttccaaataaaatatattaaaatgatatagtactttgattcatgtaaccattttattttgacgcatgctatatttatatgttttattgcaaattgaaacgaagaaaatgatagtgacatcatggctagcacgcgtgatttcagcagatagcatgccagcatgatttactgagaaaagacaatgtatttatgggagcaatcaatgtttcttttaattacaaatcatgaatcaaatatttagatattgtcacagctcttactcctacatcagatggatggaggaccaaaaaaaaaaactcacttgtgaaacctataatacacatccacagtattgtccatttgaattcagagctactcgttnnnnnnnnnnnnnnnnnnnnnnnnnnnnnnnnnnnnnnnnnnnnnnnnnnnnnnnnnnnnnnnngtntatcatcacaaannngccgtaca

SEQ ID NO: 304 - DNA, 56184 bp, Oryza sativa
  unsure (1)..(56184): unsure at all n locations
cggtntctcaanttagatcgcnctnnnnnnnnnnnnnnnnnnnnnnnnnnnnnnnnnnnnnnnnncagttagtgtcatacaatctggatggcatgtgagtttttcttttcacttttgatgattttgtaggcattttctgccaaacacctttgcactgtatttttacccttatctatactatacaccaggtcgatcctgaccgcgagagcgacacccagacacgattggtgacttattggacggtgggtttcgcaggatagaaatttgtgaccttctaattggaaagtattttgtattggagtacctcttggtagctagtctacatattgacagcagaaaatctcctgtaaacaggccgatgactaccacaagaccggctgcatgaacatgctctgcccaggctttgtgctgctgagcagaactacctctcctgggatggtacttacaacaggatctattcctctgaatatgaccaaggtgatcaatgctgttcatcacattgcactgaacctttttaatgttaagaaaggtgaattacatccccgcgtcctacgtatatattctaggggcctgttcagtttgttgccaaaatcaaccttaccatttgttggtaaagccaaattttagcaatgccaacattttggtaagttagaaatgtaaagataatgtttagtttgttaccttatcaaatattggcataattttgtgaggagaagtttctaaaatcttgccaaattctatgggcattaccaatatttggtagcaaaccaaatgaagccaaattttggcaacttgccaaataatggaatggttcaaaatgacaacaatctgaacagcccctaggatgcacacaatcaagtattgcattgaattgaactcatcacctgcagaagtacatctcaagtagcgtaaatgtttcttagatatactaccaccaaatagagggaaaaaaattgaaggtgaaaatgatgataaataatataaccctaagattttacagcgaggatagttttattttaatttttgaggctttagagtgtgctatgtggttctctactatttaattcccgttgcaatgcatggacattcagctagtattatgaaaaaaaatatacgtggtttctgatgatacatatttttgcaacatgtgtggtctaggatatccaaaccgggaactggcaggtggtggtcggtgacgaggtcgtgggctacttccccaaggagatcatcaacgggatgagcggcgggacggaggtgcagatgggagggatcgtgtacgcgtcgccggggcagaagagcccacccatgggcaacggcatccagcccgtgcacggcggcaactaccgcgccgccaggttcacgtgggtggcggcccaaggcgccaggatcgccaactggacggtggcgagagatgtcgccgacatcaacatctacgacgccacggtcacctcgagctcgggaacaggcccggagggagctgtgttcgaatatggcggtcctggaggccagccgtgagtgagtgacttcagcgtggcctctgtctttgatagtgtcctcaccttatttggaggatgatcatgggtgtatttggttagaggaaattgatatcagccgtaatcttagcattttccttcccatgatgattttttttaagataatggaataaatcccggctttcccgtgacgatgactgtccatgggaactgggggttagtagggaatgcaacatttctgggagtggatgtgtcaaaatggttcaatgaatggggttaataatccaggattgatgcctgtttaaaggaatcttttttataatagactatattttcagtatttccttaacgagttatagtcaattattacaccaattcgctcagaagcgttcacacaccaatgagtccaaaaaacacaccaatgtaacataaagaaaatacaaactaataaacaccaacacaaaataaaagacccgcaattattgaatcttattcgtgaacctatactcgaagttgtgaaaatctgcactcgagtttacgacatgcaccatttattagtttgatgtattcatcgaacctttgtagttgagcccaacaccggagacaacacgttaccttaaaaagtatttgcatataagattttgatggtgatttatcgaagaccacatcatttttattaagtcatagagctcaacatattactgatgctcttacaagaataagtttcttagtttttttttatcaatacacacaagccaaatcccaaaaatatgagatataatatgtggagggtataatataaaagcaatatgtaccgctctccagagaaatttgggaaattagcaatccaagaataaatgatatattgtcttatttttcattaaaaaacaatatctcctactaccatttcaatccctcctaaccaaattatcaatgctaaatattcatggaatattggcttcaccgtaatcctgtactcataatacaaccatataagacacgtcccaaaaagatgaaggatacaaaatggacttattctagctatataagacatggcccaaagatatgaacgaggcataatagccttaattccaaggaggagcgtggtaggcttgtcgtgccttcaggccgacccggaacgactcgagttttattaggccgtgtctgggcagttggtgtagcccgtgggcgagcacgacatgacccggcgtgtcggtcgagccatgccagcccgactgatctcgggccatgcctggtcatgcttgggccaggccagttgacccatttagccatctatactaccaccccaccacacaagtatattttcaacaggtgtgttcgatataggtatcagctcaacccctggggttaatgtctgggccaaagaccctgatgctcagataagtttcttaaagatatttttgtaaaatatttctagaaatatctagaatgttaaatatccaaattagactatatataaaatgactgttcatacatttgagccattctgaacttaatagttttattatgaaccggctattggggttactctctagaccaaagagcctgacgctcagataagtgttcttaatatttttgtaaaatatttttaaaatatatagaatgtaaaaaatttagaatgtaaaatatccagattagactacagatagaaagactgttcatacatttgagccgctctgaaccgaacggttttattatgagccggtatagattagactataactataagaccgttgatacatttgagccgctaatgggcctgctggaggtccactctgtgtcaaaggccgacaacatcagctttaattgcaaaaggaaaaagtgcaccgaaggtccctcaacttgtcatcgggataaaaaacgttctcgaactgtaaaaccagatatacggggtcccataactatacaaaaccgttcactttaggtccctcagtgattttgaccccggttttatctgacgtggcggctgcgtcagcgtgggacccatgtgggccccacatgtcagggaaaccacgtcaccaccccctctctttttcacctcttctctcccttcctctctcctttttcctctgcgcgtggatgtcggcaacgtcttcgacgcggcggggagaagggcccgcgtggccggaggctgacggggaaggagcgcggcggagaggagggccgatgcgacgggcggcgccgccaatggctgtcgtcgcgtggggaggagcgcggcggtcgtctgccttccctcctcctccgcgtgccgtgcggcgccattgccgtggccgacgggacgtcgtcggggtgaggtggcgatgcacggtggtgcgggcggcacggcagagggaagggcctgcgtagagtggccgacgcacggtggcgcgggcagcgcgacgttccctccctctcgatcttggtcacgaaccgcgtcacgtcgccggcgtcgtcctggatgccgttggcgagcacctcccctgaggcacaaaatcaacaaacagatcaacaaattggggaaaatgtggagggtattgaaggtgaggtgagacgtacgagccatgggatggcgaagagcgcggttttgttgccggtgaggaggttacgggcgttgaggatgatatcgggaagctgcaggaggttacgggcaccaccgatgcccggagccgagttgaggcccatggcgttgagggtgagctcgcactgggcgagcgcctaagggtgggagatgatgtgggttaagaagtccctgcggatgcccgaaagtgcgaggaggcagtggtggacagggaaaggaggaggtccggcatggcgacgttgacgacgaggacgagggcctgtccgttcgcgggatgatgggctcgaagtggcgacgtcgatgacgagggcgagggcctccacgcatacctcctccacctcccacgccggccgcagccgcgcgctgccatcgccgacggcagcgacttgatggcggcggtgtcgagtcgaagatggccacagccgcgcgccgccattgccgaccgcacgaaggggacagggaggttggcgagctcgcgccgctacccgggagccgccgtcgccggccgcaccaccctccggccgcgcgcgtcgccacccgtgcgagagcagacaacgagaggaaggaaggaatgaaggaaaaaaagaaagagaagaggagggaaagagagtggtgctggcgtggcaccatgacatgtggggcccacgtgggtcccacggtgactcagccgccacgtggggcaaaaccggggttaaaactgccgagggatcttgtttgcactggttttgtaagttagaggatgcgttatatccggttttgcggttggggaacgattttgtaactcgataacaagttgagggaccttcggtgtactttttccattgcaaaaaggaaaaagtacaccgaaggtttctcaacttgtcattacaaaatcgtcccttaaccgcaaaaccagatatatgaccgtaaaatctaaacagagaggcctctccgtttaggcttaacgcgcgatgcccgtgccagccgtccattggcgcgcgggcgacgtggcgtgcatccggcgcgcgcgcttgtcccgaccgcgtgttgcttatccaaaccgagctgctccgctcgttccgaccgagaaagagagagagagagagagttgttttactatttaaaaattgtgggtggcgagagagagagagagaggcggaggcggcgacaatctccggcgaaatcgtcggcggaggcggtggagatgtcgctgcggcggcagtgtgggagggggaaggtgcggttgtttcgtcccgtcgcgccgacggcggaatcggcggtggaggcagcggaatctgcgtggaggcggcgttttttctctccacatcgtgcttgcagttgcggggggaagtgaaggctgcggcttaggtggttttctctccaccaaatctggcgcccgtgcggtaagttgcagcgtgcagagaggtggttgcggttttttttcagccggagagtggagtgatttttgtgtgtgatttttgtgctaggagaggtggagagattaggcagttttcactgtgcaaatttgtgtgccgggagaggtggagagattgtgcagttttcactgcgcatatgtgcgattttttgtgctccacaaacctctcggtttgttttctcccctataatagctctatcccctcatttcccctctctctctctctctccctcatccaggtgttagttcgtcctctccgtggagctcctctgcgtcctctcggcgagtgcaaagtttgtggtggtggatctccggcttgatttgaaggtatttcaatttttctctccatttggcattttgtacatggcttgggctgttggataattcatgattcaaattccatgttgtgtagcctcagtataataaaaagttggtgtacttctgctgccatttactaggatttttgtgtgccccttgatagctttaggtttccatgcttcatgtacaatgtaaatttgggtagctagataggtttcgagtcgtaacaagcaacatgtatcaaatcgattgacattgatttgcagagatcgaggtacattcagagaatagaggctgcaggtagcaggggggagagcatgcatgtcagcatgtatatgcatgcatgctactgatcagtggtgacaggcagatgagtgctgaccgatcgattgatcccttgattggctaatctatgtcgtcttggattggctaatccaatgtgattttcagttaccatgttgctaataatctgaagctctccctagtcattgatgttattaccttttttttttttgcaaatattgtggcatgtctagtaacattttcctctagtagcaaataatggtcgtctcaaaatgttccttaagtaacacatttgatttattgaattacatctagtctagttaaaacttactttttcccgtggcatgtgagtaacattttgagaacaatgaaattaagtttgcaatttttttgtacttcctactagttgttaagttacttccaaaatgtactgacttacttctaaacacataaatgttactttctactagttgtttagttgtaattggttagattttggtgaaactaatagtcaaaatgattttccaggaatagctaggaagaaatcccatgtaacgaaaggcgcgttggacaaactagagtcaagtcagaaaaaaaggagtgtatcgcaacgcaggaagaagagagatcatggtggagatgatgcaacgcaacctcctccaaaaaggagtagaacaaaggtattgaacaaccatctatctttctacccccgaacctgtgttttgccttttttatcactgcactacacttttttcgatgatgctgcactagacttttatttgtatttttctagaagtaacttaacatgttctagaagtaacttaatatgttgtgaaaagtaacttaacatgttctagaagtaacttacagtactttgaaatggtatttagatgttgaatatggacttggacatgtgtattttgattttgatgttgaatacagtgctacaccttattgaagttttattttttcttggaagcaacttgcatgttcctgtgtagaagtaatttgtacataactcttggtcatgatctagtatatgttgtacacaactcttggtcatgatctagtatatggccaatcttcttttaagcattttgcattatatgccaccggcaattgtgatgcttagcatttgggaaaactagcataatagctgccttcatagctaagtcttgataagttattatgtttggaacaactatacaaaggtttttgtcttttcattccttaggaacccacaacctaactgaatataaaaaaaaagtaagttagttactgtttggaagtaagtccatacagttgcaaagtaagtaggttcagctttttgttgctgaaagtaattcagtattgttatcaagtaattcagcacatattatcattctggaagtaagttagtatagtttggaagtaactcacacattactaggaagtaagttgacacacttgtagagtaactaggtacagttttgtgttgctgaaagtaaattagttctggttttgaagtaattcagcacatattgtgattctgaaagtaagttagtgcatttttggaagtaactcacacattaataggaagtaactttgcataaaacaaataccaagagaagtacctaaatagattgcccatatctgtttatcctaatgaatggtgcacaaggcatgttatacatgtttgtcatgtatgtgtagtcaaacgagatgtaatctttgtagtccttgtacgcttttcttgctgctccatcaacccggaatatgttctgcaccctgtcttccttatcaatttgtgggaaagtaattcagtacagtttggaagtaagttagtatagtttggaagtaagtcagtatagttttgaagttagtaacatgcaacaggacaataactttttagacagttacagttagatgcctctaagaagcaatttttctcattttttgacaccagtggctatacttatggtttttttttcacatattgtttttgatgcagtactagaagagaaagagaggcaactaggaggaatgcatcatgttgtgtacacataccaggtataaaatggatacagaagtttttcactgaaattacagttaaaattgcccaacaatgtaattaatggatacaaaagttgtaactatgaaattttaattcaagattattttggaagcaacttgcatgttcctagaaagtaacttattgaagtgttagaactaagttttctattaagtttgctctgagaggcaactggggggatgcatcatgctgtgtaactagggaatgtaaattcaagtttttctggaagtaactttcatgttcccaggaagtaacttattgagttgatagaagtaacgttctgttcaaatttctttgagaggcaactaggggggaatgtatcatgtttctaggaagtaacttatcgaagtgttagaagtaactttctgttaaaaatgcactgagactttatgttaaaattgctataagatttcaacaccggtactcatgcctatgtaactacgaaatgtaaattcaagtttatttggaagtaacttgcatgtttctaggaagtaactttatgttaaaattactctgagatttttaaacaacagcactcatgcctatgtaactaggaaatgtaaattcaagtttattggaaagtaacttgcatatctaggaagtaacttatcgaagtgttagaagtaacccttttgaaattgcactgagaattgaacaccagtactaatgccttttttcctctattttttttcagcagcacttgaaaagaaatttattcgatatacgaaggaagtcagaaagggagacagattcatagtattcgtatctcggggaagacaggattcatagaattcatttctcacagaagacaaaaagaacctaaaaattctctaggttagtttgtatgttttttgtcgatagatctgaaaagacagtattggctatgtagttacctgtgatctgctcttcttttctctctcttcgtgcttcctcctcctcctcttcgtgcttcctcgttttctttttctgatttttgtgccgcggcggttgagttctggattgacactcttcgttcttctctctcgttttttttctgatttttgtgcagccacagctacgttcgggatcgacgctggtccggatttgttagattggagggggggtgaggcgcgtagcgcgcttcctttaggtgggcccacgctagctgtcccacgccaagcacggtgtgcgtggcacgacgcgcgcgcggctttcctttttttgtcagaggcgcgcgcgctaaaaaggaaaccgtgttttccttttttttttgtcaggagcgtcgcgcgttagcgctatcgcgatagcgatctcgttgtagtctcgtccatatatgacatttcttaacttagaaaacagttcactttagatccctctatgattttaaccccgattttatctgacgtgccggttgagccagcgtgagaccttacgtgggccccacatatcaagtcaccaccctctctctttttcccctcttctctcccttcctttctcctttttcttctgggcgtggatggcggcagcgtcttcgacacggcagggaggagggccggcgtggccagcggctgacagggaaggagcgcggcggagaggacgaccgatgcgacgggcgccgccgccaatggctgccgttgcacggggaggagcgcgtcggttgtttgccttccctcctactccgcgtgccgtgcggcgccattgccgtggccacgcgtcatcgtcggggtgaggtggcaacgcccggtggtgcaggcggtgcggcggaggggagggccagcgagggaggagcgccgcggagaggagggccgagggctgatgcagcggaagtggcatcaccgacgcggcggggaagagggttggcacggccgacggggaaggagtggtggagaggagatcgaccggtcggttccccacctggcgaacgctagcacgagtacgaggagcaggagcatgcacaggcgatgcacgtgtagaggagcaggtcggtcatgttcggtcatgttcgtgctggtgcaggcactggtctaccacatcctccgtagctcgtcgagcgtcttctccaaggacagcaagctcggcggggcggcgacgcggcggcggagacacgggagaaggggagggcggcggcagggcgaggtggcgtcgacaggcgagcgcggtggcggaggccggagaggcggcgacggtggcaggcgagcacggctgcggatggggagcagcggcgccgacgacttcgcgccgctcagcctcatcgtcgtcggcggctccaggcgcgggcggaggactcctctgataggcgatggcgaccgcgatcaccgcgccgccggcttctcgtcgctcgtccgctgggccgcggcgccgcactcgcgccggccgcacgcatgtcgtcgtcctctgtgactgtgagtagtagtaataccacccacagcgtcacggagctctccatttcttcttcttatccactgtctatgcgacgggcagcggccggacggaccgaggtggcgagcatcgacgacgacgaggcgtgcgagctggtgagcggcgcggaccttgtcatcggtggcgacgtcgacaacgagggcgaaggcgtccgcgcgtacctcctccgtctcccccgccggctgcagccgcgcgccgccatcgccgaccgcacgagggggatgaggacagttacaaatgcctcagatttgtgatggattaattgtaagaagctgtgcactttattgaaaaaagctcaagaaccaacctagctcgatccaaaataaataaataatactaataactcaacctaaaagttaatttcctctactaattagcaaactacgagctgcaaactatccatcagaaacggcagctggaactgccaacgccggtggagagttcatcccagccgctgtaatcgctcgccgtcagccgatgcctgggcgtggtcgcttgacctgttgaagaggaaaaattatgattaaccacgattcacgcgccaagaagaggatgaacagggagaggtgttgcacaccgtcgtcgtcgtctccgcacagttggatgtgcgtggcgttgcacgtcgggcaggcgaggttgacgcgcagccaccgccggacgcaccgccggtggaagtggtggccgcactccagcgtctccggcagctccccacctcctcgcacgatgtcgtaggcggagccgcacatgccgcagcagaggtcgccgccatccctggcggggacggcgacttgcgcacgacgccgcgtgtagtcgccttggcctccgaccgccgcgcctgcttcctgagcgcggacgaggggcgtcgccgcggcggccggcggacgcagaggaggactcgccgccgccttcagcttcctccgatacagccagtacacgagcggggccagcagcccgacaaccacgacaacggcgcagacggtgccggcgatggcgccggcgctgatcggagctcctccggcagttccgtcagccgcgtcgctcgggaccgcacggtggaagccgcggatatcgctcatctcgaatgcacaggagaacgcacacacagatacgcagatacccatgttatagccgcgacggaagaccgccgttgaggcgtgcacaattgcggcaatgaccgttggaaggaggcgggagtcgccattgctgctgctgctgcgcacaatgttagaataagtgtcgaatatactagtcctatttgattacagttggacttgaagttgtaataggtgttaggggtggagttagagtcggagtctgtaacccggcaactctcttaaatagagagggggacaccacaatgtaaccatgacgactacaatgtagcatagacacgcagggagatgatggcggcgtggccatggactcgtagcggctaggagctatattggttggggaggagcgcccataatcagagccccggggatataggcttcggctgaacctcgttaacaaatatcgtatgttcctgtgtcgtcatctggcatgtcttgggtgatcaatgactgaagcgatcaggagggttagtcgtctttccgctatatcgactaacttttataacaagtggtatcagagcagaaggtttcagcattggatcaagaagacatgtggagaaggaaacacgaggtgggatcgcgcatcgataggagatcgtcagtcgtggcgatgagatcaatggcgacaacgaggacgttgtggaggcgacgacctcactcgcgatcagaccgacgatggtggagcgtgaccggaagacgaggccgggcgtggccgaaggcgttcagagagattagaggggtagcaccatggacggcgcgtccgacgcacgcggcgaacgcggatccgcggcggcagggaggccattgacggaagggcaaagctggcgagcgtggcgcggcgcggcggacgtgcagggccgatgacgacggggtcgtggacggtgaacatgagggctgcgactgctgtgcgtgcaggggcacggacgtcgtgtatggaggcatgacttgtgcacacctacacatgcataggtgtggtttccaagagcagaaccaagacggatacggtgcggagacgtcaacttaagcagggagaggtggcagtgggctccatcgtggaggagtagctacggactctagcgaagaagtttctctaatccgagcggtggcagtttcggtttcggtgtctgatgcaggcggcggcgacgactcagaggaggcgtaggctgcggcttgtagcaggaggaagcggagaccgagatcaagtcggggtttggtttttggctcgtaggaaggcaggcatgtgtaagaagtgcatggaccggtgttaacctccacaaagtcaggcggtggaccaagaaaaaaggagagagtagtagtcttttgctggtcacgttaattatgatagggttacatgtgtatgcaagcatatgttggctgccatagtacgtgcatgcattatactactgtgcaacattggtttacgtatggcagggagcccggaagaccaataagctagctgtgtggtggtgctaattaacgtgggtcatcaagctgcgcgtggagatcaaagcgtgcaaggctaccgggagtctaggacgcattggttgacgtaattaaggtggtggtgattcagtagagagatgcacaggcgcagaggcaattggtgtggtgctgccctaagacggaacttgtatggtctacggtgacttaggagatggtacatcatgtggcattcggtccagagaggatcgaggctggttaaactgggccggcagggtggttagaccgacggactggttagactgcggagcttggagggttagaccgggttcaacggaccggtggttcgttgcagaaacttgtgagcggattcagaagaagggaaaaaaggttatacggtctagatagtttgcaagtgacaatggcgaatagactggcggcgacaggtcggtcaggtcgcatatggaattatctggcagacatgatatatatgggactcgacgaggagttgagatatatggagttagaccagaactgaagggaaaaaaaagattctgggcaacatcgggtcaaatatcgttgatggggtcgacgatactgtttggcagtacatgatatatccaagatatgcaggttggcatgatggggatatatgaaatctgcatcactgacgaggaaaagcaagtgctatggtgttaatttcttcaagtgattcaaggcaacggtgaattttctcaaagtatcataggttcagtctacggatgcgggaaagcgaggatgttggatttattagcttggttcataagacaacaaggaagaaatggttctcttcaagtctggtgagtttgatttatctatttggtgatgacgcatgttatctggccatggattagatcaagtcaaatttaagatggaagatggaggtgaacatggtcttcggggagtctatgatgtgacagctaggaagaaatctaatttcgcttggcaagacgactgagatgataggtgagaaggtggagcactgttgcaggtagattcaagaggaagaaattacagggatagcggagtctcttcaaggcggcgggtctagcggaggctcgtcaggcggctcgtggtgaagctgcaaaaggaaacaacccaagtctggaggacagatggatcggcatggtgattctactacttctgggtggcgtatattcgccaaggtgaagtttgttagaatatgtgtcgaatatactagtcctatttggttacagttggacttggagttgtaataggtgttagtgggtggagttagagtcggattctgtaacccggcaactctcttaaatagagagggggacaccacaatgtaaccatgacgactacaatgtagcatagacacgcagggagatgatggcggcgtggccatggactcgtagcggctaggagctatattggttggggaggagcgcccataatcagagccccggggatgtaggcttcggctgaacctcgttaacaaatatcgtgtgttcctgtgtcgtcatctgacatgtcttggatgatcaatgactgaagcgatcgagagggttagtcgtctttccgctatatcgactaacttttataactaacaacaattacggcaagaagccgttgtgagggccgagtctgcgggccgcgccgcccctggggggccatcttccgccgatgaggcgatgagcccttcgccgcgcccgcgtggcgtcacgttcgcgcgtcgacgccactggacgccggcagcttttctgccctcgcgccgcttctcaatttgtcgcgcctccgtcctccttgagccttctagcacgttcccaaagaagctccctgctcgccggccgctttatctcgtctctcgccgtagcgccctcgccgccaccgccgcgtagcttcgtcgcgcggctgttcccggtgaccattggtgtccgtgcccacgcggcgcatcgcgagtgcgtaccggttcggccaaacccgaacttccctcgaccggcgagattagccgccgtcgttcccctcccggaaaatccgctccgttggttcgattcactgttacctcctctaggcgccgccgcgccggtggtcatcttctctctccgtctcgcactcgttcgccggaatgctccgctcgccttcagccgtcgatctctgttgcgaagcctacatcgcattcacgtggacgacgcttcggcttgttcggtcccgcaggcgaccagtcaaacgacgcctctcccccgcgaaaaacctatcgcgcgatcgatcgccctagaggatttcctcccatgcagtttcctttttttttacaccactttacttttctattttagtaagtttatacatctaaagtttatatatatctaaattttatacatctaatgtttatacatataaagtttatagacccaaagtttatacgtcaaaagtttatatactcgattcaaatttaaatttgaattcaaatatttttatatatagtatttctgtacatataagtttatacgtgtgaagtttacagtataaagtctatacataagtatagagtctatccacataaataagagtattagatttttttttcctatttttaattttttttctaacttgtgtttttttatttctaaaaatttatggtgtagtaggaagagaagaagggaagagaaacgtgttaggggagggatgtgggctttcccgatcacgcgccctcggcgtaggcgatcgatcgtgcattaggaagacccctccctcggccctcgtgctcccggccatttgggccgttttgtcgcctctatctactttaagtcgactttgtatgacatccctaattccaaataccagaaatcttcacccctaaaatgtataaaaccgtgcaatttaggtctcatggcagtatggatctataattttactgatgtggcaccctagtcaacaaaataaaaaataaaaaaaatatgtcacccacatgtagcatcttttctttctcctctcctctttctcttctcttctcttctcttttctttcttctcttctcttctcttcttcagtgagctgggaagctagggcggcgcggcagaggcggccggcgagcctggaataggggaggtggccagtgagccctactcaagcccatggagagccaccaatgccgtctccggcgtgctcatggagatcctggccacacgggtgatcagcgccgtcgtcatgctccgcgagttcgccgcatcggcctcgcccgcacttattaatatgtgaccccagtggtacactgttgaattgatctgccgtgttgcttgtcatgtatccatcgagcgatgcctagtgctctctactagtagtattatattactagtattattaggagtaaattagtaatttactaatacaataattcaagagttattttgtcatttatattttttccagctaaatcgatatatgatcattcatttgcattgacattgatcatattccataaaaaagccaaaaaaaaaagaaggaaaaatgtttagtcactgctaaatgaaaattataccctcccccactttttttgttgacaataatgaatctccacatttttactactgctaactggtagtataaataaacctgaacccttcgatcaaataagatcaatgatttatattgttttctattacccgcagaaagcatcgtagtgggctcatatcgataatggtgtccatggtatcatatgcacgatcgtcatcaagtcattttgtgtttcataaagcaatgctcttattatagtttttaggataactttttctttttttaccaattcgtcagaacatctggtagttaaattgattagagaaatcgtacaagactaaaaagaacgagaagctgagtgccaataagccattacactgttttcctcctttttttggtagctcctgaaaacaatcaattgcagcacttattcacaggatgttgtataaattacatctctcgggtactatatatatcttccaatactagttgatgagcgcgattctgctcaggcagagctctccaatagttgagaatctgaaaatggaaagcaacagagtgcagactctggaagattgcgagacctttgtaaaacaggctgcccctcttctgatgctactctcttgcatgtattaacctctggtttatggaaccaacagcaaattcttcatcctcctgggtacaaatctcacttgagtcactctcacctgcttcttggcagagctggtcatccgatgccatcagaatgttccttcgagcacgatctctgtcccgaggatacgtgcagtacaggaaggtgtatgtcaggcaacagatggccatgggcacggcgatctccgtgtacactgccttggccaatgcagccgcattttctctgtccgtttcgacgcttgcgtcagaggagaccggcttgtagccgaacacttgctctgctagaacaccgacgatcggtggcgcgaatgaagcgaacaccgcttcaaagcatttgtcgagagcgtagaccgttgttctcgccttctccggtacaatctccgcgaagattgggctgcattgcaaaatgtaaattgtaagacatatcagcattgcattggagattcagatatgaaattgtttcagtgtcgagcatggtacttgtttgtggatgacgcgttccaggagatggcgaaccccatgatgaagaacacggcggcgtgcgcgacgccggtggacgggtcgttcggcagcgcgaggagcaggacggcggcgagcgggagcgccgacgccgagctgatctgcgccagcgcgatccttccggtgttcgggaaccgcctggagacggggtccccgacgaggccgccgaagagcgcgccgagcgcggtggcgaggaggtagagccccgtgatgacgctggtctcccagtgcgtgaagccgacgagctcgagccacatggcggagaagttgagcgccgaccagggtatcgacccggcgatcccctgcgcgacgatgatctggaacgtgggcacgccgatgacgccgcgggcgtcgcggagcagctcccgggcctcctcggcggcggaggcggcggtcttggacttggcgcgcgggtcggcggcgaagcaccacatgaggatgcccagcacggcgctgacgagggcgacggcgtggaacgccaggcgccagccggcgacgccgaggaaggtgaccggcgcgagcagcacgccgaaggatccccccatgatggagccgaggttgcaggtcatctgcagccacccgaacgcggcgccgcgggtgtggtcgtccgtgtagtcggcgaccagcgagctgatcgccgggagcaccagcgccagcccgacgccgttgagcccccgcgagatcgccatctgcgcgcgccacggaattttttcagttcatccagttccctctctcccttacaggtgggacccacagcgtcagtggaagaaaaaactgaggctgacagtctcatctttttacttaaacctatctttgtaagtcaaaatttaattttttaatttctaatttaaagttgactttatcgtattttatttttcggcctttatttcttatcgctaagaacacttacataaaagttttatttgtaaattatttttcgtttgtaaatatatgtccatagtatgccaaacgatggagctttcttcctgtttgtctggtttttcttatcgaaatggagttttttcgaagataaaaattgggatggaaatggaatattcggataatcaaattatataggagtaggtgcgtgtaaaacggggaaggtggagtgggtcccgcagtcagcgagaggggaggaggtgacctggaggaaggagccggagacggcgacgaggagcgtggcggcggcccagaggaaggcgccgacggcgatgacgcgggcgcggtcgtggcgcgcggaggcgtaggcggcgagcgggtacgacgccgcctggacgatcgcgcggcacagggtgagcgagcccagcgccgtcggcgacacccccagctccgccccgacctcccggtacaccgccgggagcagcacctcgtcggccttctccagcaccgacgccaggttcaccagaaccagcgtccaccgccgccgcgcctccgcctcccttcccatcgccgtcgccggtagctcctctcctctcctctccttctcgctttgcttaaatgtggggagcagaagcggaacggagtcgctggagcatgcgtgtcgttgtgaatttggggtttggatggggatgttgacctgggcgagcaagagcaggagcagccgagctggagctgacagcgagatccgccgcgagtgttggggattttttttcaccacgagagcttttgctgctttccgtcttaagatggttcgttggcaactgggactgcatctctgattctgaatggactggagttatgtcaccttgttttcgtataaaccgctaaaaaaagaggagattgaggagtctacttcaatgcatagcaaaattagcgattgccgcttttggggatttgttaggagtgtagcgtggctcggccccttcccgttgtttggagtcttgttttagccgccgtagttttataagctttagctttttattttaccttttctcttttcccctagcatcataagctggtctggctgattgtgttgtgtagatataacatttttcttctaatatattgacgtgtaattcttttacacgttcgaaaaaaaaacatggcaaagttagcacctgattaggatgtgctcgaactggatcactggaacacaaatctagattacttagagatggcaccaatcgagccttttggcaaaatcaaccatggcatttgatgtccgctctctatctcgccatgtaacgggacaggcacagcccatgtggaaagcgtggttgagggttaagttacttgacagagacatcaaacattgtggcttgcgaggcagcaggaagagaaaacagttgagaaattaaaaatcggcttaagcatcagcggcacaaccacatttccccttcctacatggaaattaaaatttgcagctggaattaaatggagggagagagcaagttgcccaggtgctgagcaatgtttaacatgctttggcttctattcatgtcaatcagggcgaaacataaagcaccatgtcaaccctgtcctagtaaaagggatttgtatgtgtgtgaaactaaacacacacatcaattggtggcaaaacagaaaagtacttcaaatttaaaagaataaaaatgaaaggcgcccaccgtggggctcgaacccacgaccacaaggttaagagccttgcgctctaccgactgagctagacgggccaggatggtaaatgttacattttcattgttgtatcctttacgttcattcctaccggcacaaatgttaacactagatagatatttaaccattttcacttttatatgttacgtttaacaagatatcactaaacctatgtattataaacacataaaatccatataacataaatatgtaatactaagttcgttgcattttaaatacagtcatgggtttttatgtcaaacgtttgacagtccatcttatttacaaattttataaaaaaaaataaaaataattagtcatatataaagtaatattcatgttttattatctaacaacaataaaaaaaattaattatattttttttaaaaaaaacggatgatcaacgttagatatagactgtaaaactatggtctgttgacaacttgacataggtaagtgaactgttaacaacgttcagtccaaactccaaatgaagacaagggtcgcgactctccaacatcctctctcctggtgaagtggtaattgccccggcacacgccgcttctccggttctcttcccccactccatactgctgctcttccccggctgcgttggggtttcaggttgccctcctcctcctctgcattctcgttctcatccctcccatttgattctaggcgatttcttttttcgaatttatatgtactattttttgggatttctcgggtatattctatagattttcatttttttaatcttctagagtttgaaatagagccttctccttccgatccgccattatccaaacaaacaaacggttggaggggaatatgcagccaatccccatggggtttatttgtttttcccatgtgaaagttcccccccaaaagaaaaaaaaaatccccatttgcctcggtgtgtgctgtggcattgcccgtgcacgcgaggtgttcgacgtattgccctcgtgcggaccgcaccgtttccttgtggggtttgtttggatcctgatgcgttcgttccccgtgatgatgtagcgctaacgctcgcgtgatgtctcggtgtctttcttgctgtatgcaaaggtttgacctcggcgggcgcgccatggcggaggacgaggcaacggcggcgcgcgccaggcagcagaggcagccgccgtcgtgggcggacatcccgcgggacctggccgtccaggtgctccgcttcctcccggcccaagtggacagagcctgcttcgccgccgtgtgtccgcagtggcgcggcgccgcgcggaacgccctcctgccggcgcccctgccgctgctcgcgctcccggacggcgccttctactgcctcccctacggcaagcccttccgtttccctcgtgccggctgcgccggctacaagaccgccgcctgcggccgctggctcgtcttcccgcacgacgacggctgcttcttggtcgaccccttcgccggcgccaccgtgacgctccccgccctgtcccgtgtccggctccgacccccaaatgcggttgctagttatgtaaatgttgggatcgcagggcgtaatgcacatgtcagcatgttctaccctcacgctacttggatgcatatcaagacttcggacaagatgcccataaacaagctactcctgtgctcgcagaacctcgtcgccgcgttcatcggcagctcactcgccaatgctggacgcaacagccagattctagtgtgccagccaggggcgtcctcatggtcggtacgagcttatgacaagtgcaagctgtttgaagacatggcattctaccgggggaagctgtacgccctcgctcatgatgagaacctccttgtcgtcaacatcagccaggatccaaacaccggcgatccacagatctcccaaattgggcaggtcatcaagggcgatcccacctggtcttcagttctgattacggatgacgacgacacaagcacaacggacaaaaagaagctctacctagttgaatcatgtggtgtattgctgatggtacgcaggaaggtttgctgcagagtggtaggcaagaccgtcgtgcctggacagaacgagtttgaggtgttcaaggctgatttggagaactcacggtgggtgaatgtgacaacccttggggttgatcagatggttttccttggacggccatgctctaaggcagtgtccgcgtctcagtacgggatgccaaatgaccaaatcttcttccttgatgatgttatggagaataacaaggagtattcctatgaggaggagaccacttctgtcaatgtctacgacatgaggagcgccgaggtctcttcccctctgccgatggcctggaagcatgagatgatttctgcaacatggctgttcccttgggattgaagcgaaggtgtgttgccatgcaatctcgcagtgattattagttgtcctggaccattgtaggttgattgatttactgatgttaacttcatccgaattcgtcaggcctcagccttagtgtggtgactaagttcttttggggaaacctcaattatctgactgtagtttggtccatgtctaagtattttggagttgatgacacaatgctaatgttgtgaacttataatgaatcttttgtcaccagctgggcttatttgaattgtgtatgtttttatcagttcttcattgtgcaggtcatatttgaatagtgggccgttcaatcatggttaccacttatcagtagtaaccattgatgttctccgtatcacgttacaggatgcttttatttttgagctatctgttgctactgagaaagggtccctgccatcttaccgtaccctggtttgttcttgcctcctggttcatccctgaggccatgttcgtgaacattgcttgcttctgctggcaatttctcatggatatccttgtcgattttgaccgaaacccatgctgattatcgcattctggcaccaaatcagtcgctggagcaaggcaccaaactgatggcaggtttctgttttgtgggttgaattggaagtaaatcttgaagggaaagcttgtttcccaatgttttttttgccgcagtaactactgtttcccagtgtatacaagacataatgttttcttaaattaagtaggttgtctcatactctcatataaggatttcttaaattaagtaggttttctcttgggggttcagtgagctgtcatgatgccatggtgttaaaggacagcctgcattgtgtgtgtgtgtgtgtgtgtttgggggttacagcaacacattcgtatatatgctgtgacagatttgttaaaggaaaattataaagcagtgttcttccaaatcatgccaatcactaaggtcccaaacatataatcaattaatcaacattcttacctgtacatgttagctgttgaagaaaactattcaccttcagaaaatcagtacttccagagattcctgtaaaaaatactactggtattactgtaggttcataccgacctggagatctgataaatcacattgtttgtctgtagtctgtttagttcatttggcagctgcactttgttcagttcgtagtgcattagtgttttgtcaccgtagtcagcatccaagccttcctcctcatactcggcccttttcttctctaacaaaaactggataaacttttggataaaagtgacacacttttcaaaccactaaacggtgtgtttcatgcgaaaactttctatatgaaagttgttctaaaatataagattaatccatacttcaagtttgtaataatcaaaactcaattaatcacacattgttaccaccccgttttgcgtgaaacacttaatctttatcttcatcttcattttcaggagattcaaacactattgtatcaatcaccgaaacatcttccccgtgttagtaacattcttatcttactaaaccatccatgttaatcagggccatgaaccatgaatgtcaactgtcaagtactcaagtcctcaaactcaatttatagaaacaaaaactattagaaaagagagagagaacgacgccaatcagggctgtgaactatgaatgtcatgtactcaagtcctcaaactcaatttatttatagacaagaaaaatggtcgacgcgtctcctcctcctcctctcgcccccttgccgggtgccgctccggcccaggtgcccacccctcctccgccgtccagcccggccccggtgtcctcccccgctagcacaggttccttcctcggctctcctccctttccggagagagtcagcctcggctccctctccggcgactgctcggatggggattcgccagatctgcttcgccctcaattcctcccggcagatctggtcagtgaggcagcggatgcgcgtccccccgtggtgccagccaagatccagcaagttcccccctccacaggttcttcaggttttcaggcagccccgattttgctgcgcagggtgggtgaaggatttactcctcctgtgccctccggcttgaaggtaaagggagttactcctcagggtagcttcgttcaagcagcaagaggaatgacttcgccctcgcagcttcccaaagcaatcccggtaaatcttcagtctgagactgccacccgtcttcaagtttggcagacagtgaagccaaagcattggtggaggaagagacctgcccaacggccttcggcattcatgcgccttcaatccgctgctcctcctcagcttccctttgcattcactgatcgccaccaacctttcccctcgtagcccaagcaccttcaggaccaccgagttgctttaaagagcctcttcaacctttgaagagcggggtgtcactgcttccgttgtctagctcaggaccaccgagttgcttcctgtagagacccccttaggtgcattctctgtggcggttctggccacaaagcccgctggtgcccgggagacagacaatggcataggggggtccagcctcctcgccccactcctgctcctccgctagccagtcggcttgttttccctccgctcccggcaatgacgcgcccaggggaaccagccaacaggccggacagcatccagcgcgtcctgcccaggacatcggccatccgtgaggacgaaagtttcctttctcactccgcagcggtggtacaggttacaggcaatctcccagtgacgaacatgcgacagatcaacaggttgctggcgtccaggttttaggttcctcatgaggacctcaatgttgtcgtcttcccaaaaggaggctacctggtcacctgcacctctcggtcgctcagggacatgatggttgcggcaagcccttttgctgtggaggacattgacctctcggtgctcccgtggtcgagacgcgtccaggcagagctggtcaaatggcgcttcagcattcgtgtctgctttgaaggcatccccagccacgctaggtcggcagagacagttacaggtctgcttgatgaaggttgcttgatctaggaccttgatgagccaagaacggagaacgagacagcttgcctctgcgcctggctgtgggtggacgatccagactccatcccaaggaggtgcacttcgagcttgaagaaccgctgtccccacgctccccagactcacgctgggacctggacggagaggctcggcagaggacttcccctcccaagctgctggcctacccggtgctcgtgcatctcgatcaggtgctcaacttcaacccaccgccaactgagccaacttggatgnnnnnnnnnnnnnnnnnnnncagcggaatcatctcccctgtcttgatgacagaagaaatcccaaagcgtcatgattttatctggagcctcagcgtcaaggatggcactcttgcccctcagcctccggcttcccctagcccgggcccaggcagagatcgctcgcgctcacgttcccgctctccgccagcgagggagcgccgccgccccttgggttgggatgtccctcctgctcgcagctcagctttccccaggcgctcctcttccaggtcttcgaagaacataggtgggtcctacgggggtggtcaccgcagggcagcttgctctccggtgagggccgctcgctcaaggtctccgtgtggaaggtcatcccccccgccatcgctgtcggttcctgcagcgatgaaggatggcggctcccagctgtctcgccccccttctacacccccataggacccgatcacccaggccacccctcttcaggccaaccagtacgtgatggaggctgaccctatgctggaggagctggtagctgcccaggcgtcccagtccgccgtgctgatgtaggtctctcgggctgcccaatctcaaccttcccagttgcctctgatgatctccccagacaagcttgcagatttcctgtcccaggccttcgcagtggtgcagcctcctctgctcaaaactcccacgcgccaggtctccaagggaaagctcttgaagaagagcccgactcgtcttagccaggcgggccgcaagagtgctcggttggccaagaaggcagccgctcgttcctctccggccaagcaaggtgacctcgctcatgagctgctgatgaagaaggctggcctgctccctgaggacggcaagaagactgaggatgcaatggccaaatacgtcaagcttttcaagcagcctctctctcaggaggtcatggatgccttctctgctctggtggctggctgcgccattggtgacagcaagaagaagacttagttggcttcgtcgcttctcgatgtgttgttcccttttgctgtcatgagtctctgtagtagtgaaatgggttgtttgcttctcctgaggggtttagagtagtttagtttcttttggagctcctgtagctctagttggctttgttcttctatgctgtgcctcatgctccccctgtacctagttagacctcgatctagtaaggatggtccttcagtcatgtatccaggtcatgtctctacagaaaatgaagtgctcagttgcctctaccggccaagctctacctcatctcttcctgcgactgtgttttgcttctctactatgcttcaagcctcaccattcctacaggttgtgctcctccatccgcttgggatactgcaggtgcccatcccgttaaatgtctacaaatgattgtgccattttgagttggaatgttagaggcttaaactccacagcccatcagcaggttgtcagaaaccttgtcatggacataaactgctcctgtgtatgccttcaagaaactaaattagagttctttgatcaagcaatagtcaacagggttctaggtccttcgtttgcagataatttctgtttcccgccggctacaggtacaagaggaggtatcctgctggcagtgtctgactcaaaatactcgattgaaagtgtgcaaacaggtgtttactcgatcatggcaaatttaaaagaaaaagaagatggctcggcttggagcataacaggggtgtatggaccacaaccatacaatgaaaaaagagattttctggaggaactaaagcaaacaaagaacacagtaaatcaaaagtggatgatcttaggtgatttcaacctcattgtccaggactccgacaaaaataacagcaatcttaacaggggcatgatgcagtcctttagggcggctttaaacacgttggaagttattgaaataaaactaaatggccgtcgctacacctggtccagcgaaacagaaataccaaccttaacaaaaattgacagggtgttttgctcacatgagtgggaagaaaggttcccaaattgcttgctttcagctatctctacgatggtctcagatcattgtcctctgctgctaactgcaaacccttcggggcctaaatgcaaccttctcaggtttgaaaaatactggataaggctcccaggattcctagaaactgtgtagtctgcctggtcaaaacggtccactcgcctgatgccctgaaaagaattcatatcaagttagcccgaacggcgaaagcactaagaaactggagcagatgcagagttaggagtctaaagttgagaatggagatagcttctgagctgatccttagactagacttagcacaggaagagcggaacctctcagctcaggagatccttttcagaagatcccttaagcagaagctcttaggtctagcagccctagacagggtgcgacttcgtcaaagatccagacaagtatggatcaaagcaagtgacgcaaacactcggttctttcaaatcaaagctagcgcgagaagaaggaaaaacttcatacaacacctcctgacagactccgggatggttcactctcatgaagaaaaaggacaagaacttttcaatgtttacaagcagcactccgctgtgatcaatccctccttacaggaacacaaccttgacctcgctgatctagaagcacctttctcagttgaagaaatcaaaagtgcaatttttcaatcccgttcagacaactccccgggtctagatggcttcacaggtgctttttttaaaaaaatattgggacatcattcatgaagatatcacacaggcaataaatcaggtggcaaatcactcctctcaaagtctatggcttttgattttagcctacattgctttgcttccaaaaaaaagagaatgctcttcgtgtcagtgaattcagactcataagcctcatccatgcatttgggaaactcttttcaaagctccttgcaaacaaattagctccgaaacttcaacagcttgtgtcccacaatcaaagcgctttcataaaaggaagaaacatacaggacaacttcctcttcgtcaacaacttggtcaaagagctccattcttccaagaccccggcaattctcctcaaattagacattgccaaagccttcgactcagtcagctggccttaccttcttgacaggcttaggacgctggggttcggtagcagatggctaggttggatctgctccattcttggttcttcttcttctaaggtcctcctaaatggaagagcaggtagcagtttcatgcatggcaagggcctacggcagggtgacccgttatctccgattctcttcattctagccatagacccgcttcaaaaccttcttgtggctgcacaggatgaaggcttgctgcagccccttcataggagaactgcccgctttaacatggctctatatgcaaatgatgctgtcattttcaccaggctggtcaaggatgagatacaggcagtgcaggctatccttcttcactttggacgagcaacgggaatgatcactaacctaacaaaaagtgaggtttacgccatcagatgcaaagatctagacctccaggatattctttcccccttcccagcccagttgaaagaattcccgtgctcctaccttggcctacctctgcacatcagaaagcttcggaggcttgatgttcaacccctaattgacagatttgctgctcgccttcctacctggaaaggaaaacttctcaacaaaacaggtagagcggttctaatcaagtctaccctctcagctttgccaacctatcacctcacggtgttccccctcaagaaatgggtagagaaaaagatagacaagattcgcagggctttcttatggacaggttctgagcaggctaatggaggtcactgtctagtcaactggaagagggtttgcagatcaaaagatttaattagggggactcgacattactaatttggaactttttggtcgtgcactcagactgaggtggttatggtatgattggacagctcaggacaaactgtggcagggctcaaaccttccctgtgatgaaacagataagcaactcttcagggcctccaccatcatctccttaggaaatggtaacaaagccaaattctggcatgaacgatggctggaaggtaaagctcctaaagatattgccccatccttatttcagatcgcatccaggaaaaacaggacggttgcccaggaacttggcgataatcgctggcttcgtcagatgcggagaatgaacagcacggtccaagtcagggagttcatcattctttggcactctctgcagcaaattcatttgcaggatggcattgaggattccatatcatggagatggaccccaaatggatgctattcggctagctcggcttacaggatccagtttctaggaagtatacaggacaacagatcaactttcgtttggaaggccaaaacggaaaataaatgcaaattctttggctggctgatgattcacagaaaaatcctcactgctgataaacttcaactaaggggctgggataacagtgagatctgtcccctctgcggcattgaaccagaaacggctaatcacctactcatggattgtgccttcgcaagacaagtttggagctccatgtggaacaagcttggcctacacatgccttcaccctctctttttccggggcgtttgctagattggtgggaggcttgcaggaaggagctagttaaggaacaaagacgtaattttgatggccttttcatctacactgcctggggcatttggctgcaaagaaatggaaggattttcaatgacatttacaactcggtagctcaggtcgttaatttcatcattgctttgtgcaaagagtttgatgaagcccttagttcctagatgagttttctacgccttctacttcttgttgcagttcactttctcaagattggggtttcccatctgtttttaatctcgcaagctgtacgcttgccctcagcttgcatggctggcttgtaaaacgacctccttttctgctcctccttttatgaaattggcagagctcctgccgtcttcccctcaaaaaaaatttatttatagacaaaaaaaacgtattagaaaacagagaaaaaacaacgcccaccgtggggctcgaacccacgaccacaaggttaagagccttgcgctctaccgactgagctagacgggcctacacaactgagcaactataaattctaaccagtaatatttctgaatcttacaaaactgctgtatgattccatcaaattataggctcaaacagttaaaacagtagacaatagaactggtgaccaaagatcacatgccatttcaacctagagtctcccttctcctggcccacaaaaatcttgctaatcactaaggtccgtcacataaaaccaattaaccaactaaccaacattatttcctatatacgttagctattgaggaagctatcatctttaaagaatttgtgctgtcagagatttctgtagataaaaaaaaactgctggtatgattatcctgtagagtatgaacacagacctgaagatctgctaaatcacattgtcgtttgcctgtattctcacacttctcacgtctaggtcatttgtcagccgcgctttgttcaattcggaactgcattaatggtttctcatcatcgtcagcatccaccccttcctccccatactcaatattgatcaccgacacaccttccccattgtaataatcactggtccgatgagatctgtccggttcaatccgctgcagctctgaagttatcagcgaatccattcttgccctctccctgtctcgaggatatgtttggtacaacagggagtagatgaagcaacagagtagcatcgggatggctattgccgtgtaaagagccttggctagggcagcggcattttccttgtccctctcaacactgcttatgccaactccataagtgattgggttgtagccgtatgcatgctctgctagatacccgacaactggtggagcgaatgaagcaaataaagattcaagggaacgatcgagtgcataaatactagtccttgatctctcaggaacaatctctgcaaatatagggctacaggcaaaaacaaattagtcaaatcagtaggaataatcacaaacacatatagtcaaatcagtaggaatttggaagtttactgctattattctcatgacatgatatataatatgattcctccttttcaaaaaacttatgctatgccttttggctctaatcaagaaattatgaaaaggctggtacatcatccagaacacataaattttgtaacatatctttagttttccatctcaagattatattttaccttcggaaagaactactatttttccaaaattccaaaatggattacggttttgcacaaaacatgactttagagtactgaaattttagtttctttgacaaattctttcaatatcaaagaaagcaacgaactggtacatgttgcttacttgtttgtagcaggagcattccaggagatgcaaaatcccacaatgaacatgactgaaccatgcaaaaaacctgtagatgggtcttcaggcaagcctagcagtaaaagagccgcaagaggaattgcagaagcggagcttatctgagatatgactattctaccaaaatttggatagtgcttagcaagataatcccccatttttccaccaaacagtcctcccagtgagcttgctactgcagatgtgaccatgagaattccagttcccttatgcgtaaaacccatcaactccagccacattggagcaaatgataaggcagaccatggaaatgaacctgtaattccctgcgctacaatgatttgaaaagatggtattttcacaacagccttagcttccaccaccaaatccttcatttctctccaagcagacttgcggacatgctgctttttgtttccaaaattgatataatgaggatccaccgcgaataggcgaaccaatataccaactgtgacactgatgagagcaacaacatgaaaggcaatgcgccaaccagcaatgcccatgaatgtagtagatgctagcatgatggagaacaaccctcctatcagagaccccaaatttccagtaagttgaagccatccaaatgctgatccccgtgaattgtcatcggagtagtctgccaccaaagattgaatagcaggggttacaagtgctagcccaataccattcattcctcttgctacagctacctacacaaaataattgtcatttcaagtaagataaggtcatgccaactcttaattctataggcagaatagttttctctatttaactgctgtaacttgccaacattattggttacaccagcctattctaatatcagatctcacctagtaacataacaagaaaaataaacagacaggaaattcatgcctgaaaattaaagctggattcaaatagaggtctgcatcgtatgattcgtcactatatccacggaatcagctcagatcggtgtgcccaatacatgaatgtatttatagcacacaagcttagaatagcacggtcaaatactcacatgttgaataatcaacaaaaatggccagctgagactactgaatcctagaggtacaaaatgcgtccatccttcgatccgaaatgcgatctggagttctgaacagcagaattggacaaattttgctatgaacgggcctagatcttcggcaaggtaaagtgaaacagactggaatatttggtaacaactaaaaagcaggaatcgagatattccgaggggaattggaatcagacctgcgcgaagttgtcggagacggcgacgaggaaggtcgcggcggcccagaggaaggccccgagcgcgacgacgcgggcgcggtcgtagcggacggcggcgtaggcggcgagcgggtagcaggcggcctgcaccgaggagcggcacagcgtgagggcgccgagcgccgcgggcgtggcgcgcagcgcctccccgacctcccggtacaccgccgggaggagcgcctcgtcggcgcgctccatgatggccgccaggttgaccagcaccagcgtccgcctcgccgcctcctccatcgccggcggcgcggcgcggcgcggcgtggcgcggcctcgcctcccgatctcggaaccctcgccgcgttgatgtttgagttggatcttcttgcagcggtagtcttgctggtagagggaaattggtaacggccaacgggcagaagatgctactcttgcaaataggacctttgctcgatgagcaattttaaaaaaatcaagtacaagaaatttttaagacaaatttaagcaaataattctgtccaatgtaatatacgaaataatgtttatatgcttgaagttttaaattttactaaaggcatgactagtattatgcccatgttttacaaggaaccatgctcatatagttagggattaactggttgggtggattaaaaataaagcacgagcatttgactttcttcgtatgatgagaaagggatgaaaagatgacgactgcacttttatcatgacaaaaagaagccattgtcactcacatttagggtctttttatttggtgaaatgaaaatttttgggtatcacatcggacgtttgaccgtatgctggaaggtgttttcggacataaatgaaaaaaactaatttaataacttgtctggaaaccgcgagacgaatcttttgagcctaattaagccgtcattagcacatgtgggttactgtagcacttatggttaatcatggactaattagactcaaaagattcgtctcgcgatttatatgcaaactgtacaatcagtttttctttttatctatatttaatgctctatacatgtgtccaaagattcgatatgatgttttcgtgaaaagtttttggaaactaaacagtgacttagggaatactccctccgtcccaatatattagaacctaggatgggattagacctatcctaaaactatgaatctggacatctttgaaaaaaattacgtaagcatatgttggagtgaataattttttaaaaaaatcttcatctatctaaatagtctagattctcacaaaatttgtattatagaatttaaaaattaaactgaagctagaagatacaagaaaatccagtagtttttctatattctcaacagctaactgtgacaatctggagtttcgtcttatggcgctgcgtacactcatggaacacaaaaaccgtgaaaagcagggtgccgtgcgcaagaatccaacagccgaagctccggagatctccatgcagggaggaggaggaggatattggcgaggtgcggcggaatatcccgccgcgtaggcgacggacgtacgtcgtcaagccaaagtctcaagccggcacaccgaagccgagtcaaagtggcgtacgtgggccgcgtcgctgcgaggccatcgcgacccactcaccacgaaaaagaagaggtcaccagcccacgtctatcaactaaaggaaaaagtccagtttgactccttcaaagtacgccgaatctaattcataccctttaaccagaacaccgggtagaatgactccctcaactattaaaaccggtataatttggctccctcaacggttttggagggcggtttcgctgacgtggcactttgactcggtccaaccggctgactcagccatatgggacccacatgtcaatgtcacattttcctcttctttctttctcgttttcccctctttttctccatggcgctgcgcggtgactagcggcgacgtcttctctgtacccgtgctgctaccgctggtggagtatgccgagcgcgccacacgggacggcgtatccgtgaactttaacgcaccgcagttcatcggtgatggcggggaggaggtaacattcgtgtcggagcgaggcggcgcggcggggctgttcctgtgtcagccggggtccgagtgggtcgagccgcacctggcggtagggcgtttgggcgcaccgcgccaccgcttcatctccaagtcggcccatcgccgttccccctctaggtcctgccaccgccactccgatcaaggccggggcaatgccacgcgtcaggagatccaaccaccgcttcgcctcaaggccacggtgttgattcgccttggcccatgtcattgctccacttaaagaaatttgcatatgtgccatccttaaaaactggcttcgctagaatgccatcgttaaaatgggattcgcccgaatgccaccctcaagctgtgggcattcgccacaatgtcatttccgctatttcttgcactttcggcccctgtcgccaccgccgtcgccgcctccttccgcgcgcttgcgccgctaggcccgcttccctccctagcgccggcgcgccgacgtcgccccctctcggttccctgcgggtggagagagaagagaggagaggatgagagaagaaagaagatgaagcccggggcaaaaaggtccgagaaaaaatgaaatggatggaaaataatttacaagtgcaagaaatagcgaaaatggcattgtagcgaatgcccacagcttaagggtggcattcgagcaaatcccattttgatgatggcattctagcgaagccagtttttaaggatggcacatatgcaaatttctcctccgctttcgacgcaggtcgccaccgccaccacctacgagggagatcgacattgcatcgcgaatgagtggtgaaagcctaaaagggggagatgggattcaataggcgaggcgcgcaccgagggggttcttctgcttccttgtctcacggcggtgatcctccatctctagtcgaacaccgtggtcgccttcatcaccgtctcccgtgacaacaatcctgtggtgtccgtctcgtgtggcggcgctcggcgtactccaccagtggcaacggcacgagcgcagagaagacatcgccgccagccatcgcgtagcgccatggagaaagattgggggaaacgagaaaagaaagagagaagaggaaaatgtgacattgacatgtggggtccatatgctgagtcagccggttggaccgggtcaaagcgctacgtcagcaaaaccgcccttcaaaactgccgagagagtcaaattataccagttttaatagttgagggagtcattctacccggttttctggttaaggggtacgaattagattcggcatacttttaagggagttaaagtggactttttcctcaactaaaccagcccactcatgcagcgccgcatgcatccgcgcccgcgacagcgcaaggagccaaggccttcacagttcagcaccgcgcgcggggcacggctgcacgacgcgctgctgtgctgagcaccgcgtgcagtggtggggcgggcgcgtcacgccaggtgcgccgcccgcacggcttgtctgttgtgtgtttccggctccaccgatcgagcgtctcggcgtcggcgtcggcgtcggcgtaggctgtggctgtgccgccgcgcgcggacgacacggctttcctgcttcgttttgcgggcggatgacggcatacatgctcctgtacacacccgaatcatatcccacggcgttgtacgatctgagatcgcaacagtagcctgtgcccagtagccaccgaatagaagttactatgccaccacgccacgaactgatcatatcgaaattgaacaattatatttacattttaattcaaaatattgtgaccaaaaaagaaaaagaaaagaaagaagattgccccttcgttttttagggagctgggttgcgtgatcccatcctgatctttgccaaatgacacgctccaaagagcaaaaggtcgccttctttacgtcgagtcgtgtctgtccgtttcagacaaagaaatctccggcgaactcatccacatccagcttggctggatggttttgctagcaaaagaggagcatcccgaggacagcatcagcaacaaccgtccatgcaattggtcatcatcatcgaaaggcccggccggtgctgtccacggcttggcacttgggcttttaacctctttgcaaggggaacaagctgggatctgtcatatgttggtgtctgacgtgagtgaggtacaaaggcctcctatgcttgtagtaccctctagctaccctattccttttttcttgctcttgttttttcaacttttttctagtgtccactgctacgtactagttgtagtatgattgtatctttcatgcatagatagatagccatggtacagtacaacttgtttaccgtctattatatcataatattgaggatgcgttgattgatttgttcattattcctcttatgatcggaaattaattacacctttgctattcatcaagtgactaaaatttgtgcaaattacaaattatacctaaccctggtcattagatcaaaatataatggtcagagcatcatcttcaatcttgaattgtggtttactatttctctttggacaagaagagaggagaggttgggagatggcggactgatagattagacggttgcggcaatgaaacctctgatagactacctatggactaaagtttttgtgttggggaaggtttaagacataggaaacggtgagagggcttcaaagggatggcttgggtggtgaaagactggtggtaggcaaaaaaaaaaaaacgtgaaggtggtgagtggatggaggagggtatcggacggtgtcatgccaggactgatgcagaggcgcaatgacagcgagacaatatggtggcaatggtagaggatgagaaaacagtcgacgattagagtgtagcatgataaatctaggtagtcctaataaggtggaggtggagggaggccgacagatgacgtgtatggtggtgacgttgtgtgagtaatgagaggtgttaatcagtgcacgttagaaggaaagaaatgtaaattatagagtagtacgaagcttgactgcttgaggtattcctagacattcaaaaagaattaactgaaatttaaagagaaatcgaccgttgactgatgaaatagcaagtccaattaattacgtgtagcattagaggactgctcgtggtttaatttgctacttctctttcgacaattgatggcttagacttggacgtcgattgatgcttagacaagcacaatgtacattaacggtgactatccccgtatagtaggagtatatagtacgatctggatcgaatctttgggtgttctcttttgagcccaatcaggtaaagcagctagcacacacttgcgcctttgtacgtcacaaaactaagagcgctagctagtgagctacggtgtagctagtcatggtgatatgtgactagctagtgtcgttgtgagaaggtgactcgatggatcagctgggtcgatctcatgcctctctcatgaatgtacgtgcattgcttgaatattcttcttgtacaaactggaattaatactgcttcaaagttcaaattaaccggtcgagttaccccggccacttcaatctaatggataatggcccgttcgaatgagccaaaatgctcagctaatcggtggcacctgaatcaggatagatcattagcgcatgaataattaagtactacatattacaaattagaaaaatgacttttataaaaaaaacttattcatatattttttttttcataaaacacaccatttaatagtttggaagtcgtgctaacggaaaacgagaaatttatcatttggtgttgctagaaagaactcaaccatttggtgtttttttaaaactgttaaaattttcctcagtcttttgacctatgtatcacttatgttgtgttgtggcgtccaattagctggaaaaataaaaatggcttaacatgttatctttctactaatgtgcttctttctcctccatatagttgtctaaaaaaatcaactttttcatatattttttcatctcaacaaactctgatgagcttggttcttcttcctcctaacagagagcgtgtttacacacaatggatggcttgatgacaatatgagaagtgaggtttgtggtgagttcgtatggaaggacaatctgggtcagcaccctcgcggggcatggcaccatcttaacgtcctcatctctttcacctatgtgtttctaccgtcacttcatccacgagctcctccgctgcaagctccgcttacacaaccgcctcctacctaagttggcctttaatttgtcgaacaagcggagctttgtctttgccacgtgacacctatcctctatgaaatcaattggctaagctcatgaaagatatgtagtggggggtgagctcaaggaagatggtagcggggtgagctcaagaggatgggaggatggcagtggacatgccaatccactgctgcttgtagctctatgttcactgaccgcaactacgagaatccatccaaaatttgtatgagtgatgcccgatagagacagagttggtttgtttgatagtcataatagccctccagccgtcagctctccaccacctgtgtcatcctcctgccatcgtctctccgccacccatgcgttcccctactctcggctctgtgttgtagtcttcttgacacgtcctcacgtcctcgctcttctccgtttgccactagattgacacaactgcacttctgtactgtgtcatcctcctgctattttctttatctctctcacgatgacttgctggcctaggtgtaggagctcgacagcggcatccttagggagcctaccagtggtggcctgtcattgcattaggaaaagagagaagaaagaagagagagaaagaggggcggaggaagaagatcgatggccgaagtagacattgacaaagttaatctctgttttatgtcactgtactacgtaccatgttataattgagaggtaaattgaagagttcaaaagttaaaaagaagggtttgataaatgattttaaatttgagagttcgtgctctagacaaacactacactaggttatcaattggacttatccctcgattggctgatttacaggcatgcgttagcttgtcagacagtagtgatcgacgcgaggatatcagattggcctacccacctacctattccctccataaaaaaactaatttctgcgtacaaatatggacttcacattcatcccggaattttttttttggaataaagtatttagttgtgcatgcgtgtgcatgccaccagtctccagctagcttgcccgtagaggttttcgccgtgcacgggcgagcgacggtcatcggccaaggcagcgagagtgaacgatcgatgcgcacgcgcggtgtctcgtggccggtcgtacgtacgtgcgtgtagccatctactaccatactgactagtgtacgcgcgcgtcggcatctcgatcgttaacccgccagtgggatgtggccctgtgcgggggcgatagctagatcggtccatatctctcgcctgcttgccggcctctcctacgactcgtcggtccctcagagtcacttgacaggcatggccgtggcgtgcagggtgcgcgcatcgctgcgccgctactggctggctgcagccagcaatcatcatgccgtggcgtattgggggtgtgcgtgcctgcctgcgctgcgctgagcccctcctgctgacccacccactctagctccgcggattagctaggaggcgatcgattgtcacctttatactacaacgttgaaatattttgattgttcttgcagtatctggtaatcgacgtacagtacgtggtttacagcttttacagcgcacaaaaagatcagtgctactccctccatttaaaaatataagtatctttttagtctatcacaatcttcgatatattactttaaccaacaatatcataaaaataacatgttttaaataaaaaattatatattaagatagattgtttaatgataaatctattaacatcaatttacatggttattttttttatttttttctattaatagtgaaagttaaaaatactccctccatctatttttgataggcatatttctaaattaaaaaaaaatatttttgatagttatatttcaattcaataacatatcgtcttaatgactttcttggatttaatgtatgactatccatttttccatacaagattggttacatgggcatctagaaatataaatattaatgaattgcttgtttacgagaaatgactagtagcatgtttaaatggatgataagtagaattacttatccttgctctgtgtaccaagataaaatatgactatcaaaaagtagatagaggaagtatttaattttgatactatgctaaaaatgcttatattttggtacgaagggagtatcatttaaacatggaaaagctccgtacctccagacgtgaaaaagctacacacctctgcatgtgcggtttgtttgttgacgctgtgtgctccattttgttgcagagcctgcgctcgctgcgttcgcctggctcgatgggcgcttcgacgaccgccctttgcctgcatccctccactttgtccccctcccccctccgaaagcccactgcatgcttagctcgatctccgcttcaattcacggcttttaccttttgtgttcttgtacgcgctttacggcttttgttgacttccacatatcgggacattcacaagacaatacatgcaccagcagcaatgcattgcatttgcatggtggaacatggctttaaaatcactgcaccactaactatctagtcgttggctaactttcaacctctattttattatacaacatggctttaaaatcactgcaccactaactatctattcgttggctaactttcaacctctattttattacttgagcttgacttttatttacgcatgtattattgttggtacggagacaactagataatcagtgaaaagtcacatatataaatcacacaacacaaatatatggaccctgagaagggtgggcatcggggtgagtcgaggctgataaatttggttttactgatggttaccgtacttccttcgtgactcttaggaaaaatcatgactcatgcagcgccatgtcccagccattctctcggtctcaaccctaagccagcaatcgtggcaaaatagagcttatccttgttctcaagatctttgaatccttattaggatatcgtcaggtcatacgtgttgcaaccaatggaattaaaaaaaatgacgcttgacttgaaggctaccttgcacattgttgctatggatggatgaatggtgacgagtggcaatgtgggagcaagaactagaggaggatggacgacggcggtaggttggaggtcatgactgtgaggaagttgattttgtggcgtgcatggatttaggtatagggataaggattttgagtgctaggcagggtttacctatcctttttaagtagaaaattgttccccaccagtttatcaaaaaccgatcaaaaattggtgactttccgtcaacgccatatagaaactggctaaaactgatcgattttcacaaaccgacacttcacattttaacgaaaaccaaccgatttttcacgaaaactgatcattttttgaaccctgatgctagcgtgttgccgtttgttgttgggcctggtgggtattttgctactctcaaaataaacaaacatagtatgggagatgtgatgcatgtgtgtatagttccatgctttttgtagtttctcggtcctaaggatcactcaatgatgaaattaataacctgattgttacctctagaagaattatgagatcaatgggtgtacaaataccctagagaggcggggtccttgttagggcaagagcaacgcgagacacgcgtgtctctgccctcctgaaactgtaaaatcgaagtcagagtgacaagctctacagcacatgcgcaaggggattgtggcttcggtgcggcgcgaggggatgaggaatcagagccacgagctccacaatgcaagcgcctctacgttttctgggcccggcgtcgtctcgtgatggcgaaaaacgcgtctccttgcgtaggggctagaggctcagcagagatgcgcatttagtcaacacttaggcgaatatctgagctggtgaacgaaggaacttgccacatcctcagcaccataaaggcccttaggtccatggccccaatgggtaaattgcctctctttgtattaggcggaggcattcttctcacacgctctgagggtagtagtactgcaaggcacgctatgcatgcctctggcctatttgtgcgatgaaattggcccaaaagccatgcaccccacattgctcgtgacccaacaaaaagaatcctcgaaccaacaaatccttgaccccacatccacctaccccttcgagcttatcctcacgcaccaatgaaaaaaaatccggcgcttctccttcccatcccccgcgctgcttctccctcccccccatccactgcacgcttctccccccaaatccgtcgcgccgcttctccttgccacccactgcgccgcttctcccccaaatccatcgtgccatttcttccccaatccgcctcgctcctcctctcttggccaacgacgaggagacggaccatcgagggctcggaggatgcatggtggcagcgcgcggatccgtagtggagcagtgacaacgtcctcatgctcgtctccgggaagcgctgagcggagtagtgatggagcaactcgtggtcgtcgtccttctcgctttgagaggcagccccagtggtggatatctgtgtcaccggctggtggtacttcaaaccaccgggggcggtgtccaccatgccgtctcctccacccccccccccccaaaaaaatcccctacgccacttctcctccgtcgcgccgtttctccatcctccccatccaccggcgcatcgatgcagacagagccagataggagtgaggattccagtgcgggagtgaggatgcagagcgagggagcgaacgattggagcgatgacctccacagcgcaggtttcctgcgtcgcgtgccctcccactactacgaaaaccatctttcgtggcggccattttgagtcttcgctggtggcatttggcaccgccacaaagcaaaggataatgaaaatgtagcatcttcgctgacggcgctaaaccgctagaggagataacttttcgctggcggccagctaaagacagccgctagcgaaaatcgtcttcactggaggctgacgtatgtgggccgccagagaaaatagtcttcgctggcggctaccttatttgctccactaggaaaaaatagtctttgctggcggcttcattacatgggccaccagtgaaaatgattttccataaaaaaataatccccaaaatctcttttcgccaaaaaaaaagaaaataaatcagattttcgcagcatgtacagattcaaatccacatccaaaattttgagcatcgatttaaatcctcatccagagttcattagattcagttaacatggaagtgaacacagcatacaagcattttgaacataaaaaaaaagaaaaacagcatcaacagaagagaggaaggaggtcgttgtcgccgtcgccgaccgagcagcaccggatgtgtgagccccattgccgagcatcactgcctccgagctccttctgccgcaccaagccccccgtcgccgctgcagtcgcatcgctgtcgccacgcccccgcctcccttcgcagtcaccgttgcccccccatggctcctcccgtcgccgtcgccgtgcccccacctcccgtcgcagtcactgtcgcgccccacgacggctcctcccgtcgccgtcgccacgcccccccccccccgacgaccgtctctcgtcgccaccgcgcacagctgccggagccaccgccgccgacgctgcctaggaggagaggacgccgacgccgtggatctgtagaagggaggaggaaaggagaggtgggtgctagagaagatctggatctggatctggagggggaggaggagagttggagatatttttattctggagaggtgggtggataagagcaggtacaatagcaggctataagccagctataaacatattttaaagagataaaaaaagagagagaagagcagcgggctatagatctgtagccagctgcagcatggactccaagacgtaatgtgtgtatgacaggtgggaccaggtattaagagcatgtttggtacaattccaacttctaaatttagttataggagttgagtctggagtggagttgtggagccgactaaacccagctccacaactctaatacaatttgtgagagagctccacccaactccacttccagttttggtggagctgaaactgtttggctgagctccaactccaggaggggtggagctggagctggagctgtgccaaataggccctaatagtatagtaagcaactattgtatgaattggctattacatttgctatatatgatttgaagctagtagtggactatactattaagactatactattaaacttgctctaaggagcatgggcggtgcgtgattttttgttaatagatggtggttccttctagatttttcctgacggttgcttaagtgggccgctagcaaaaaaaaataattgtatcttccctgccggactatataacccaaccgccggcgaaaattatccatcttcgctggtggcacatctaagtgaccgctagcgaaaataaatacatcttcgctggcggccggtataacgttgtcgccacgtatgcgcaggtccgacgtgacgcgggaggctgataactcgccacgtccttacaatgtgaaaggccagatgagaaaagcccccgtatctaatcttgggtgcttggcccgaaattatatgcgctgacgtcgtacgtgtagctagcatgatcatccatgtagccatatactactcctactcctaggtcgaaggtggcacagacagccatgcattcatgcatgccatatactcctaccataggcaattgagactgagaggtcacccctcacatgacatgagtattggaaatgctagtagcatcatcagcatggacgcacaggagaggagagagtgatatgatcgagcagaagagagaccagaccaagccagccatcattgcaaagcagcagattgttcgctgccatgggctaccatgcttatgaatgatgcctttgggccttttggctctcgctgctgccattgcatgccaaccccaacaaggactcacatgtctcgactctcaactctctctctctctctctctctctctctctctctctctctctctctctccatgaaaaacattttaggcagagagggaacatcagaacactactaatctgaatgactgtgtaataatcatgatctcacttttgctgtatccatgatttgcatatcagcgaaaaggagaaaaataaagaggtttggcattcagttaataatgcccactttttacatcgaggttttatagcctttcttctgtgcaagcatttatacggtaatcactagcatcacagaggcgcatgccttaatcatccccagatcattcgttcagaaaaagatgcacttttttagaacggaaagattgatgaaaaagatggttgcgtacgtgtagacggtcaacgtttcagtctagtctctcgcacgaacagtgccagattccgtagcatatatatatgtccacatcgaaatatcaaatgcagagagatcacatccaatagtcgctaaaacgagaaatttgatcattacagtttctcacggaatctctcctttgatgatacctacatccggtgacaccaacatcagtaattggtgtttgccggacttctccgttcttgaggaagatgtttttagtctaattaccacaaagagatttataaatatctttaggtacgaagaattacttttactccgtagtataatagtgcagaactggagttgcagttgcatgactttaattatcagagatcaaatattggtatctgtaaacgtacgtttggtttaaaggatggaatatttcgagttggatctggtttaaaggatggaatatatcgagttggatccgtatttgatttgaggatatataggtggaatgaaatgatcactgaaagagaatttctttttaagaaccaggttagacatattaaaaaaccgatccactaatccaacccatattaatttactctatcgcttaacacatgtgagacatccttaaaagggtaaaagagtagaacaccaacaatttcatctcatgtcaaatggacggattggatcgaccatcccatcttaaaaatataaataactcatctcaccttgtcttcaaaacacatacttagtgttattcgctttaataaaaaattgataaatctagggatttgctttggcctcctctctttaagcatgtcataggcaaattaaaaaaaaacaacaacataatttaacagaattcacattagttttaactagctactccctttgtccaatcttaaaatataacaacttttatggttcaaattttaccaaaaatatagtaatttccgcctatcccctcatcttaaccatcacaaccaaggtaattgatattgcgatataagatagtatcaatttttcatgatagtatcataagttcgagatcctaccaaattttaaattttcatatttttatatagcatttgtagtatatatgttgtataaattgaagcctataatattgttttagataaatctaatgaacattttgaaacttgaatgaacttattcacattatttacagttcactctattttaattttgtaagatcatagggatcgagatactatatgtgtgatccggtagcattaaaagtacgtcttgtagatatagacgtttttctaatactgtaaatgcattttaaatatctttacaatattgtagagcattaaaatgcctcatacgtaactgttggtaaattgtctttagaaacaagaggcgttttaaaaagaatatctctataccgtttagtattctttttataaaaaaaatagaggcactttctagatgtattaaattatgctacaactatagcaaattaacaaggtaaatcaatgtagaaaacgattaaaaaaagctaatttgctattgccgattcttgaacccaagacatcgatcaatacatcatttttatactctcatatcattagttgtaaatatgtgtcttgcattagttaactctagttacttagtgtacattaatattaaaaaaattgcctccacacaagtttaaatgcctttacacatgagatagattttaaagcaccaaaaaaatacctctacaatataagattaacagaatgtgctaaatatctctagagcgtctctacagtaaaagtatggtttaagaagcaatttgaaaaatggctttagaaaagtgtcccaatgtaagtttttttttgaagtataggatagtatggaatagatggtaagatcaaacactatcaaattaggatactaagtgagatctatatcgcttcgatttagtaagattatggtattgtaggatattaagatacatatccaaagtgtggatattttaggggaaaaagagtaactcttatagagcaggagttgatgtacaattatgtttacaatagaatccaatacaagtacacgactcttgtttcaaataatagttaatctttctcagcgcaattacgtgaaaatgtgcgctatttttgataaaaaaaataaagtaaatttcacaaagctacaaatacttgaaccaaattgtcgcaaaactacataaatatgtatcacaaaactataaatttagcaccaaaattttcacggatttaatgcatcgtatcataaaactacaaatttaacaatgaagttattaaagaactatatattttagaatttagaaccataacactgttatgtatctaaaattacaaaagttgtagttttgtgataaaattgttgttaaatctgtagttttgtaaatttgtaaattcgtgataaattcgatattaaatctataatttcatgatacactttcttaaatttgtagtttgatgataattcaataaaagtctctatagttttttttaaatctatctattatatactaaaagtccattaatcttcctacaaacactcccaagctgccacgtggcactcctacaaacgctcctaggtcgccatgtggcatagtctaatctcaccgtcgattttcatttaaattggtggacccgttattttataccgttagattagatttatacataacgtcgattttcgtttaaattagtggacccactattttataccaacagattagatctatatatatattacctttctccgtacggtttgccgaaggaatagaacgtacgtacgtacatacgacaaccaaaataaaacatacatgattagtactatcaaaaagcaaatatctacaatataaagttgaaatatattggcccacaaatatacacatgcagctgaactaattttaatgttgattttcacttaaattgagatggattcatattttatctatatgtgttattgattttcaaattagtggacctgttattttatactattaaatatgtaacacctttctcatgtacataatatttgccggaagaaaaaaatgcatgtacttactataaagatagagctaaagtaaaacataagtacttagtaccatctgaaaaaatcgatggcctttaaaatagaactatctacaatataaagatgaaatatattgcatgtagtgttaaactagatctataatataaatatcaaatcaaccatctataaatgttcatcttttaaaattattttaaaattatatatctaatttgtgatcctacaaacacttctaagtcgccatatggagctcttacaaatgctcctaggccgccacgtggtactgtgtagtctcaccctcgattttcgtttaaattggtgcacctgtttagaccattagatcagatgtatacatagtacctattaaaaaaagtaggattgaaaaggaaataaagtttcggtagtactgtccgcagcaagaaaaaatattatatactaatagtctactaaactacctaaaaaattctaagttgctatgcggtgctcctacaaatgctcttagatcgtcatgtggcactatataatctcactatcaatttttatttaaattggtggatcacgtggcatacaaatggctaagttgaggtggcccaagtatgttatagtactctatgagaatgttatagtaaattaggaattaaaattgtgctttatgctgatcttgaggggacacagctacatcgatgaggtacccaactttcaaggtaatagatcacctattagtgaggcattcatgtttaacttaaaggttgttatcctattagttggtagaaagtgatacttttagaatatttatatatggatttggaaataagtgagacatgaagacttagctaagtagtgcattaatgatatattaggcttattttatttgcacatatgcaatttcatctattaataggtaatgaacttttataatagtgataatgagttgttacgataaatggagaatttctatgtgatcggaacaaagtgttttttttactaaaagtccattaaatttcatacaaatactcttaagccgccacatgtcactcctacaaatgcttctataccgtcacgtgacactttcctttaaatcggtagacccaatattttaaattattagattattaattttcaccattaaattttatcttccaaaaaaaaaatctgtacgttcccccctccgaacacaagttcacgtaatacgttttaaaacgaaaaaaaatgcgcacatgtatgtacgtactccctctctccccgtctaaccctccctttccatctttccaattttctggctaacaaccaaatgcatagtataaaaattaattagatagctaaataatctcttggtacatatatttttatataaaaattataatatgtaacttggatgtatatacccttaatttccaggggcgaactcaaaaataaaattatcaagacattacttggatatataccctttgttttcagtggtgaacccataaaaagattatcaggacactacacacacaaattatttaattattgattgatatattaattaatatgacatgaattatctattattatatattaaaagtccattagatgtcctacaaattctttcaagctaccacatagcttcctataaacattcctaaatcaccatatgacgctctaatatatcttaatataaaaatttttgagaaaaaacaatcatcttacccaaaccagtagaccttattttaaaatgttagatctatatcttaataataaaacttatggatcgactaggccgtcaaaatccgtatgtacaatgcacatatccacttccctccttacatatgagacgaacccaccggctctcgcctccttgttttcccttacggcaattaaattaaccaccggataaaagaaaatcctaaaaattatccctaaagaaatccaccttaatcttttaataaaaatggtggactcagtacttaataattttttaataaaaatggtggactcattactttatactattagacatctaacgacttctactaacttaattatatctctcaacatatataccatatatacgaggtctatttacctatacaaatatgtaaagctaaatcaatctacaaacgtacagataaatccgttaatccgtatatgaatgaagttctttttaattactatgtccatcctatattgaatcctaaaattttataggaattaaggaagaatgaaaaaaatatactaagattcccctctctaaataagactcattaaatatgaggtatgtgcagagttagaagatagttagagtactgttggataaaaattgaataatggatggttggatgggacgagtagtattaaaatcctttatatcttaggataaaatttgaatccttcaatttatggatggaggtagtacaagcaaatagacatatgtaattatgtctttaattagataaagaagtcacattaccgtattttttaatatgaaatttcttaacttaatatatcctaaaatctattaatacatctttagtatacaagaaaaagtattacttaaaagtttaaattaagatgctaaatttttttaaaaaagaaacacatgtagtataaatgatagtttcatatgaaccggatccattgttgcgacattttttcttataaatttaagacgacatgattcaagtaattttagtttacaatttgtaacaactcgttctccagaacaacacatcccagcccattcaaccggcacgtccacttacaaataccacccacacttacactttcgttctcgctttatgtaaaatagtcaacacgaaaatgatatggttagaagggcagtgccttacaagttggttgcactcttgcttaactagcaatacggtagtactgaagtgcacacaacgcttatagacaacacatatcatattctttcaataaaacataggccatatcctaatcgaattaggatgtcacagacacccctcaaaggacctgacgtccccgtcggtccaacatgtgtatagacaaatgtcacagacaccccccttaaaggacctgacatccccgtcggtccaacatgcgtatagacaaatgtccagaaacatgtcccttttagcacacgtccgtacgtccaatgatcgaaactaactttcaaaacattcccaaacaaattattgatatatacatatttagaagagaaattttttgaaaaagaaatcatatatacataaacattcataacaaaattttaaacactactaaataagatgcccaaattttaaacactactaaataagatgcccgcgcatcagcgcggctacctttctagtttactttaaaaatagtgtatttgtcactgggcacatattattcaatcagtaacctacacatagtgaaaaataatatactattatgtagtatgtaaagaatacacatgcaaacaaactgctactactccctatttgcatctatactcgtcacgagtggagaaaatcacgaagaaagatcagatttttgctccctgaatgctaccccatgcattttttaagtggctttgtgtgtggatgctaagctcgaggagatacggttgttggacagtgctggtagtctaatatccaccgtttttatattccaatactatattagtattatattacatccatgtgaaagtaggtagccgtctaaaccttgaaagatctaaaaggccaaaagagatctttctgacaaaagacgctcctttttgttccgtgcttcagctgctcatgcatgtggccaatgaaccctacattagtatatgccccagagattaacagccgatgtaacaaatcttctctttgccattttacgctgtcaaatctcaccgctaatcgcgctagccaatgggttagctgacggtgattattctatatatatatggtcaggtaaaaatcttgggattatctttctactagaagaagcatggacaggttgaaatggaattaagcaggagagcaactactctgatcagtgatctctctaatctatctctctctctgactcttatctacacctaccagcttgcgtgtgacgaaagcaagtaggacaggtgaaacactagcacaaggacaagcgcacgagctgctgctaatggagacatacatgcaacttcattaatatgaaactgtcccctacatgaatgtgattaattaactgtaataagcagtgatatactatgatagtatgatcttgttgtttggtttgatcgatctacacaaagagcatatgcaaataggggaattaaacacccaaaggagtagtagagattaataagatattaaagaaccaaatgaaattaagctactagctaaatgagctttactactacaagccaatctgctcttggaatataatgaagcgagtgaattgacctactccgatgtacaaatccacgagtccacggattgcgttctcatcgccgccgtcgccgccgccgacgaaggtgtcggcgctgcggcgacggtgaccgacgtgctctccgcattgtgctccagttgaggcgctgcgtgggccgccgcgccggcgccggacgagaaggtcgtcttcttgccgccgccgccgacgctccgggtcatggacgcgcccccgaccacgccggacagctcgtcgccgccgtggccgtggccgcggcttcgttgttgctggtgcatgtgcgacccgtcggcgcccatgatgccatgcgtgaggccgaggaagccggccgccggatcctgcagcctctgcggcggcggccgcggggctaggtcgctgccgggagcgtcgaacatggtgtgcgcggtgtacttgacgtcgtcgctggcgccgagctgggcgccgccgaggtggctctggaaggagaggtaactgccgccgtgatcctgcatccctaggagagaggacgacggcgccgacgcgaggtggtacctgtcgccgggtgccgccaccgccgccgtggttgcggcggcggtggaggttgcaatggcaatgttggacggcgacggcgaggacgtggagggcgaggggaaaggcgggaacggggaagggtggtgcttctgcgcgaacgggcggaggaggtaggccgggagcgaggacgggttcccgccgccggcggcggtagcggcggagcggagggaggagggggcggggaaaaggtggtcgaaccgcgagcgcgcgggtggcccggcgaagggcggcgaggggatgccggtgaactcctgcaccatggcgcggaagttggaggtgtcggtggtcagcaccgtcgtcggcgcgcgccgcgacgcccgcgtccgctttctcgacccccctcgccggcggcgcgccgaccccctgtccctgctgcgccaccacctgctcggcagagacctgcacaccgtgcggcgacgacgacgacggcggcgaggacgacgctccccccgctccannnnnnnnnnnnnnnnnnnnnnnnnnnnnnnnnnnnnacccaggggcacgn

SEQ ID NO: 305 - DNA, 24352 bp, Oryza sativa
  unsure (1)..(24352): unsure at all n locations
cccattagtagtaccacaacaaaaagagggaggaaaggtttttatttattggtccccattcacaagggccaaggcctacgcaaacgcaaacccaagttgcccccgttttaagtggcttttttgtccggggaaggttcgggtgcgttggtgtacgagggggcgtgcagacagtcagcggcctgcagcgcgcatgattaggcgctgcggaaagtgccagnnngggtngggggggggggcaggcagcgatccagaggtttattcgggggtggtggaggtggactggtggtggccgtggctgtggctgcctcctgcacggcacggtgaaaggatcagcagcagcgtcgtctctgtcgatcgatcgatcgatcggcagacgatggatggcgctggggttgggttgggttgtgtgtgttgttgtgcgcgttccatctgcatgcactgcgtgcggtgcctgtgctgtgtgctttcgaggttcgtttgaataatggggtggtaaaaggcggaagagagtttcggggtttgggggtgtcgaccgacttgtttgttgccggtgtagggtcattgcctctcgacctatggaggtcaggtacggagtggtatgtttgtacgttacaacggtgtttatagcttcaaatcttacagaatctttaactaatggatacaacctgttttaaatgaaatgaaaaaaaagatgaatatgtcaaaaatcataaatctagagaaataaactgttctaaaatcgttttgatgcactctaattgagtgtaagtattatataacttactccctccgtcccgaaaaaacgaatctagtactagatttgacatattatagtacaatgaatctagacagaggtatatccagattcgtagtattaggatgtcacatttagtattagattggttttttatgggacggaggaagtaagtattatcaagtataagtgtgttataactgagtgtgagtgctatgtaacgagtgtaactgtaaattgaatatataagaatacaaatcttgatggatgatgatgcaacattctacagataaaaaagtgaaagataaaagcctaaaaatttgttgcaagcgaaaatagtaaaaccgttctttttattccgttggtatcgttggttttcttagggaagtgatgtgttatcggttttattaggaagagattggttttattaggaagagattggtttgtttatgtgaaaggggcgggatggaaggaggacgactatgcttttaaggtagcagataaatgaaacgcatttttactacgttacaccgttaaacgatgttttatccgtttgtgtatattgggtaagccaagaggtcagttgccatagttttgacattttttttgttctccatcgtaataaattataatttgcttctttttcattacctggcgcctccatacttccttggctatagctatgcatggccaccactatccaaccacagcaaactaaccagtatcctctttgcatccaccaccctccaccgatggcaaggtactccctccatcccataatataagggattttaagtttttgcttgtaacgtttgaccactcatcatatttaaaattttttgaaattattatttattttatttgtgacttactttattatctacagtactttaagcacaactttttgttttttatatttggaaaaagaatttaaataagacgagtggtcaaacgttgcaaacaaaaactcaaaatcccttatattgcagaacggagggagtacttattaccagttcctcaatcacatctagatatatgtaggtggctttaatagttttataatgatctcataataaaaaattgacaacataataattatggtgatataagtattgataggtccgaacagacataaacaaatcttgtcactcggtcacatgctagcttcaaacaacaccatcttaataatccaaaaactccggtcgaggtgtctgatcatttggcgggagtgttggagctgctcctaacttttggagaaagatttttatttttatttttttgagaagggtattttttaggggcatctatatctaaccggatacatgtggtatttttaaattaggaacttagactatcgaacagggaacttaaccctcaaataacccaatctgaaattcgctcctacggagatttaaattcaggacattgggtgctacttagatcagtgcaaccactaaactacatgccgtttcacgagaaagatttttatacattttaatgaactatcttgcgataataaatgatttatggattaaaaaaataattctttgtatcattaacatgggccagggcctagctacatcaatttcggtttcgtgtagagttcttctttctctagaaaagaatatccaggcagaggtatttccaacattactctacgcctatgttgattgcggtaattctaaaaaaaaaaaagttgatcgcggtcaacagacggcttcgcttgtggtcaccaatttactttttcttccttctggaaaatatcttcactagattctacggttggtgatctcagtcaccgagttttcttctttttgtttttttacattgcttttcgatcgcaagatatacatagctagtatgtacatgcatgtaagggccggacacagggtatagttactatccctatttttttaagatatgatactgttgattttttttaaattttgttagactattcatcttttgtaataattaggaaggtagcccacgcattcgcacgggcatgtgtcgtacgttaagtttgagatacttataaaagtgaaatattaacccgagaacacctcccatgatttctctataaattgttttcgtggcattaattgcttttataattttataacctactagctttatgttaaatcatatttaagtaatatctataagcaattatttattatcttcttcatcatttgaaaagaatatagtcttactttatttagaaaacatgtcaacgtaagtaaaagtaagttgttttttagttgcatatatattatcatagtttactaaaggatgaattggatgggacatgaagctccaataaatgtatgggtttatatagcctaatataattgatgtagtttgagagatgatctatttgtgaacatttcatgtagagtgagtgagaggctccacacaacctaatatgaatacgataacgacaaaatataattacgcaataatattttttaaatgtgatgtaccatgaatacacgcttgtttttttatatataagatcaactgatttaaaatgcataggagtattccatatatgtagcttatggttgttttaattatgtggttggtgacttacggacactctggagggtctttaattgatttttgttatgtacaatgatttagtataacacaatacatattttcaattaattttcatgtttatttagtgttcatgcaaacggtagggtataccttcaaatgatatattttaacttttatatagaaaaatatagctaatgaatgtttaattataaataaaataatagttatgattgttttatattatgttagttagaaaaaaaagaagaggtgataattgcattggagaggagagaatgcgagagccacagtggtattacgaaagacaggatgatgggaggagattattatttttaagatagatcgaatgtatcctataattttgagttatctatttttataaatacatttaatcttagatctaatttaaaatactttgggtgttgtattttctaattaaactacttagattattctaattttagtgtattttattaatcagaaggtataaaatctatttgataaaataataataatttaataatttattggttaaaaatattcggtctactttgaatttaaataatatataaaaaaaggagggtggacactggccttggaacacgtacgaaggaggtccgtttgtacaaaagtgtataggacggtgatttggttttattttttttaacataaatattattataaattatgatttccatctaactaaaatagcatgaaaatcatgaaaataggagagaaaagggacagaggggagggcgtacacaaaaggagatcacgtacatggaaatgtacgtatgatatcaggtccaccatataattgtaaatctaatagctgaaaatctaaaatagtggatccaccggttaattagattgccgcatgacggtttaggaatgtttttaggagtacacgtggtggtttgggagtatttgtcggaagacatggtcaatagtttttttttatgtacgtacatatgcatgttttctttttttttttccaaataatagtctcctatacatgcatatatacatacatatattttatccggatgaatagtatatatttatttttccctcttgcaaatacacatagattagaagagagggccgggattaattactttaatgatttgatctaatctattctacacctgtacatgcgtaaatcaattgttatatatttatgtgactacatatacaagggaaagtgatgttacgtgtgggaggaaggaggtggaggtggaaagattttgtagataaatctaacggcttgaaacaatgggtctaccgattttaatcaaaacgaatggacagatgttttatttttttcttagaatttataggaattttttttatttattagaatgccatgtggcgatttaagagtgtttgtataatgccatgtggcggtttgagaccgtttataggaataatagatagatagatagatagatagatagatattcaatcaaatagacaactacaaagtacagttatttttattttagttaactaaataattcacgacccggtgaacacaattgaggtgcaggagtgcttctctcttcattaattgttcttcgatttttcatttctattttgcggttttttctttctttccatttcaaatgtaaatgtacagttcatgaatactcccaccgtactataaaaaaaccaacttaatattgtatatggtatattatgttcagattcgttattttaaaatgtgtcacatccagttatttatttttttaagtagctttaacaattgaatttacgtacgtacgttaccgctaattggccggttaccgctaagatatggaatcttatctcaacccgatctgtcaattccatttcccatatatgcactgctcctctcatttggtcggcgacgtatgagatctaactttaaatccggttcaaaacatgcatccatcgtgctgtacgtaaatgaacttcaaatctttcaaaggatatgatatatattcgctgacctaacatgattactactctctccatcctatataaaaatacaaacttctgagttgttctttttaagtttactagaaaaaaatatctatgcgttataatgggtaagatattttttgaatgtatatgttatactcctttcttagttttgggccgaaagcctatccctttcttctttttcagccctagcccaatgtgctgcctccctccgctcggcctatctctctttggcccaacctacaggtggagccatgggactagctcacacgtgttcaacctccagaagatggtgccgatgatgccggagctaattctcccaatcaaatccgaccgaatttttcttgatcttgtataattggtttagggtttttgatccactcgatcttcttattttttttccccaaaatcaaggcgaaaacttggaataaaaataattgaggaagcttaccaaccggccatcatcggcagcggttaatggagattaaatctggccaattaaagcccaattaaagggggaaatcatggggaaaatgatgagggaggagtggagatcgatttttgcaatcaattagaggagaaaatgcatggagagacatatcgatgtggcggcggagctagggtttggcctggcgaaggaaaaaagatggtgacaaaaaacggaagcccttatcgtgtgcgagaaaaaaaaccgcaacgaaaaaaggacggcggaaaaaaccatatgaaaagaaaggaaaataaaattaaaaccaatttaaatacagatgacgtaccaaaattttggtgaaaatatttttaattttcataataaacatattcaatttttataatagtgtagatgtgacttatgtccagattcaaaattaggtgctgttttcttttttaatacatgaaaacactaaacatacattcgcttacctaagcatggggtaataaaatcatttggaccgcctcatcactgaataaatcacccaaggccttgtatcttctccggttatatatgcatctcattctgatcaatggtttaattttctgcaactccaacgtctttattcatatccactttcccgccaaccactcgatctgcgacaacggcagtttggtagcttctctgttctatcgatccgaactattccggagttggcaaaacaataggacagatgcaaccgagatggggacatttgtgcttcactgtatgtgatcttttgtactatagcttcacttccaatgcatactggactcgccacgtgctattgatatcggggaaaaaaatgttgcggtgatttcctcataaatgaacatttctcttcttttgagtactgaaaaaaaaaataagagaacattaccaaggaaatatagaaatgtaaatatgtaataattttcaaaagaaagaaaacattttgcaacctgaagcctggacgcctaaggacgggccgggagggaggcagcaacaacaccaagaagtaataaggagggtataggagagagggcaaaagcagggaggactgtgaggttcgggaagaggcatgtggaggaacaattgtggctgagagaagggatgatgcgatggatttagggtgcctagttttttatagtagacatgtttatgttttggatggcttatttacgtaggacgtgtttggttgcctgcatctaggttggcttgcatctaacgtacaacgagaggtgtgtttggttgcttgggcgcggttgagagcatgtacgcgcgggtgcaaaaagcatcgccgagccaggccaagaaggaatgtgggattcaagcttcgctcctcaacttggcctaagcgtgggtgccacgaggcatgtgtgggtgcaagggttgtgagtcagcttacctttcttgcctattctcgcacctcaatttctcttccactctcttttgagccgtcgtcgtctgcttcgccttgcgaagtaccgccaactctgagcatggcaggactcgagctaggccagctctaatggagtcccttccctgcacttaatagttgccacctctagccttcttcagccacctaatcaccaaatctggacgcatgcgacaagttgctggtgctagagggattgcttggtaacaaggattggtgcaagagttatatggctggggaggtggatggagctacgtggctaggaaggggggtggaggaggaagaagagggcaacatgatgggcaagaatgtcaagaaggttaagaccgacgccgatggtgaagaggatcaacgataagatccacatagattttttctttgtttctattttctgtcttgtcctaaccgggtttattaaggcagtaatcttgactgatggaagcggataagaagttttgattaaacactaattttgtgattgatttaggcattcactgttcttatttctcatttctacatgcaagagattttatgaaatttagtcaattgaatattaggtatgtattcattttcatccatgaatcataaggggtaatcttaacatacaagataagcggtaaccaaacttaaccatcatgcatccaatcaaaaaatctcttacatacagtatttgttgtatcactaaccaaacaacatcacatatcatccatgctttactgatacgagcaaccaaacaaccctttttgcacccacccatccagggcggggtcagcctagataacatgtacaagctagactagagtgttacgagcaaccaaacataccctcatatgttgtgggctatatgactatgcaatcaatttaccatagtggtcggttccttgttctgttataattttgacatcaaaattgaaaggagtagctatatttatggctttatttttttatcaaaaaatagtcaaattatttttatgttgtaaattacctacactttcatggtagttcactgtaaattttaaaacttacactacattgtaagttttaatatttatattgtaattttttaatacacaatgtaattaggattaaaactacttaattatattttaaaaaatgagattggagagatgaaagtatgattatatataggagagaacaatcacagagagaaaaattgactgaaatttagcgagcaaatgtggcgtaataattatagaaatcctgaatttgtataagtgggattgcaccacttaactcgacagtttttaaaactatatacgtagtgctataaaatttacaccatatgtttcagccaactagccaaaaacagaggtagaaattttacaaactggagcagataccaaatttgttcctttttggatggtataacttgtaggcgctgcaatcttcacataattgtgcgttgacgacgctctttgagctagcagtagacgtggccctcaccaaactttgtacaggtggctccctaccgaattttcttgtccccacgtgataattgcacggatcaaattgaaggccagcttctcaaagcgatcgctgattagggcacattcatatctccgatgttggccatgcatcatcatatcatagattaataactattgctaggttaaaacaagtaaatgtaagcttgtaggaagtaaataagctaagtactgtaacctccagcttaatttgcatgtactgttctatttagtacatgtttacctacattgcaggcaattaattaggcaaagtgttaatagcacctcccgaccaaacaatctgttggttttcaagtgcaatctacactgcgtacttgccaagttttgacgtactgtttgtaacggagagttttgtctcggtttaatttacaacaataactctatcctgtcctgctatataagatcagaaacaaacataaataatgatactgcattggccaacgatatgatctctgaacaactgaatgaagtgtactccaccaaccagtgaagttatatcagctatatatgctgattaattaaataactccctaatccacaatgctgtatagtacagtatcatgttatatctagctagtaattagatgggaccttgcaacctcctaatgaaagccatgcgatgcatggacccgtttaatcactagtgttctgtgttcaacctgttcatcagatatatgtgcattgtcagaagccgttgatgataaatattaatttgttctatgcatcataaggtgatagctaccttctaaccctctccactagcttggcaggaactgaaggccaggcccccccttttgtggcacaatatattgatggcatctcaatatttatgtttgttctttaacttttttagatcaaattttctgttaattgcgcctttgtaaaggtttgatttgattgcatccatcacgcaggagttaaagatggctttcaagacataaacatgtaaaccgctgatgtataccattactggttggcttctcttctgttgggtaaattgtttgcagtaggacttcgacagctatccatgatcatattctgcagcaaatcgctctcgccactgcagaaatttgttgaactggattgacatatagatacaatcgtttagtatggcattgtactagtgatgagaagataaagagagggcatattttactctacatgttttatatcataagatgttttgattttgttatatcaaatttcttttaactttgaccaaatctataaaaaaacagcaacatttttaacacaaaacaaatataatatcaaaatatattcaatattaaatttaataaaatcaatttgtattgtatatttataaattgctttatataatatgaaacagatggaacagtttgagaagccagaaatcgtactcatagctgctgggcctgctgggaaggcctttttcggttgcagcttataatatgtatacatataaccggaacaattaaaattattttagggaaaaactgtttgtccttctactcttttgtggtccaaaaggataggctaaagaaaaacagaaagcaacacaaaatccgctaaatcaattctaaaaataagtttcaaacttcagcaatggccgcaactggttttattaattgagaatactatataccttagtacctaaggtggttggatatatatattcacttgttttttcatgtacaatggactattatgagttgaagattgactactgcgttagaacaacccatttctttagttccaaacataaatagcgttttcattttttttatagaaacacctctggttgtgtttgcatcatttttttaatgatgaaagctttatcgatataagataattacatcacaatgatataattactccaagacaacttctagcctttcacgatttgcatgacttaacacccggatttactcattggtggtcaaatcctgatctccaaagttatgtatattcggttgttgtgtctgcccgttcatccatataacctgattaaaaagaagtaaaataattttcaaggaatatatgtccttatatatcttttatatattgataactcaacaattaaaatcgatacaaaataactcctcacatgttttgaacatgttttgagagtggtttttgttgatgtgactcattgatttggtctattgagactatagaattttttatatttttttctccttatcacttatatgtgggctacacgtctacatgtctattttaattgctccaatgatttgactggcgctaccacatggatgccatattagtgaaaacaactcttaaaacaataaaacaataagaaggccacaacgcgtgcgctgtctgccaccccggcttggctagaatgctgacttatcggttgggctacagcgaggagggggagggtaaaaaggaggtacccattgcatttttttatttttaactagatattcattgacacgtgggtcccgtaggtttttccgacattaagtgccacatcaatgtcatataagtgccacctcagtcaaaaccaccagctaaattgtcttagtatattatttgcattggttttaaaagttgagggacacgtcatatctgattttacggttagacgaatttaagactcagccacaaattagtgaacgaaaagtgaacttattcccagacattcatcgaacgcagcggaggaaatcacaccgtcacacgagcagatgggcctgtgcgttgatctgccgtgaaaaattttgcgccaggcaggctgatcaagtgccgggccggacgtttggggtcaggcccagtggtttaggctagcctaatactattagattgttttgtactgtcccggccggccatcagaattttgactaaggccgtgtttagttatttttcaaaaaaaaatttaagcatatggacacacatttaaaatattaaacgtaaactaataataaaataaattacatattctatatgtaatctaccagacgaatctattaagcctaattaatccgttattagcaaatatttactgtagcaccacattgtcaaatcatgacgtaattaggctcaacagattcatctcgcaatttatatgcaaactgtgcaattgatttttttcgttcatatttaatgctacatgcatgtgtccaaacatttaatgtgacggaatgtttgaaagtttaaagggaactaaacacagccttaaatctaacttatttacaatctatactgtgaatacatgatcaaccattaggtagttttactttccatgatatcgtacattttcacaagctacgtactttttgccatcagatatagtttgaccctcccgcacatatttatgtatttaaattaggccacctttacattggacattcctgtcattaataatacggacggtagattataaattattatggattttctaaactcctaaatggtacctttgttgtaaataaattcttcactattacttcttagacaagtttttaaaatcaacatataaactttttatatctaattctttcgttagttttcttgaaaaatcaactcagtattaattatccatcattcgtcatctatcgagacagtatagtacatggatttttcaaggttttcttcaacacaataaaatacaacgtactgtatgtctgaagttccacggaaatatataaataatacatgcatttttttattcaaattgtatgcatgtctagaatattgcaaaacgttttgtttgctttgtcttatattaattcctccacaattattataaggaataaaaaatcagtcatgtatgaaccatgcataattatgatgtgccacatttacaagtactagctagccatacgcactaaaaggattcacttgtcgatcaactaaaaatatcagtttgatcgagtccgtatgaaccatgcaattttgtgaggttgtacgtagcagtaattctcagttgtcatataggccctgtttaaatgtttagttccaaagtttttttttcaaactttcaactttccatcacatcaaagtacaaacctttcatacacacaacttttctatcacatcgtaccaatttcaaccaaacttctaaaattcagtgtgaactaaacacagccatataccacctttcaatcaaactacgtgtccccatcacgtgtcattttcgttccagcctaacattcgtgcgcatgtggaggtttttgtaatgattaagagaaccccccaaaggaattaatgtttgttctaacttaacactacaagcatataattacacatagataccaccctagatagattaattaggttatgaattaggcgcatcaatacgcattatattgcaaccggtaattagcgtgcacatcgtcgtcaagtataaatgcacgctttatatatttacatgtcttatatataggttagctagctagctagacgtcaatcatttttttttctcaagtagattttttcactggctattggctatagctcgtagccacctcccgagttggtcaagcggtcggctccgccatagaagttgctactatcctgacagttcagtagtattgtcagggaatgctgcacatttactcggggccgtcggctattaagtttccccgtcaggaaaagtccattttctggtagtgaaattcccactatcgacaacatatatatataaaaaagaaaaaaaagcacgaattacccccctctcccgaactatcgcgatcgaccgaattaccccatgaacctaaaaaccagacatcgttcaccctaaacttttaataccggacgaattacccctcgacccaatccaaaccggttttgccctacgtagcgtacgcgtggcaatccggacaacattttatttttaaaaaatggtgggacccacatgtcataccccctctttctctcttcctctatctctctctctctctctctcttggtcagtcactagacagcggcgcgcacgccggcatgcatggcacgacgtggggatgggcggtgggcaacggcgtgcgggggcgggccggcagtcggaatgcacggcgtcacacgggcaggtagaggggatgggggagggagaggtcggcggccatggtggagaggcggacgatggccggaagcgtcggcgaggggaggtagaggggatgggggagtggaggtggatgggaaggtggaggaaatggagggggcgggccggcggcggccatggcggagaggcgggcgacagcgctcgccgtcgtggcgctggcggagaggcggaggtccacgaggtgaaagccgcgcgccatcaccgaccgctcggtctgtctctgcctccgcttccgcctctatgagctctacctcagctgaccacctagacgagctccgctttcgctgcctccgcctggtccgtccccgccggcgactccgacttagagcagcagggagaagaggaccgccgtccatgccatgagcgccgccgtccacgccgaccgctagactgcccgccctcgttcccgtgccgccatgcgcgcgacgcgccatctcgtgtcgaccagagatccggtggcgggcgatgggagaagaggcgcaagtggcggggagatccgccgtgctcgccacccgcagtggccttccggccgctgccgcccgcgcccctgccaccaccgccgctcgccacgcccctgtcgcgcccgccacccgttgctcccgtacgagagagaggaagagggaagagagaagagagaggaagagagaaagaggggtatgacaggtgggtcctatatttttctaataaataaaatactggctggattgccacgcgtacgccacgtaggacaaaccggctctggattgagtcgaggggggtaacttatctagtattgagagttgagggtgaacgatgtctggttttcggatttatggggtaattcggtcgaccatgatagttcgggaggggggggataattcatactttttccaaaaaaaattatcaatcactatcaaacgctcttcgtcggctggattcaacctgttagatttatcactagggctaactttatcttcaaattttatcttaaccctccacatgtatatacgtgtgaaaagagaactagtagaagtggaccagcccctgacaccctaggctatggctcgaggcctggtatcaaaagcccatggaccgcaataatttttcgatcatatatggattagctttctatcagatcaccacaggtccgccctaacaggatgcttctgccttccttgattgatcatcttgttaatttgctcttcctactcgtgtcactactacagaaaagccttcggtgccggttggtttcccaaccgacattacagagacggcactgattacttggggtcaaaggtgccggttttaaaaccggcactttgaggcacacatgagccaaaaaaaaaagtcggctaagccatcaagccgatcccaaataatacccaaatcccaaaattacatcaaatccatgaatacatcaactaaattgcctcaaatccatgaacacatgaactatagtgaataatccccagaaaaacaacacatctaacatcaacaaatcacaaacaggaatcacatcaacatcaacaaatcacaaatcacaaagagggaggagaagagatggatccgtggtcgccgactccgtcgcacctctagccgcctccctcccggcggcgcatcccccgtgccttctggtgccgcatgtcgcctcccttccaccgccgcatccccctcccttccgccgccgcatgccgcctccagccacagccgttgctgggccgcccctccgggccgttgtggcaccatctaccctcctgagccgctgagagccccgccgcagccgccggaccaccaggccaccaccgcaaccgctgggccgccaggctaccgctgccgccacgctgggccttctccaccaccgccgttgcggtcggatggaatgtaggggagggcgccgccaccacctcgcctcctactgtctggctgcagccactgagccgctgccgcctgcccttcgtcgggtggagaaagagggagcgagagagagagagagctaagagaggggaggaggcagagagaagagaggataagggacaagggagatgagagaataagggagagagagagcggaggtaataaaaagatccgcggttttcttaataggcgtcgtttttataaacaaacgacacctataatataaatataggtgtcggttctttaaaaaaccgatgctggtattatatatagatgttggtttttagttaaaaccgacacctatctctttataaagatgctagttctagccgaggtgtcccgtggatgcgcgtttgggcaggaaaaacattataggtgtcggttttatctgtttcgacacctattgtgccgacttatatgtgtcttttttatagcgtgttcatgtgtgcctttttctaatgctccacccgatatattgatctagctactaaccaacaaccgaagtggaatccaactcctcgcctcgccccaattgcatcgcatgcacgcatcactcatcgatggcgatgggaggcactagcagctacgtacacttagctagctaccttctctcgatccctttcgcagctaatttggctgcaaaaaaaaaatatatattggcacaacatatctgagattccacttggccacttctggtgtggggctgactgtgatccaagctggccatgcaacgaccaatagcggtgtaggatcggatcgcttcgccatctgattaagattttttgtttctaatgagaaacttccctcaataataaggtaatgaagtagtctatatattattgtttgttttgcgattacgcgtaatgcgagtgtgacacactgttatctttttagttgtgatgatttagtttaagatttctgatcaaatcaggtacaagaaagcaaagggctcttccttttgttaatgattgatttgtggcttgggtggtagcacttacttttcgatgcgataggctacatagatgcacgcatgcattgctcgagttaacagagaggttgtactgaaggcggccggcctggaggaaggagaggtgtgagaggagaggagctagattttgctttgcaaagtacagactgctttccgctttctgtatagctcaagggcggtaccactaactacttctttagttaattgggctacagtctaatcgacaaaatgctgaatccactacaactaagcagacatattcaaatttcttttttgggaagagttgcacgttatatatgagttacagtgtttccttttcggtttgtttctttttctgtgtatctcagttatgagatggaaagtgtatccaatcgtgtaacctttgaaaatggacacaactacaaaatgagatggaaagtgttttagatatagaagtcggatttctatgcactattttaaagatggggatagaattggcgaaggaaattcttgaccgacctagtcttgtttctgaaaaagcgatgccgtttcgatatttctgaccctagccatatataaaatgaacttcctaatttctttcaactccgtgttgtaatcatcactaaatagctaaattggtaaatatgaataattccgacaatgctcgttctcggtcgcccggggggatgggaaaaaaaatcgatcgctcccctccccctacgtgcgcacccccactggacctatccacttttccctccccttgttccacaaaagatatttcacctagtgtgtttacaatgtttcactgtgtatatatctaatgttgcagtgaattaaaatattcttttacaacaaatcacccacatattttggaaaccctttattaagggaatttggtttattttttgttccaccaaaaatgttttacctattgtactcacaatgtttcactatgtatagatctaatgttgcagtgaactgaaatattccattgtaaaaaaaagcacaaatatatattttggaaacccctattaagggaattcgtttcattttttgttccacagaaaaatgtttcacctagtgtacttataatgtttcactatgtatggatcaaatgttgcaatgaactgaaacattctttcactatttgctgaaacattatttttatataaggtgaaacaacacccaatttaaacgagtgaaacattttcgatctacttagtgaaacaattctgatatacctggtggaacatcgtgcaacatttaaaaataattcaataataagctaattttttttgtcagaatatattcatgtgtggtcttgttttgaagatttaattgcaacgaatttaatggtgcaatcagatcatgatttggataagtaatttaagagaaaaatctgtttaaagtagttttgcatgtaaatcaggcgctgacgtcagcgcccaattttaacctcctcttatcgggcgcccgacccggagtcgcgtccgaataattcccaaacgattgaggaccgttctcgttaaaatgatatcatttatgcgattgttttcatccctagttataaacaattgacatgcatgtaaatatctaatagttcattgaaaatttatttaattggcttatttggtttcctacaatacaaaaatatgggcaatgccaaatcatggcactacttaaaaaatggtaaaaggtgctggttgggagccccacatggatgctggatttcccaaccggcgtctcaccggcggttctgatgagagaatcaaaaggtatggtaccgggacctttgatgttacacgaatgaaaaaaaaaggcggcttgatgcactagctaatcgagccgatgcatcgagctgctctctaccaaactcagaccaccatcgatgaaacaacatccacaaagcacacgacataaatcatcatcgatccatccaacaacacagtacaaatcacataaattttaatggatatccaacaatttcacacaacacaaattgctcactgggacatcgaggttgccgttgatggattcgtcgaatccgcaggagtcgctgccatcaagggcatggacgccacgacgccgcagcggtagagatgggaggaggagggtctgcgcctctgcggtggtggggtgggagagaaggagagacactgctaccgccggatccacccgcaggagaagccaccgccggatccacacgtgggagtcgccgtcgtcgcagccgtcccgtaggagccactgccatcgaggggatggacgccatgacattgcagcggcggagaggggaggagggcaggctgcggtggcagggtgggagagaggaggagagactgagagcgcggaagatgagggggctgcgagaaaggaggataaggatgaggaaggagctcggtcggctcggctcagtgctatcaagaatctcaatatgtgttggtttactaaaaaaaggcacatatagtacactataggtgccggttaaattaaaaaaagagtaaattgcactggcggttcttaaacttgtaacgaagtttcacttatatccacaaacatgagaaacacgcatcgagatccccaaatttggtttaatatattatcccggtctaaagcctcgtttgaccgtggccttgcctacgtggcatgctacgtggacgatgacatataatttctttactcccttcttcctttttttctcccttcttatccctttttctctccactttgcatccttcctctcccttctaccgctgacaggtggggcccacctgtcagtgcccggcgaggctggtgagggggcggggagaccggcggcggcaatggcgtcgtcgacgggaaggagaaggaggatgggaaggggaaggcccccggtccgaagtggccccgctgcagctgtcaagctcgtgcccgccccgctcgcgctgagctcaccgatacctccaccgcacacgtggccgcggtcggcgacccctccccaagggcacggctggcgacatcaccccccgcgcgcgcctcggccgcttccgcatgaatgacgcgccgccgcccaatgaagtgcgccatccccctccggcgctggttgcaaggccataccacccgctcctcaccatcgccgtcgtcttgggcggcggtgggagaggaaatagtgggagaagtcaaatgtcagcgcagcgggaggagaggagccgcggacagcggctgtctctccatctcctcccctgtcggcctctacccggggctcctctcctcctgccaatcggcgcccgcacgccgctcctctcctctcgccggccaatgctcgagcacgcgagctgctcctctcctcaccagccgccacccgcgcatgcgcgccgcacctctcctcccaccagctagcgcctgagcacgcgcgccgctcctctcctcgccggctgccgcccgcgcatgcgtcgttgccggaaacctcgtccaccacgcgaggtgaggaaggagagaaaagatggagagaaaaaaatagaaaaagaaaatttagccatgtcatcatccatgtgacatgccatataggcaagaccatggtcaaaccaggctttggatcgggatgatacattaaaccaagtttagagatcgcgatgcgcgttttgcaaattcgtggatctaagttaaacttcgttacaagtttaaggaccatagtgtaatttactcattaaaaaaacaggcatgggaattatatgaaccggttcttttaataaaccagtacctacaaggtgttataggtgccagttttaaatttttacccctctaaggcttagaatgacgggaaaaagctcatttgtgtctatgtcggttttagattaacccatgcttatgatgtgtcccctattacgtgttcggtagtagtgtggtactgtgggtatgttttggaaatatttttgttttataggtaaatcttggtaaaatgccaatatattggtaatgcaagatttggctttaaaccatattggccccaccaaatgctccctctcacgatgaaccttgtgtcatggaaaaactgaaaaataagttttacattcaattgcgtcagccaagatttatactcgacctttagctttgatattaagttgtatatactaattcaatgcaaaaatgtaatgcatgtttcatttgttgccaaaacaaaacttatcaaattttggtttgaccaaatttttgtaaagcaatgaaccaaaaccaaaccaaataattttggtaaggtcttaaaccaacacctccacatttttgaccttgttaacatttggattaccaacctttagatttaccaaaaatggtcttaatctgacaaatgtgtctaccaaaaatgttaaccctctttactaaacatttggattcatttatttcagcaacgaatcaaatatgcgcttaatctgacaaataaaagacagctaaattcgcgaaagggcctatagactagtggttacaagagcctcagtagcacctgaggtcctgggttcgactccccatgggagtgaatttttcaggatttaacggtgttgtgctttcagtggtaggcgatttaacggcattgtgctttcagtggtaggcgacgtgcccgtcgacagcgagacgcctatggtgacttcgtcaatctcttcaggatttatcggcctagttttcgaagatgctcataggtagggtttacgtgcgtgtgttcatagtgaaaaaaaaaagaagccttgaacaggagggttaatgcaggacaagagagcgtaagctccatcatttgtttgttggcttgtcagccacagctaaaatgttaataataaaacttaaattttaaattgattttgaggtgttcttattttaatttatttttcagcattgacttttaaatctaagaaaatagacataaaaggtttacccgtaaattagttttaatcatttcatttatttttccacaccttatcaaccgtagttctcaccgtagctttggctctcgctttacacagacacccgttgttttctttctaactaactatgtatatatatgagcttcggcatatcaattttccctatctccttttgcggacatggtttttcctttacacgccatgtccggtacatagtgttttttgggcttgtaaacttctgctctattaatatacttccctcgttttatattataagactttctagtattgtccacattcatatatgtgttaagaatctaaacatatatgtgtgcctagatttattaacatctatataaatatgagtaatgctaaaaagtcttataactttaaacggatgaagtacaagaggcaaagccattacctttttcaatttttttcccctgtcatcagctactatgtcagcctgatctaagaaaaaaaaacaatgtcagccaacacagcatcccaagtgtagtcgcctcactagcctggtcatcggcagatacacacaatcacactgtatcgagcgatattattgtacactacttactttgcaagtgtttcagaaagtgattgcttagttcctgatatcacatactactacaactgctactagctgacacgactccatgacaggagcaaaagtctgcgccaagaaccgaaacgtttcttcagagaactctcaattctgccttcattcgctttgcatttctacagtcttctgtggtagctagtctcagcagcgatcgattgcacgatatgactcggggtcttatcctactcttatcttgttatcttcttagctggtagatctatggatagagaagtagaattctagcatctcttcatctgaaaacgaaggcctgattacttatgtttaaggaaagattatgttttagaattataatctaattttaaatttgaaaatttgataaggctaattccaaatacttgttttcttaacaatcatgaaaagagaggcagacagaaaaacagacatctaaaaacaggggaaggtaggccgtgtttagatccaaagattttcttcaaacttccaacttttctatcgcatcaaaattttcctatacacacaaactttcaacttctccgtcacatcgttctaattttaaccgaacttctaattttgacggaaactaaacacagctgtaatgtataattgacagtgaaagttattcctcaggtagtcaggtacttggaacccaatgataacactggtattgaaggatggagattcatcaaaaaagtaatggaatttatgtgacaactacaggcattcattaagatgcaaaccgcacgaaagacaatctgtacgactaccttgatagcggtcagatagctgtacttgtggcttcaattttcctctccatcaaaggatgatgatgattcattcagatgatcaggtcttatcttttcatgtcacagtagtgatagttaatttgtcaccaattctgattgatgctgactagttaatgtggatggttaacacgaatcgtaaccaaaatctgactttttagtagacacaaatgaactttattttaccattccgtaaaacatccatgtatatttacttttttctttttaccgactcgcacggtcgcaccagacagtgcgaagttttattaagagagcaggaaatattttcaagattacaaccttgtgaggtcggtaccaggaaaacgaaaaaagtataccaccatccgcacaccgataactccaacaaacagacccaggagaaggctagcaccggaccggccgccgctaagcgtgaccgaccgccgctaggccaacaacggtacacagccgagatcgcccaaaacccgacccttacaaccaatacaaaactccgatatatccaaatctttgggattgagggagagagggtgagagaaaagaatggaaccgctctccccactaagccctccaacgtggccgacttgtagaagctagggcgccgccacaagaggatatgaatctagagtgagcttgcatcaattgcttgggaggtttcggcaaggggatgcctagacgtcgtatccaaggagagaagcgacgaaagtaccaccgccgccgtccgtcaaggtcccaaagagaaccaagactgggctttcacccagcagccccacttgagggggtgagacagcacgacaacgccctcagaaggggattgacgctcgaatgccatcattaccagtctagccaaggccggtctgggttttcaaccgctgtccaccgcatgtcgatctaccactgatgcaccattgctccactgccatctaaacctccgccggcacgtgggtaccactgcaccggcgccccctcgccggccagtctccgcacgctgccatcggtcggcctcgccaagctccgcctctatcggcctctcctcctgctgcgctggccaccgcctccacgccgactagcctcgtcgtgtcgcaccagctcctcgatcgcacctccacacacagcagccgcctccgctgtcatcggccgcgcctcaccggcctccgctgtcgccagccgctcctccgtgcgcgcgctgcctccgccaccgctcctcccaccgactgcccgccatcaccgtcgtcgccgcgagtctcctgggccacgccaccacctccgcgagcagcctccgccagccctcgtctcccgggccatgcttctgtacgcgcaatgtctccgccgtcaccggctggccagcctaccgccgtcgctcctccctccggctaccctcgatttgtcaccattgtcgccgcgagtctcccaggccagctgtcgc

SEQ ID NO: 306 - DNA, 2036 bp, Oryza sativa
  unsure (1)..(2036): unsure at all n locations
nnnnnnnnnnnnnnnnnnnnnnnnnnnnnnnnnnnnnnnnnnnnnnnnnnnnnnnnnnnnnnnnnnnnaaccaatggttgtttttcttccaagcccgaggagaggctctaccgccggcgcgttttccctacagccatgttcccggccggccgcacggtttccggcagcaggcttcggcggtggcgaggcagttgtggcgatgtggggtggcggcacaggcggctagggttttgcccccgagccgtccgtgtgagagcagtgcgagggagacgcgttgtgttttcaatatcttcttggagtactatgtatttactttgatcacaaaaatgatatatctaaatgaatacattttaaaaaatatttttaccttcccttgaagatatattacaatagaacttaaagagtcaaacatatagtgatggaaaaatgaaaccgttgctcgtggctcatatcagatcagatcaacttgaactcgtaattataatggatagagttaagttaggtttttatctcatcaacttataatgagccagctcacgagctactcatttagctcgctactacacaaaatcaccatattaattagtacttaacatttcttgctttattttcttaattatagtggctctctccacctccatgaatctgaacacattccttgctttatttttcctctataatagcctaaaaatgattaggttttatatagttgaattttcaaagtgtcattcaacttatctttagtcctcggtcgtctagtcgacagtttcgagtctctaatagttggtgtgttgacttccgggttgaaatctacaattgtaactatttctttgtgtttagttaccgattcgtaatatttagattgcatttacctacttcttgcagtgttttatcttttgcattgatatgatcattaaccatgtataacggttggtacgacattatttgtggtgtagtgattgcacgatgttatagacttattatggttgataacaactttaccaacatgatattctatcaaagcaagatttaatcccttactataagattgggccacgagagagcgtcatcagtgcttggactcatataccaaacgagttatgtccaaacaaagttgatctataccaaccacttcttgggatgggatccatctgttgatcatttaatagcctgggagcataaccacgataatctaccctcgattaagtcagaagaacatgaattatatccttgcgcgttgcagggacggatctacactgtaatagtcagggtacttaaagtgcttattggtagaagataatatcgtgatttaagtataattataattagtacgttatgacaccagcaaattcactatggcactggagtgtcaattttgtggatcaaccaatggcacattgcacatacgcaccgtgtattgggagaacaatatctccacaacttgtgtcttccgtttaaaaaaaaaactttagtgtgtttgaataattggaaatgaagagtgggattgtgattgaaaaatgaatgaagggttagaattaaatagaagagggattgtttaaagatatcttttggtgcgtgagaaattatttttctatcccattagccaaactgggcctttgtgtctctcttggtccagcagagtagtgcagagttcttggaagcagtggcggaggcagcgtgggggctggggggnnnanannnnnncnnnncnnnnnnnnnnnnnnnnnnnnnnnnnnnnnnnnnnnnnnnnnnnnnnnnnnnnnnnnnnnnnnnnnnngcgcgttattattgacttcaccaaaacatgtagctccgtttattttgttgcttaccttcccctccatcataatccctgtctcttttaattctatttactctttactttcttaacatactatatctccattaccttattgctttcttgtcggtaacccttgtttccctcaactctcttattatcgttattttctcaatcatttaatcttcctctcatataccccttctttaccttttttcttatacattttcaaccttcg

SEQ ID NO: 307 - DNA, 4604 bp, Oryza sativa
  unsure (1)..(4604): unsure at all n locations
ggtgcatgagaactgctaccccctggcnnnnnnnnnnnnnnnnnnnnnnnnnnnnnnnnnnnnnnnnnnnnnnnnnnnnnncctgctgcagccacgaccattcaaggagcaaattaaagccagttaaaaatctctcatcaaacccagacaatgctgttctgtagaagcttcgatcagtttgcatgggctgctttatctgcaacattgcagctcgatacaaaggtacagtttgcagcttagagagttcgtgaacacaaaactattcatgacagaaaagtccacttgtacttggccttgacataccactagctggccaactagcttgtcaatatctcactttgattattaacgctctaccttgacctagtttctagaatatccttttcaggaatatatcatatcttagccaaatggacagatcattctcagggtataaaaagaaactaatgctgacaagaaaggaggcactttttatgaaagcttttggggtagataacatacaatgcacactggctagtaactggtgtgggtgtggtccaacaacacatcctggttttctctaacgatccattaaaaaaaaggtttatgtccatgacagctatcaacttcttgttgatggccaaagccatcaacctcatgttgatggccaaacttttgtggaggtgtaaattgtttatttattaattaatcatatagcaaatgacgaacatgagaaacggacttaacatgaagaacccttacgaagaaaaaccacaatcgtgtaggcagcatcagtaatacgaggagagttataggcaggggatggcagtgaggcagtgtctctatcttcctagatatgctatggtaatactcactctgattccaattatatgggtaattaaactaggaaaagaatcataattacgtctattgaaattgtgtacaaattgggacatgtaaaatcaacagtttgcaagcacttctgtctattagaattttgcatgtagtaagtataattcacggttcttctgttgtagatttgaaccgttattatcatcatcaagggtattagtagtatataaatatatgctactaccattctgtaatagttcacttatcaatcataaccaaaatttaaatttttaaacttaattatataggggtctttttaatcgtggttaatttttcagacttggctttaaaactgataatgactcaaacatacaagtttttttttagtctcttcatttctctatggcttattgagctcaactgatcacagctaacacaggcagcgaaagaactactatatcactatcaataacactgttttacgatatgtgcaacttatcacagaaagcacacgagaactgatgtttcatatcacaccagtaaaaacaggaaccagcttttaacaactggacttggtaaatctgtctcgcaagacaagacatgctgagagagaaggggttcctcttgaggatatctcctcaattttacgtgtcataaaagatcatgttaaaaacaaataacaaatatgagtgtcacatcacgcctgtccatagctgttcaaacttacaggttaatttgctgagtgctatatcgagtattttttaaactatttataacttcttaagtactcctgccatcctaaaaagagacaatctattattgatacatccgagtacaatgaatctagatataccctacgtccagattcattgtattaaaatatatcgcatcctagtactatgttgtctttttttttaaacgaagggagtaattgagtaagaagggaggggacgagagacatttgtgctgtaatattctgatgctcttcatttcatcatatatattcttgtacatagataatcagaagccatatacaattacacggtagcactcaaatccatccaccttcctgtgcacccacccaggtagcatagcaaccaccatagccaaaaaggacgagagagcacaaggcccaaacacagcaacactcttcatccccttctcatagccaccaccacccaacacaaagcgcctcccaaaaaaaccagaggacgcgcgcgcgcgcactgtcagtgtgtgcacacagaacagtgtacaggagagctacgataataactaaaagataatgctccctctctaattaatcacccctccccttaattacatatatttatatactactaatacccttgatgatgataataataataataataatctttctccgatcctaacccaaaacccctaggagcagagcagagcagtagcagagagagagagagagatagctgtcgggaaatgtgggttgaagccgtcggcgaaatcaccacttggggcgagcacgggagaggcgctcccactccaccagccgcagcaagaactccatcacctgcaagagaaaagaaaatgggagaaaaaaaaattttagccggagtagaaaacacacggtggtgctggtgcagtgcagaaacaagttggtggacgccgggccgcgccgccctcccgagtcgaccgaccggtcgacaccgacggcgccggctgtccgtcccccgcggcgcgcggtggtccccgggaacgaaagcttcgcgcgcattgacgtcgactaaagataataataatagccgcgacgcgcgcgccggaaaactacgcgcgcgcagcgccgcgccagtagaacataacagtgtagtgtactagtatttcctttcctttttcatctcttttactacgggtgcgtttagttcacgttaaaattgaaagttttaatgaaattagaatgatgcgatggaaaattggaagtttatgtgtgtagaaaagttttaatgtaatggaaaagttggaagtttgaagaaaaagttttaatgcgatagaaaagttggaagtgatttacaacgggccaaaccatataatttgggatttacaggatgtgtggattgagataaagcacgagctaagcccatattatcgtgaattggctgggtgggtagattgataataaaataggatcctataattgttacacacccaagaagaaacatgaggtgatcaggaggggatggaataaggacgactgcgtttttatttatttaaagtagaagagtttccttttctaaaaaaaaatctgaacatttttgtgtgatgtacgtgttgacagttttgagatgagaaatcagaaagaaaaattgaaagaaatgcaaggggggtggtcattacctcggctggctcctgcagggagtaagaggcgttggtgtccttggggtacttggacacgaggatgccgatgccctggcctctcttgcggagcaccttgaacgcgtcctcgtcggtccggtcgtcgccgatgtacaccggcagcacgttggtgcagtcggcgaaccctgcattatttttattattcgtttcacaacgagcacacaaaacaatcagtgccaagcccagggaagaagaaaacgacggcgacagattaagcctgaacaaaaaaaaagagaaaaaattccattacctagcgactcgaggaggaactcgagggccttgcccttgtcccacttgatggtgggccggatctcgaacacctacaggagaagcatccaatgatcggaggacaatgactcagtgatcgtctcacggccgcaacatatcaaagcttaataataataagcatatatctctacctagcaaagaatcgattgatggctacacatgtctgcagaaacaaaaaaaaaaagaaaaaagaaaagaaaagagagtgagatttgaaagaaaaaaaaaactcaccatcctcccctgcgtgagcttcagtttggggtagtccttgagctctgccttcactatgtcagccaatgtgctccagctctgcatgcatgaaatcggttaattgatcatctagttacagagagaaacaaattaaggagatcgaagaggctgatgattagttgatgtcttctttttctaatagtactaataataattattactgctgaatagtgacaattttaggatggggctcacacactaattaagacactaacacccaaagaaaaaacaggtgctagtagtagtagatgcagggaaggaagagaaagaaaaggaaaggaaacaattgtgttgtgccgcaccttttcatcgacacatctgaagtggacagacacacagaacttgttgttctccaccttggctccaggtatgcacttggtcctttctatcagagaatcgtgcacctaacaaattatacacaccacaattaaccaagtttaacatcagatcgaacccaaaaattaaaagaaaaaaagctaaacttctccttcagctatagtttgcataattgcgtcgcagcagtagtactatgttctaacctgttctatcatggggaggaactcgctagccggctgaaagagaacgcctttcgcctgagaatcacacagaggtgcaaaagcagagaaagataagttttgcttttcctcgctgtggttgacaagtgcggcagtggaggatgctcaccttggccttgttgtggcgggaggccttcgcggggcccttgatgtccatgccatggctnnnnnnnnnnnnnnnnnnnnnnnnnnnnnnnnnnnnnntcaagacggtntcaatgggttcaa

SEQ ID NO: 308 - DNA, 1095 bp, Oryza sativa
  unsure (1)..(1095): unsure at all n locations
ctggtcnttnnttcggaaaacggtgcgactncnnnnnnnnnnnnnnnnnnnnnnnnnnnnnnnnnntctgcttcgtcatcggtcgctccgtgtcgaggtatcgatcgatcgaccgacggggcgagatcgatacaatcgatccgggtcgaagagagagagagagagagtccccgccttcgcgttcgagctcgtcggattcgcggcggagagaggagggaggtgtgtgtcgaggaggcggggaggaaggcggttatttatagttggaggaggcgcccggggcgggggggggggggggagagaaagagaagaggagagagagaagccaagagcgcgacgcgaatctatgggcgagggccccacactgtggtgccacggcgtggggcccagacgggtgtccttgggtcccaccaccacacacaacacaagtacagaacccaccccggccggccctgtgccgtgcccgtgccgtgccgtggcgttgcctcgcccagcccaacactccagtaatacggtgcggcccacgctagcttagctttccccatgctttgacactgatttattaccacgtagtacaccgccgcgacgacctcgatcgagtcgaaacgctcgttacaacgatgggaaagggttcgacgcggccggcacaacgacgaaaccagccggggcgggcggccactgccagaagggacacacgcgcgcggggaccggacgaccagacgatgggcgcgcgcgccaggagcgagggacgcgtgtgcgcggcgccaccaacacacacaacccgcgcgcgcggcccttgtgagcaagccgtggcgagaccgcgcgtggcggcagcggtgtggtcggtctctcgtcccgcgcgcatggacacgtaccctnannnnntnngtntttttttttttcttcctttcttttctctgtctttctcttcctctttttttcttcctccctcttcttctttcttcctcttcttcttttcctccgtgcccactccttcttatctttttcgcgtcttttgttcgtctcgcctccgctgtctagtttttcgttattctgctactattgagtcacactacactcttgatatcgctttcacct

SEQ ID NO: 309 - DNA, 10574 bp, Oryza sativa
  unsure (1)..(10574): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnccgccccccgcgccctgcgcggacacctccccgtaaaatttgtccatttctctcgcactccgtcgcagccgtagtactagtccgtggcggccgcgttcgttgctctgctcgtgccagtgtcaccgtaccttaccaccccgttgtctgagccgagacctcgtggactcatgctgaccccgccagattcagaggccagtatagtacggagtactaccgctagcagcctatggtcaaagcacgtagtacctgcaatgcatcggcgcgccctggcacatgcatgcaacaaacggcagaaacagctaccggaacagacacgggcggcacgggatcctatgcttacaactacgtactcctacgttcgcgcgccacgagctgccacaccgagcccacgtacgtacgagctgttggtcgatctccccctgcctgcttaccaagacgtagacgccgcaggtgcgcgacacggcatgcatctacctagtcactggcgtatgcatgtctcgttttatcgctacttcagtcactactaacataaacaaatctataatacgctatgatataacctagtataatttttagagaaggcatttcataatgtagaataacatatactttctccgtactaaaatataagtatttttaactatgagttaaaacaaactgttatgacctgagcttgtgagggatcgaatcacacaaactagcagcagaatacactgataactcgagataatttaggaagaaattggggaatcgggtgaagaacagacagggggcaaaggaagaagaagaacagcaggaggaaatcagatttaattcatttcattcactgaatctctcaatacatgtttcttgccttatatcgtggcggtaagactgacttgtgggacccaatcctatttctagggcccattcgtcattcacccaacactagatacatttatctagtatgggtatgacattactgcccccagaaaaacttgcttgaggtcaagcaagagttaagtgtggcatcgatgactttggacacgcaccaactttcttgcagaagtttagatgacctgatttccacttgatgagaagcacatgcaagtaaagaacatggcaccaggacacctatggactgatgacatactttcaaagctcccaatgcagttgcctacatatcaagtcgatgatattcaggaatcccatcagatctcaatatatagcatttccagacttgatgggggtggtggccaaggtaagataaagattttagcagcccttgcatcaaggaggtcttcagggagtagcattatcttgtcattgtctctaaaagagccaataagtaatagcacttcagcacttgcaccgactacaacatatgtgccaatagctgcagcagaacttccttgacagattgccatgaaagaacaaattcccttgttctaaaattccattgcctcttagccaataatgctactttataaactgcccaattctttttcacaacccactaactgatgaagcttgtaacaccaacaaattcttttgcgtaattcatgacaatagagttgaaaatacctagatctcatggcctgctgacaatcttcaggttcaggtactgatttatcacattgtggaatgattggacaatttctctataacaagtacttctggtaacaattagttcatgcacagtggtttgagaccaactcaaaatgctcaggtcaatagccagggacatatttgacttgataatgactagcaatctgaacattcttctcaggtctgcaactatccaaatgacatgaaagtactgttacctcgagaattatccaaaatggataaactaaaaactgagaaggtggaggccatggttctttctgccataacatcttggtgttttgatagtcaatggtttgtagtgtcatgagagccatcctcataatgcttgaaacttgcataatctgatttttggttgccgcatgtaaacatctatacaagcagtgctcgaatatctattgttggttcttgtttccaggactaaaaccatttctttgccagggaaatatcttgtcaagcaataattgatcaccttttgtttcatatttccagggacataacccatctctactccatggaaaaacctcctgaagcatttgattgctatatgaacaagcccgccatagtggcctacacaaacaccatatgctcattggaatgtcactggtctcacagcacacaaccacattgaccatggagtttggcaccatattttgaacccaaggggtgagatgctccactggtagcttgatattctgtggcatttcaacaaatgcaagagctgatgattcattgctttcgtaagacgtttcgtgtactagatcattttcattcatctcaaacaatgaaacgccgccaatatgagtgagcacatacacctcttttttcttcatggcccaacgtattgggcgatgagcgacgcgaattcgtgacacccactttatgatacgttggcttgtgcccttcctttctgtgaaaaatgaggctgaaatgggcttggtgctggatggaacatcatttacatatgttggacttgagatagagctggcatccagagaagttgttatgggcacagagctaggcaatgccgtggacacagccatcagcaaactagtaccatgtccgttgcatattgacaaacacctcacaggcgccaccgacattatgtcattggggcatgattgcatgtacttgacatccaggaagcaacagccattgtaaatgcagcacccatggagtgcttctctagctcgtgttgcatcttggcacagccggaacagaatgaaagcctcaacttgaattgttccctggttatacacacgcacttcctctgcaccatatggactgaatacctgaagaagaacctctgcggtcactggatagagcacatggctcatcgtgacgtgaaggacacttgctgtggttggctccttgttacttggcatttcatcgaacaccttctgggaatcaacactggaggttgcccctggacttgaaactgataccaaggaatccaccggggtagcaggtaccgaggaaggggatagagagcccatagcatgatccaatctggcccctaactcatcgagcttcgccaaaatgcggccatacatggcctccttcctctgttggtccagcgagtcactggcgacggtctccatcagcatgataaccactatcttcactcgtctcttcgtagatcgaaccttggttggaatcacggcgctcaagctgaacaccaacccttcctttggctttaccgatcaggctgaaatagaacggatcataatggctctgataccaaattgttatgatccaagctcgtgagggatcgaatcacacaaactagcagcagaatacactgataactcgagaaaatttgggaagaaattggggaatcgggtgaagaacagaaagggggcaaaggaagaagaagaacagcaggaggaaatcagattcaattcatttcattcactcaatctctcaatacatgtttcttgccttatatcatggcggtaagactgaattgtgggacccaatcctatctttagggccactcgtcattcacccaacattggatacatttatctagtatgggtatgacataactgtgtatacagatttatatagctaaattttaggacagaggtagtatgaagagactatatttcatccagcttcgtatataaaaagtaatgtttgtacatgagtttgataattaacatactatgtttaaatttgtatatatagcatatagaagttggtttttctaaagaccgatagtgttctcgctctctgtacatgcgtcgtgtcaaagactcgatcgaagccctgcatgactcatggctggtcggtcgtcgacccgatcgatcgatgtcagtcgtgcacgcacgcgaatgtccaactctaacggtctgacgcatgtgatcgatagctcatcagtagtcatcacggctttgagctgtcgatcgagccgggtctctaacgtacgtgtgcccaagcgacgggctacacgcgtatcgccagctaccggccgggtctcggccggtgacgtgcatgcatggcttcaccagccaatgtacttgctttgtcggcgacatgtccttttcccctccctacactttctttttgactgtgcagcgaccacgtcgacatctcgcgtgtatacatatacggagtatgtacaaaggtcaattgcataacttgctttgttcccttggttaattaatttgctatagctaatgtcatcttctattgatcagtatctgtcatcagttattaacttaacttaggaaccatcaaactaacaagaagtttgtccatgttagctactcctacctacctacaacctagtataactggcacataggtaattgatgagttgatgatttggtcggcggtttaggttataacccacgggtaagtatgcatgtcttacatgtggacacacacaaattaaactagtagctagcacgcagcttgtacgttgtaccttgtaccggtgcataattaccatattgtttctcccgtgtacttgtggagtttggagatcggaatcattaatttagggggaaataaaacaccagctgcgcctgcgcacaagattcggcgaaacgagaggcgatctctctcgcctcgtcgccatcgtatcagcgacccgggccacatgggttcggctactaatctatgggttcttttcacctaacaatggctgcaagagatttaattaattagctctgcaaaaagtgactcgctttttttttatctcctgcaggcccagcagccgtgcacgcacagtggctgtggagaagccaccttgcagttacagtggatagaaaatcaagtgattaacgatcgattttgagctggaattgttaataattatcctgtggtattaaaaatggatcaaaagctaactaattctgttagtgtagtgtatgcttgtattggtcgttacgcggcagcattatcattgcttcgaggtctcgttttaatttttgggtgtcttttcttgacgtgtcagtaagtacgtgttgatcagagaatctagcgctggcacacgtataattggttgcactaatatttctgagtagtactcattggcagataaaacacatatgcaacataattaacctggatttggtatacatatatgtacagatcgatatatatatgtgcctgtcaagaatataattaatataattagtttgcactatgcatgcattgcatagcatatgacacactagctttcgatgatgcatatggaattgaaggaggggtaccaatatagcatggctgcacatggacgcatatgcgtacatagctgctgacgtgtacgttttattcgatcgaagagacgggatcgatggtcgttgcatgatgagtctaagctagcgaccgagctcactatgctatagatgcccttaaaatgctgatcactagctacatagatgctcttcttcgacctagctagagcaatcaaagcatggtgaaggaccaatccaggagacgacaataatgtacaattcaattagttgagagcgaatttgatgcttaattacgtggtacattattggtacgtgacattatatatatatatatatatatatatattcacgcgcgcatctgatgaactaattaaatggctagatatataaatgttgggagatgtatatttatatatatatagatagatacatgtttgtatagctagtaatttcaacggccagcttcttccccccaaggaattaatcctttttcatcaacagaatccttatccttcaccttagttcctggctccctatgtactgtgatgcgtgtctccatgtatgaacctggctagcttctttctagatctctctagctcgtgcactaccttatctcactcatatatatgcgcatatattagtcacatggcttcgcttggatcaatggatattagcatatgtagagtcataaaatgcatctttcactttggatatatagcctcttttactttatatatagtcaagagctagccttagctagcaagctagcttgctccaccaaaagttaagcatgatacattccagaatgaattgagcagtacagtctaggaagtaggaagtaaacagagaacaaaattagcaaaagaggaaaatggaggacgagagagagagatgaagaatgctgaaacgaagtcagctatcaacactagtgaaagacacccgctttgtaaaaagttttggttaagttcatctacatttacatcggacaatttggttacattattagctagatcctaaatcatatcaaggcgttttcttccccgggcatatcatcaaggcgttttcaaggtggcaatgtggcattggattcgtctgatcttttctatcgtttttccctttgccccatatacccggctggccgggaatcagcatatatatatgttgaacacgtagagcatgacaccgatataaaaccaagtctacatatataaacctcgcatctaaatgattggagctctctctatctagctataggccagcactgacatcgatttgttcttttatttagtttttgacaattagaggtaaattgcaggatacattcttcttcttagatcgatcatgtacttgttggttaattttatcggttattgatgatacaattaaggagatatctgtgtggtggagtcaggatttttagaatgagtattcgagatttgcattaatacttttatattaataagaaaaccattcataatttttgttggagcattttcttttttaaaaactatgttttgtcccaagttgtagaaaaccataggtattacaatttatggcatatgaccacatgtttcatagtataagggttccatcactacagcaaaacaggcaactagagacggctaaaatactacgggtcatcaaaccgttgctactaaactatcccaacgtacgtgcgagaaatcccccatcacctagagtcggataaaagagacggagagataaactgtggctacctccccacttaacagcacccaccattataatatcctttaaaattattaattaatcagataatcactatttatttttggaactgctcggtacaatcgtaggtctatcgaaaccctcgacagagtcgcacgccgccgcgcgcccgccccagatcgccggcgtgcctcctccaccaccatcgcgcgccaccgctgaccaccgccgctccggtcctgcaccctcgcttctcttttttggccgttgctgcctatcgccactgtgctgccaccccattgcagccaccacggctcggttcagatcttgcgagtcactaggtagatgaacacgtggggagcatatttgtggagggatgagactgatttttggctaattcagagtatgatcccctgattggctgattgaaagtgctaggacgaccaagggattgacctgccgtgaggaatcagatcgagtcggacagcttcatcaaagaaaaggtaatttcattgttctctctttctattgagaatccacataggtatacattggtttaggacgattcgtgatgaacatctggtttggtgtgctttggtagttttaatttacattcattgggactgtggttagaggccattgttcttaatgatctttctttcctgaaaagttaggtatgttgttcaaaattgtcaacattactgcattcaatgtaaatctagtttctggaaaatgaacttaatcccttaatttctgaagtccaaaaagggcacaacagatatacaaagatatatattgactttgattgctttcgtatgcttcctaccttaatgcagggtttctgttagcagactagctagagggacggcttttgctgctatttgacacatatgcgattatcaattctcaggaacttcaattactgctgaagcacctccatgttactactagcaaggtgaggttgattaattcccaataaaatattatgcatatatgattgctaacttacatgttgccttatcaagagaaatgatatcaactctgcacttgttgtcaatatatattttgtttcactatatatccaatacagggcattattaatcatgtttcactattcttttgcttttcctaagcagatcaaaagacgatttctttagacttcaatacaagctgaacctggaaactccgtgatatacttgatgattgaaaggcatattcctttgcatccatggtgcttcttgtaagacataacttttttgttcatagattctctcacaaactctgagtgatctactttcagtttcagatgttcagataaaccatggagttaatttgatctattatttacatgattcatagtccatcccgtgttgttttccacggtaagtcttgtcattattttgttgacagaatattttatcagtagcttccttcacaatctctactctagtccactttcactatttatttttttcacattgtaaagttacattgtatagcaggttcttgtgtgaagatgatgattaacgggtgcatgaagatgatgattaacgaaataacagttcaatcaatctggagcaatagatagtatacttcaattagatggagaagtccaagttatgtatttgtttatgatattgtagctgaaattgtacattttttttcctgaagttcaacttttcatgtaagatgtaaattaccattcagtgaatgaaatgtgtgatttttcaacaagtccctccctgattttttttatttataatgctaaagtgtgatgcagtctgatgttctccaaataaaattgtggatgccagaattgaggaggtttgtttctgtatctaagaaatttatttgtagagacggtctgaagccgtgtctagtgtgtttattatgatatttctgcaaaatatggaaaatatatgtagagacggtttttctgtctctatggaccgtctctacctgatagacacggctagcaaaaccgtctcttgtttattgagacgggagcaatggcaacgcctcagagacggttcacaggccgtttctagtacacctagagacgggcaaaaccgtctctacaagagaagaaaaccgtctctatatcttgtttctgctgtagtgcatagaatcctgccttaatgaaatttactcaagtaaattcagcatatctaatataatatcatttataataggaaagaattaaaacaacaaccacctatatcaagaaatcaataattgaaattattatagatacttcataatatgaaacttttaattagtaaatacatattctacatgtatatataggagtatgtacggggtttggtgaaacattaggaacatggtatttgggttatgttcttcaagtcataacatatttcttttttgcaacttttgttatattaggttttctgatatttagtttttctgaaatcaataagagcacttgataaaatttaaataatttataatcgtgaaaaaatagcatttgtaaaacatttatatgtaacaatttagttatcagcatgaatctttcaaattaaaataaactagtattttggaccgtcatactaattaatatttcaacaatatgatactatcttgtaatattgaataaagaataattagtaagacgatgtattgcggggttaatgggggtgggctattcattcctgtcaccgcaccacaccacaccattatacattgtattattcttttaaaaggggtagtatagataatatatacatagctaattagatgtgtgcatcgaagaagtatcgtatcacctggacggcaatcaagtgcacaccaatagaactttcgtgtagaatttaatcatactaagaataattagagggtccacatgtaagtgagtggtgcaaaatattatagtagaggtggttctgtggctttatgccctaacttttccatgtttggaaagacgggcaaaaaggtaattacaagagtgtaaattctgcttgttgaacacgtcgtctcctaagcacacattgtcatgcatgcaactaactaatcataacaccaaatctttcgaagcttctttttgtatcgttgtaaatcgcttaagaaaaaacggcaagaatattttcataacggttcaagaatatgtacatataatatcggcttttgccacttgccagtagcacattttgattgaaaatcgaaaagcaactttagcatagattacccgtgtggcctctttatgcaaattgtctttatatttgtccctttgtacgtacggttaactagagctttgtatccatgatctctctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgttagtgtatatcaatnnnancgccgcc

SEQ ID NO: 310 - DNA, 751 bp, Oryza sativa
  unsure (1)..(751): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgtctgccgatcgatcgatcgatcgacagagacgacgctgctgctgatcctttcaccgtgccgtgcaggaggcagccacagccacggccaccaccagtccacctccaccacccccgaataaacctctggatcgctgcctgccccccccccccaccccccctgccactttccgcagcgcctaatcatgcgcgctgcaggccgctgtctgtctccacgcccccccgtacaccaacgcaccgcacctcccccggacaaaaaagccacttaaaacggtgcaacttgtgtttgcgtttgcgttggccttggcccttgtgattgtggacgaataatcaaaacctctccttccctcttctgctgctgctactactactggtctactgcctttcgcctcgccttcctcacgttggatcccgtggagttgagactgattctcatggaggcttaagttgcggtctcttgcacctgcttcgagtttgccccgcttgatttatataaaggggtggttttc

SEQ ID NO: 311 - DNA, 707 bp, Oryza sativa
  unsure (1)..(707): unsure at all n locations
ggtgtncncnanttagatcgccctnnnnnnnnnnnnnnnnnnnnnnnnnnnnnnnnnnnnnnnnntagnctatatattattgtttgttttgcgattactcgtaatgcgagtgtgacacactgttatctttttagttgtgatgatttagtttaagatttctgatcaaatcaggtacaagaaagcaaagggctcttccttttgttaatgattgatttggggcttgggtggtagcacttacttttcgatgcgataggctacatagatgcacgcatgcattgctcgagttaacagagaggttgtactgaaggcggccggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 312 - DNA, 708 bp, Oryza sativa
  unsure (1)..(708): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctcgtcgctcgtccgctgggccgcggcgccgcactcgcgccggccgcacgcatgtcgtcgtcctctgtgactgtgagtagtagtaataccacccacagcgtcacggagctctccatttcttcttcttatccactgtctatgcgacgggcagcggccggacggaccgaggtggcgagcatcgacgacgacgaggcgtgcgagctggtgagcggcgcggaccttgtcatcggtggcgacgtcgacaacgagggcgaaggcgtccgcgcgtacctcctccgtctcccccgccggctgcagccgcgcgccgccatcgccgaccgcacgagggggatgaggacagttacaaatgcctcagatttgtgatggattaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 313 - DNA, 684 bp, Oryza sativa
  unsure (1)..(684): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaataataattattactgctgaatagtgacaattttaggatggggctcacacactaattaagacactaacacccaaagaaaaaacaggtgctagtagtagtagatgcagggaaggaagagaaagaaaaggaaaggaaacaattgtgttgtgccgcaccttttcatcgacacatctgaagtggacagacacacagaacttgttgttctccaccttggctccaggtatgcacttggtcctttctatcagagaatcgtgcacctaacaaattatacacaccacaattaaccaagtttaacatcagatcgaacccaaaaattaaaagaaaaaaagctaaacttctccttcagctatagtttgcataattgcgtcgcagcagtagtactatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 314 - DNA, 674 bp, Oryza sativa
  unsure (1)..(674): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacgtacgttagagacccggctcgatcgacagctcaaagccgtgatgactactgatgagctatcgatcacatgcgtcagaccgttagagttggacattcgcgtgcgtgcacgactgacatcgatcgatcgggtcgacgaccgaccagccatgagtcatgcagggcttcgatcgagtctttgacacgacgcatgtacagagagcgagaacactatcggtctttagaaaaaccaacttctatatgctatatatacaaatttaaacatagtatgttaattatcaaactcatgtacaaacattactttttatatacgaagctggatgaaatatagtctcttcatactacctctgtcctaaaatttagctatataaatctgtatacacagttatgtcatacccatactacataaatgtatccaatgttgggtgaatgacgagtggccctaaagataggattgggtcccacaattcaatccttaccgccatgatataaggcaagaaacatgtattgagagattgagtgaatgaaatgaattgaatctgaattccttccgctgttcttcttctttctttgccn

SEQ ID NO: 315 - DNA, 2067 bp, Oryza sativa
  unsure (1)..(2067): unsure at all n locations
cggagggggattctacatagagcgtttatttctccacaacaacaggagaggtttttgaaattttgcggggaagagaaaaactttttcccaaaaagaagacgaaccccggcaaagggtgtttataaggcatattttacccaaataacccccgggtaaagttaggaggattttttttaaacaaaatggcctgggcaggggaatccaaacccttcccgcggggtgcaaaaatacccttgtgaaccacaaacaaaaaaaggggttttttttttagggttaacccttaacccccgatggatagggttgccaacttttgaaagggagatgggtggggctttttgtatatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcccccacggaggcgcccccatggcggcgtcggcggcttcgccacggcggtgtccgcggcggcgaactggcggcggtcggcggcgaaccggcggcgaactggcggcggacgacggcggcagacgaggtggaggaggcggcgccgactcggcggcatcatggcggcggcggcggcacaaactgcaggggcggttagggttaaccctaacccccacgcccctccagcgcccccttttcccctcgggcccaatgggccggttgcactgtagcgggggtgggctgaatcctattgatttcggcccaccacccatttaccccttaaatttagtttttattttttattttcagcagcaatttcactttagtccctatattttatgtaatttagtcgaaacagttcatcagttgtacaaacaattatgtaatggtcctatagaccactgatgttatgtgtttattaacataggtgtttatttaaataccttgtttcactaaatttatttgttgtcttaataacatgccttttgcatattatttcaagacacgctctactttctctataaattttgtattttgatttagcaaattctcttaattatgtccaacataattaatggaggatttaatgcatgttccacttcacactttaacttggaaattaatcacatgtcgatggagtcctatactttggtcatatcgaccataacttaggcagcgagtatctcgcccatcataaagtggtctatattttgagatgattacccgatggagccctagaaattggccgcactggtcataacttaggcagcgagcacctcgcccatctcacagaggtctacatctcacgatgattacccacatgtgttcttttccaagaatatgttttgagaaatgagattatttgaaatttggttgaacacaaggtagtggagttctaaacattggctacggtatattcaccataatatatttgcctggagaccgtattttaggcagcaagtatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 316 - DNA, 1898 bp, Oryza sativa
  unsure (1)..(1898): unsure at all n locations
agtgagtgtttcaatttggaacaaagtccacttttaagaaagtggcccccacggcagagggaaaaaccgttcttaggggcgagggcccataggtgaccctcccccaaaaaagtttttggggcaaggggccgtaaacctaaatggaacctaaaggaggccccatttaaacttgagggaaaaccgcgaagtggcaaaaagaaggaaaaaccaaggaacgggcatagggccttgcaagttaccgtcaacttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattaattaggcaacattaggtggttttattaactttagactttgggaatgctcatatcatttggacactgtggaatgattggcttgtgatggaattgaacacacaccccccccctctattcaaaactcccaaaatggttttaggctacgttcgaggtgcatggttttgctagtagcaactcggccactataaggaccggtcttcgggcctctgttgcaaagcactaccgtactaaccacatgtctaatgggtaaggcttaactcggtgctcagtctagtcctgaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtgctgcgttttcatagctcggcccctgcgagcatacaaaatgacctcagtcgaagtgcgaacccgcacgactttaaatacagcgtttcccttaagctcctctgcctttctggtccaactgtcgtaacgtaaccgtcgccttttcttgggagagggggctctatagctagccgagagtttaaatcggggagcgtgcttcaactggttggggaaaacccnttaacccgactgggccttccgaactttttttgggcaaccggagacacattta

SEQ ID NO: 317 - DNA, 1936 bp, Oryza sativa
  unsure (1)..(1936): unsure at all n locations
cgttacccctaatttgtgaaaacgggattccccctttgagtgaattaacccgttcccccaaccgaaccgcccagcccaggagtccattaacagaggaacggaaaaaggcccaatcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgattccgcaaggaaccttcatgtaaatatcagaatcaagtgacccataaagatatgctgtcactacgtccatcaactgcataaatagacgattttgtactgccaatgatattaaatatcagaaagttataccactcataactggagagtaagtttcgttgaaatcaacgccaggtttttgcgtaaaaccttgtgctacaggccttgctttatatctcaccacctcgttgttttcgttccgtttccggacgaaaacccatttgtatcccacaggaaagataccacgaggagtaggcattacagccgagaatacatctcttttgtaaagcgaggctaattctgcgtcaattgcgtccttccatttgttccagtcagagcgcttttggcactcttttatatacctaggttctggatcaacttggaggcactcagcaatttgttcagaaaaattagtgtcgacaattatagctcttctatcaaaagattctccagtttcagagtaattgatggcaatttcatcaacccttatagactcattgtgatctcccgaaacaatgtgtctatggtcttccgaattcctagtctcagcattgtgcaccaccgagctaggttgtagactatcacgatctgcttgacatatagtatcaatttggtgtgtaccaactaaaggttggtttgcatttaccgtctttctttgcttattagcaattgtttctcgctgagtggccatacttcttcctctctttttagtgagtggaagttgagtgcttttatttggtacctccactctttctggcgcattctgagcgggaatgaaagatttagtcacacctttataattggtaaatgcatctagcatgttatttgcaagtctttgcaaatgtataattttctgaacttgaagttcagtttcagtagtacgtgggtctgaggctggaataccctgggcatcccaatcaatttcctggcattctttttggtacttgaattctccccctaatgcccggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtcattgattccttagctgtgtcgtcggttgggggagccggttaactaattaagggcggaatacgtttttccacgaatcggggatacccggaaaaacctttgcccaaaggcacaaagggccgaccccaaaagcccgtttggggtt

SEQ ID NO: 318 - DNA, 1266 bp, Oryza sativa
  unsure (1)..(1266): unsure at all n locations
ccaccgaccatctctctattgttattatcattgggtgtgatcctacctcttttttctcccctttnnaatcaccttngttctnttttcactccccccccnnccccctggatgaaacatgagnccnntcggcagnaccgagtagccccgtcgtcggcctcgcgcctacccatcgnctatccgccgattccctcacctgggaggactccaagcggagatgttgcgcatcctccgggctggcgttcgcggtgtaggccgcgagatcgaggaggccaaggcggcggcgttgtcggcaaacgaacgtgccgatcagctggcgcgcgatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 319 - DNA, 1345 bp, Oryza sativa
  unsure (1)..(1345): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctcttttccttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 320 - DNA, 1476 bp, Oryza sativa
  unsure (1)..(1476): unsure at all n locations
actcacacaccacaanaccaaacatttatgttgaaccataagcgtctcatactctccacatcacacaacaancctcnntaaatacactcaaacctctcacataccacccncccccccagaaatgataatcntgaacancccnnnnntnggaaccccccaaaaacaaaacccgcccaaaaaaaaaaaacanctttttttttcccccaaaaaaacaacggaggggacaaaaaaaaaaagggaacctccaaaaaaaaaaaaaaaaaagaaaaaaaaaaaaaaaaaaaaaaaaaaaaaaaagaaagaaaaaaaaaaaaaaataaaagaaaaaaaaataaaaaaaagtaccaaaagaacaaaaaaaaagtgaaaaaaaaaaaagaaaaaaaaacccagaaaaaaaaaaaagaaaagcgaaacaaaaaaaaaaacgacaggaaaaaaaaaaaaaaaaaaaaaaaaaaaaaaaaaaaaaacaaaaaaaaaataaaataaaaaaaaacaaaaaaaaaataaaaaaaaaaaaaaaaaaaaaaaaaaaaaaaaaaaaaaaaaaaaaaaaaaaaaaaaaaaaaaaaagaaaaaaaaaaaaaaaaaaaaaaaagacacacaaaaaaaatagacacaaaaaaaaggaaacaaaaaaacaaaaaaaaataaacagaaacaaataaaaaaacaaatcaccagaaaaaacaaacaaaaaaaagaagcgcaagaaaaaaacaagacaaaaacaacacagacgaaaagcaagaacaaaaaaaacataactgcaacacacacaaaaaaaaaacaaacaagacaaaaaaggaacacgaagaaaaataaaaagaagaaaataaacgtcaaaacaaaaaaaaaccaaaacaacaaaagcgagagaagacaaaaaacagaaacaacaacgaaagcatgggaccaagaatacaagaaaatataaaaaaaacaatagatgacgaggaaacaaaaaccgtcgaggacgcagaaaaaaaaaaataacaataaagcaaacacatgatagacggaaacgagacaaaaaaataacaaaaagaacgcatacacaactgacgagaacaaaacagacaaacaacacaataccgtgacacaccctgccacgaacaagacactaaaaaaatacagacaataaccgagtagagaggagagcaacacaacacaatcatcaacaaagacatagaacgatacgccgccgagaatacaacgcaaaaagacacacgaatacacaaataaagaacaacaagctgacacgaacaacgaaaccatccacaacatatacacaagaccacatacgatagacgaccaacataagcgacacagagaaaaaaaaaaaataaacaaaaaaataccacaaggagcgcagcacacgtcccgactcgcacaatgatagaactagaatcgataccctaagtaaaaaacacgcacgctgtcgcaacgagaacaggaaacaacaaaaaaaan

SEQ ID NO: 321 - DNA, 1092 bp, Oryza sativa
  unsure (1)..(1092): unsure at all n locations
accgcgtgaanttgannattgattnccnnctggcaganggcttctatgcgtattttattcagcacaagcagcgaaattcccttatctggctgcctactgatggtgacgccgaaaactttatgaagtcgcatgttgagccgacgattcgcgatattccgtcacttctggcgctggccccctggtatggaaaaaagcaccgggacaatacgctcagtatgaaacgcttctccaacggtcgcgggttctggtgtctgggtggtaaagcggcgaaaaactatcgtgagaaatcggtcgatgtcgccggttacgatgaactggcggcattcgatgaagatattgagaaagagggatccccgacgttcctgggtgataaacgtattgaggggtctgtctggcccaaatctattcgcggctcaacgccaaaaacaaaggggacctgccagattgagcgtgctgccagcgagtccgggcatttcatgcgttttcatgttgcctgtccgcactgtggtgaagagcagtaccttaaattcggcgacaaagagaccccgttcgggctgaaatggacaccgggcgaaccctccagcgtcttttacctgtgtgaacataatgcctgcgtcattaagcagcaggagctggatttcactgaagctcgttacatctgcgacaccaccgggatcttgacgcgcgacggtttatcctggttttcatcaacaggcaccgaaatcgacccgncagacagcgtgacgtttcacatctggacggcatacagcccgtttaccaccttggttcagatcgtttaagacttgctaaaaacgaaaagggatacanggaagcgtaaaaccctcgtgaacaccactctggccgaaacatggnagccctaaaatggtgaaccggcctgacccgnactcatggcccaaccccaaagagtctttgggggcatccgtacccggacgtgtggttatttggaaaccggatcgactcccaactggatcaaattgaaatgcgctcttgggatgggggcccgtgaagaaacttgcttatttaccgccaaacatatttggccgccatgatgatgacccgacctctctaagg

SEQ ID NO: 322 - DNA, 607 bp, Oryza sativa
  unsure (1)..(607): unsure at all n locations
ctgggcaataagggccctttacgtttccccaattgttccggcaaaagtgatccgctcccgtgccggcagcacgtctgaattcacgccgggttatgtgaagccgaaacacgaagttaacccactgatgactctccgccgcctgccggatgaggatccgcagaatctcgctgacccggtctatcgccgtcgccgcattatccttcagaacatgaaggatgaagagctggcgattgctcaggtcgaagagaaacaggctgtttcggcggtgctcagcggtaaatacaccatgaccggggaagcgttcgagcctgttgaagtcgatatgggccgcagcgctggtaacaacattgtccaggccggtgcggctgcatggtcaacccgcgacaaagaaacgtatgacccgaccgatgacattgaagcctacgcgctcaacgccagcggtgtggtcaacatcattgtgttcgatccgaaaggtccgccctgcggcgttcttnaaggctaaagaangaagatggttgggggtcggggtttttacccctgacgctggcnccctcccttaaannnccgggtggncgtagattgtaggcctaccgttnnnncacttccg

SEQ ID NO: 323 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttttattacccattggatctataggagattgatcaacagtggtataggctttatcctttaatgtataattatccataaaagaacctagcctactccttaaaaatccatcaaccttatctttaaacattacatctaatctaatctatctttaaaattagccatagatgaatctattgtagatgcaatttgttgttggatagattgtgatacctcgtcattacttaccatgtcgggagcgagcttgggacatggcccgggcttgatgatcacaccttgacgagtcctagtagttgatctcatcaaggcctcccgtgtgagctcgttgatgtactcctccatagctttacgatcctctccttcgaagtcatctaatgtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 324 - DNA, 564 bp, Oryza sativa
  unsure (1)..(564): unsure at all n locations
gcgcttgtgnnnccaaggtacangcatgtgccgcatatcttcaccgncgnttgcgtacaagcagaggtcggccctgcctgcgaaaaccgatttccactgccggcgataatgcgttttctggagtgcctgcatttacttgcaacctgaattcctcaaaggcgatgagaaatgcatctagtcctttaggacacggctacagggagttaccaaaagtagtacagtgtgtatccacttgttacccttcttactaaaagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 325 - DNA, 1424 bp, Oryza sativa
  unsure (1)..(1424): unsure at all n locations
cggggnatggtgcactacgcctgatancactagtnccctgcangggagttacacggctcgccgggcattgtcatcaccgccgtccatccatggtaggcacaatactgtaccccttgcaggaggatccagcgaggtgcttcggcaaccggaggcggaggaggtgcgacagggatggggggggggccacaaccggagttgcaggcacacgacgagggtagtggcggcggccaccaaccctagccctgcctccgcgggatccccggcgcgtcctcctcatcgatcgacgaagaagaaggtgaagccggcgtgcgcgctgatggcgagggaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcttgtcccctgaaaaaatgccttttcgctgttttggggccaaccctgcggttaacagagaactgttcgctatcttcctttgggaaagaggtgtgttctcttaggtaaaattgttgtatctcaaaatcgttgaagatgtccacagcaaggtgggggttaagcgcggaacaccnccggtaagacgaacgctgtgcattatagggaataattcctctgagggctaacccggaaggaaaaacttatttgacctgtgggaaatcctgtgtaaagaattttacacgggggttcttgggggggtttaccgttgggaaaaagggtaaaaaccgggcattgaaaaaaaaatagagtcttccttttttaaaaccctacctttcaaaaaagaagggggtttaatcgggaaaaaacccctgtatggggggataaattgtttcccccaaaaactccaggaaaaagttccaaaaagctttttttttctggggtggggg

SEQ ID NO: 326 - DNA, 1850 bp, Oryza sativa
  unsure (1)..(1850): unsure at all n locations
aaaaagttgctcccagagaaaacaccctggggggcgccccgaacccacccccaaatatttttggggggggcgggccacttgaccccaaggggccccttatattttgggagaacccccttgtgaaaaaaaggaaaataaagcgcggggccaaggccggcaatatacggccccttcgggtacccccaacccccgcttttatgcccttcaggggggtcatttccttgggccgaactaattccccaaacccggtaaaggggtttttatcctttttcggggtgaaaacaacctttttcccccttacaggagccggcccgtgccaaaagtgggtttccggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgcttgccgacatgaatataccccgagtcacaacacctgctgtgcaaccaactcctcgtatacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgtagggcacagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgccttgggcctcggttgggggaacggtttaattaatcaaaggcgaatacgggttttccacaaaaggggataccccggaaaaacttggacaaaaggccccaaaggccgaaccccaaaagggcgggtttgggcttttccaaagttcccccctggaaagaataaaaaattcctctaaattgggggggaaacccccggcttttaaaaccacggttccccggaaaatctttggcctttttttgcacctgcctatcaggaaaaggcctttttttt

SEQ ID NO: 327 - DNA, 1229 bp, Oryza sativa
  unsure (1)..(1229): unsure at all n locations
agcgtgttttgaatcgaatacactgatagacnacctctnnctnttctggcttagattgacgcgcttgagcagatttgtgcagccaccgtgccgtcgccatgctcctctcgtcttccctcgccaccactgcccccaccttgtgattactcttgttaccctcggccccacctccgaccatgcccacagctggatccatccctgtggcttaagcaccgcctcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 328 - DNA, 1855 bp, Oryza sativa
  unsure (1)..(1855): unsure at all n locations
tctcccctaagggaaatctttagagggggccccagtgccccccccaaaccttttgggggaggggccgaaaccttagggacccaaagggaccccttttaacttccgggaaccgcccatgtgcaaaaaaagaaaaaaaaaaaaacacgggcctgggccccaaaattaagggccctcgggggaaccccaccccgccgttattgtccgaaagaggggggccttccctttggggctgaattttattcccaaaccctcgggtaaggggttttgatggcatttccggggctaaaccaccctttttccccaaaaagaagccggcccggtggcaatccggtgtcatccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacactggtactaaaatttgatcagtcaatgctaggtcttaggcttgtgaaaagaattacaaaacttgctttgcgcaaaagaaccatagccatcctttgaaatacccctatcatgtgtattgttgatgtggtggcttgctgagtatggttggtactcacccttgcaaatataaacttaatcagaggccggagatgaagcttcggaggacccctatgcctattaccaggagggtgatgaagacgatggagctcaataggtcttagtgacggtcgttgcctgtggcaatggcatgccgctgccttaattccgctgcctcatctatttctgcttttaggatatattccggactgctcggtccgatgatttaagactacgcctgcgggtttatgttgtaataattcgcactagactctcgtgtatgtgcatttggtatttcagctatgaactcgtgtgtaccagactacttgatccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggtaatgattccnttggctcgccgttcgcttggggaagcgtttacctacataaaagcgggatacggtattcccaaaatacgggtaacccgggaaaaaactttgacaaaagcctccaaagccccgaaccctaaaaagccgctttgtggcgttttcaaaagttcgccccctggaaggttcacaaaaatcgccttaattaagggggggaaccccacggtttttaaaaaccggcgtttcccctgaaaatctttggggtttttttggaccttgccttaacggaaaatgcc

SEQ ID NO: 329 - DNA, 1215 bp, Oryza sativa
  unsure (1)..(1215): unsure at all n locations
acgtgntttgaatttcgaaacgctgtgangcgcacaaagnaattnttcaaaatgttgatgcattccacacttggcatgatcgacttgggcaccccggtatcgggatgatgagaaaaattattggcaactctattggtcatcatttgatcgctgcaaccactgtgtgcaaatatcccactgtaattgctgggaattccgaactttatgtgcaccgcacttctgaggttggtttagactcaggaactgtaatgcacgaaacttatgaattgttcaaagatggcaggcatcctaaacaagctactacctccatccaaaaaaattggacactctaccgccgggctgatgtcctgaaatttcgtttagatatttaatcagcgaaagtggggctcacatgtttctaatttttttgggtcgatagattcctcacataagagcatcaccaacagatacctataatttcctctagaaaagttgtttttcggtttcttaaattgaaaataggaagtagaaaaattgatctctataagagaacacctaaatttaattccaaaaactagaagtagacctttctgttaaactagaagacaccaccgccgctggatggcgtgggcatgcaaaatcaccgagcgtgaacattttgcctctcgtgcgggaaagggagtagaggcgcgggagcaacaaaatgggggtgggaaaagcgagacaacgctccttcttatattgaccgaacgaggtttccggattaggggaattccaaaaatgggcaccaaaataagggatctggtggagctggtttttttttgacgaaattccttaaaaataggtttgggaattaaatatgggaacctgttaaagatgctcttacacccgcaaaaccttatccctacgtgttaatctcgctacttcatcggtcctaacccgaatcccaatctttttcacgcctttctcttcaatacaacattgacaatggcgaagcgggcacactttagacccccaatgtcccgggctcttttattcccggccctattgctttggaggcataccgagaagcgggcccattaccgtgggggcacaccccaaatccgtgtcatgagttcaagtatgggcaacccttattaccctcttgttcgtgggggggacacaaaagggccttttttttttatggggggggcccccccccctatttgtgaaaaaagttgggtcttttccttttta

SEQ ID NO: 330 - DNA, 28864 bp, Oryza sativa
  unsure (1)..(28864): unsure at all n locations
cagcgggttggacgtgcgtgngcgattcatctttgacagngcttggtatctatgcaccaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttgtgggaagtagcaccccggccactataaggattaagctcgggcgtctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcgtggcacagggttggtgccctgctgctagggggctcagtcccgcctgcctgtcccggaggttccggccgtagggggattgggtcggtactcttgtctatggctaggatgggttggaaactatgtcacgtcttccgtctgtataccgtggtggtatgtggcacgtggctacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttaggttaaggcaggttcgtgagggttcacggccttgattaataatactgtgtaactctaggatcgtctttataaaatggctttgggcaactaagtaacttttaaatgctgtttactgcaaagcttaacccctatattattaccccttgtacccccttgcattaatcatgcatctgccggtgtggcttgctgagtactgtggttgtactcattcttgctcaatcttttcccccttcagtaagagaagatttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacagaacttgtaattctctagcactagaatgacatatcctttggattgtgcaccaatgccacgcgaaaacccatggtgccaaaactaggggtggaaaaacctccgagacctcctccgaagaggcaggtgacaggtaaggcggaggaacccgagatgcataaggaaaatccagtgccggaagtgccaccggagattgcagtgccggaggtgcccatggagattgtagtgccgttgtcccaatggagattacagtggcagaaccagaggtgcaaattgtggcatcagtcgggacatatatagaagaagtagtacgattggaatgggacggtacagagccagaaatatttgaagacccttctcctgcgaaagaccccgaggtgcaagaaaccccggtccctgagaaggccactgacaattctaaggtgcctaaagtgcttatgagccacgactccaagtctaaagatgagaacaatgagaagttcatggtaaccatcttcagagggggtaaggaacgtgccaaactcagagatgatgacccccagaaggctgctgcactagccaggccatacttgccaactgatgattgctcggaaaaatacgaaaatgggaaagcactcttgccggattgggcactttacgaaggaccataggagatgagaaggttacataccttctacatggatgccagcaagaaaggcttgggcaatataacagctcgatcaccggcagattgtttcggcggcgaatgttacgtatggctagatttcgaagatctccatgccatatatcatcgggacaagatgaacgtcaactatgttgctgttaggtgcatgtgagtatgaattttaattaattacatgaaaaatatgtacaatacaaatccatgtaattattactaagagtaggtacaatagcaggctataagccagctgtaaacaaattttaagaagataaacgaggagagagaagggcagcgggctacagatttgtagccagctgtaacacggactccaagacacagtgtgtgaatgacaggtgggaccaggtattaatagtgtagtatgtaactattgtatgaatgagctattagattggctatagatgaattgaagctagtagttggctatactattgaacttactctaacaaacttcttctgtaggatgcaatacatggatgctaagaagaaaaataaacctatcagcttcttggatccaactcggatctgtcaaacacaacataccgtgaggctagcaccagggtcagatcagctgaagggcaagactccacaagagataactgaatacaagaagggcttgcacaaggagaaagtgattattgtcgcatagtatattggacgagccttcttgcactttcaaaataagagagtcgtcatggccgcttataattttaagtaagtccggtacatttaacttctacacatgtgtcttattttagccggtactaactaactaagttgttttttaatatgtagcgatcattatatctatttaatcatccaccagaaggatggaaccgtggtagtcttggaccctctcgattacatacaccagtcatacaaagaatttctaacaatcttacagtagtaagtgattgactcttacatttttatatgaatgttttataattaaatatcctccttaatgcgaaacggtacgacatccatacagtgtgtacaactactacaagttcaagggtgaagaacagacccgaacaagggagaagctgctagtacatacatattggccggtaatacttcactcacttaatgtattccaattgtttcactaattgcaaaatttaactctttttcctatgatatgtcctgaagtgtcacaagcaacctataggaactgtcttttgcgggtattacgcgtacgaattcctcagggttaatgggaggtacaaggttaacgcggaggatgtaagtctctatactatgcattagacagcttcacatatttatgatactaatatattgtttatcttcaatgcatgcagttgctaagaatagaacgtcgaacgagctttgacaatacaagcatcacgaatgtccagcgcgatctgtgccaattcatccaccatgagtgttgtcatgtgaaaggagagtttttcgacccagagggtgccctatctacaagtgacgaattcaagaaatttcgagagtggagcactactatgccataatgtaactagatggtgtatttgaagtgacaatgtaaaaaaatattgtaatatatataattttggcaacacttttcagttatgcaatatatctagatttctcagtaccaaatacttgataatctttccaatatatgtatataataatcttcctgcaagaatttctattaaataataaaaaagtaatttatgggcaaattattattgtatcaaatttcaaaattttctacctatcttcataggcggatgttttttttttgcagtcggcttctacatattttcgcaggcggatcaatctagctaacgtccacctgtgaaaataatcttcgcaggcggacggacgccccgcctgcgaagatcgatgatcttcaccgtcgtttgcttacaagcagaggtcggccctgcctgcgaaaaccgatttccactgccggcgataatgcgttttctagtagtgcctgcatttacttgcaacctgaattcctcaaaggcgatgagaaatgcatctagtcctttaggacacggctacagggagttaccaaaagtagtacagtgtgtatccacttgttacccttcttactaaaagcagtagcacctgccacttgcatcctcgtaacccatctaaatttcaaaaaacaagtttctcttaaattacttatcttatctacgatccgattacaccgttgtgttcgttacaattaaatctgtacaacgagatcttaatgattatattatgaagaaaaaagtatttatgtttgtaaattacttttattatatactaagttacttttatcatatatataaattacttttagatttgattcataatgttacgtggtgattacttttattattgtttttagtcaattccataatttctgctgattaatttagtttctagatagagttatgtttttatacctacaacatatttacttctaatgacatgacaaagttactttctttttttcttaagttacttataaatatatgtaagttacttttagactttattgaatttacttttaatatgtctaagaagtaatttagtgaaatctaaaagtaatttagatatattataaaagtaatttgcaatttttcatcgtaatatgatcatgtgatatcttgttgtaaagattacattgcaacgaacataatggtgtaaccggattgtagatcggataagtaatttgagagacaattttatgagaagggaaaaagacatggatgtctaacactctgatgcttctctcaaattctaaactctaatgtttctcgactaaatcggatggccgtgctaggcgtcgctgcgtaagaccagatcaaaggcctctcgttatagattttacgagtcctttaatgtactctacattaccacgttttgaattgtacatcgtcgatccatctatattccaaaagaaaaaagaaagacgagaagcttaattaatgcatatactaataagttatatccaccatgattgatgttttaattacttaggttgatgcataaaatctaatatattatttgtgtcagggttacggataaggtataccctctacccttggatatacgctatgcggcaatatggtatacctgcacgtgtacggacgttctctgtatacgctaagcaaattcttcacgaagttaactgatggaaagattcctacccgtataggactgggtcgtcactgtatcgtgcagggtccgatgtctccgagtcctacttggagaccactaacctgcgatataaaagggaccccccgggatgacctaaggcatggaatctcagagttaacacaacgaccacaacccatgaagtcggaacctacaggagccaagtcaccgggtgatctagtcggatcaactcgactacgatctcgtcggtatcatcgagttctgctattccctttgtaattcgtggctttcactgtataatcccataccaactggattagggctactaccttccgaggagcctgaaccagtataatccttgtcttctattttcttgatgtcatattacgtagatccttgtaccagcgtacctcaataccctctatatccggtctactggtatcccccgtcgataatttgcatacataaagtgaattctattaatatatctagacaaatacgtattactccctccgtttcatattgtaagactttctagcattgcctatattcatctagacatatatatatatatatatatatatatatgtctagattcattaacatctatataaatgtgggtaataccagaaagtcttatattgtgaaacggtcgatctagaaaataaatatcgattaaaaatgattattctatatagttgaaatattatttaacacaacaatagagtaaaggatatctactactccctctgttttaggctataagacattttgactttagtcaaagtcaaactattttaagtttgactaagtttgtagaaaaaagtagtaacactttaaacccaagacaaatttattatgatttaatgaaactaatttaatattataaatattactatatttatctataaacttaattaaacgtaaaataatttgactttgaccaaagtcaaaacgtgctgtaacctgatgaaacaggagggagtatgttactagccttcgaagacaatttagagccggggaaagcgtcaagtacccaaaattttaaataaaatagcaacaaatcaccctctgtcgagcttgatcagcaagaaacatggctgctccctattctgatcgaaatggttttctctgcaagatatataccgcataaaatattttatcatttctggctagttaatttggagagagcaaaattttaaaatgaccagaatgcccctagggagaagattgatcatccaataacccttataagttgtgcgggctcgtaattggtctcatctgaacaaaaaaaaaatcaacctccattttcgcatatggcttcattaagaggacaatatgcaaaaacatattttctctgatgagccttttaatggcagcataaaaaaatgagcctattttcgcatgcggtcctcctaagacgtttcacatgcgggcttcttaaatggtccacgtgcgaaaataccccctctccacaaatttttctcccctcctctctcttttgcctctcagcaactttaatattttttcacctcctctcctcctaatattattttcacctcctcctctcttctctctttctctcctctccttctagtggccggtggcgggcagcggccggctcagagatctcgagcggttccgcagcagacaaggaggtggccgtgtgcgggcggttcgaccacctcgggcggtgccgctgccacagaggcagcggcgatgggacgacgtgacagtgacaacgggcgtgggcaacgtcggcggacaccctcccccccccccttgaatccggcggcggtgaccctccccgcgccgatctggcggcagccgctctctccaacctggatatggtggcagcggccctccccagcccggatcacgcgtcccctcctattcccgcgcggatttgtcagcggtggctatgggaggaggacgacaatttcggcgacgacggaaggacaaatacgacggtggcagcaacaacgataggattctagggttagagtttctgagtagtttttgtttttcataatttctattcctttcacgatttttcctattcgcatgccggccgttggcttaagcgcccgcatgcggttgcgctggccacatgcaaaaatacgaattttgcagacttttgggcgtaggcggtccgcccgtccgcatgaaaatattgattttggccacgtggaaaaactgaagctgtagtagcgagcgttgtgatagccattagcacagctactttcttatgattacagttctaagagattcaagagaggtgacaattgacatattgggcgaactggatacataagataagcctttttttttcccgggcattctgttcattactctttttttttttcacaagtagccaaaaatgataaaatattgctggtggtgttatgtagcaaagaatcatatttttttttaatccatgagcaaatttacgttttagatcgtccttcgccaaataatatattttagagtgtcacctactctatcattctaaaatattgctattcaggataagatttgacccattttaaaataacgaatttagacagtggtggagctaggacccggctagcctcggcaggtgcccgggctctgccggatgtggccgtactatgcagtagttatcagtttacgttaattacttagatacaagttcaggcgttcagccacgtacatttgagtaaaatagcaaattacatgtttaattaactagttccaataatggttgtcagatcagtggatcagcacataaactagcaaaatgactagctatatatacatataatgtcaagtattcaacattaaccattaacgagtttcatttcatcaatataatttcgtgcattggttgtcttcttcataaattagaactcgatctatgctaaatcgggcacgtggttgtatggatttaattgtagttcttctctattattaggtttgcctaggctcaatatccgccactgaatctggatagaacctatgtcgagatttatggttacagaatgtgttaaatcggttcagtttagttacattattttatgataaattaaattctatcctatattgcaatattttggaacggaggcagtagcaaattttatttaatttccaaggattgatattgttgcaaattttgtttaatttgcaaggattcatattgtgtgcatataattacataaaagcagcaaacattcgtaactacgaactgagaactaatgatctctaacctcttttcaaaatgatgactattcactaatggttcatactatatagttcccaacacaatcacaatccgatggacttcgaaccgttacacattataaaaactcaaatgatttattagaaacctttaaggttatatctgtgacggtcattatagcagtgaagcataagttaagtaattatatatgtatctgcgctatgcaagttgagccaactgctcatcagtcttgttttcattgttcgacttacgaaacttcttgttttcattgttcgacttacgaaactttcttcggtggtttgagctcatgatcacgcttaatctctaacgcacaaaaataaaaggtatacctataaaaaggtatgaaaaaattgggccaggtacgaaaagtggttggttaaaatggtaattagataccgtggttaattttgcggaagacaaaagcgtatcttcctcctatgatcccatccagcctgcaatgcgaagtcccgatagagtgtgttggaggcatttctatgttcatacggtggttaattaaatgcttagcgattaactacggattcctcaaactaagcgcatcaatttctcaagtggttgtagtgacctgagtaacatcctaaagtcctgagttacagtgacctgagcagcctagtggttgcagtgacctgagtagcatcccaggatcctaagttcaaatcttcataggagcgaagttcccaatttaaaaaatattgcatatatccagttggatatagaagccgggcttctctagaaaaaagagagataaaagcacataaaaaacaacagtaaaattgcaacaagtttgtactatcaatatgaatttttgatattggtgttgcagcagaattttttttttgaaaatacactgttcatcttttctctcagaaatataagagaagagaaaaattattcttcactggccagaaatcatgggaaatggcagcccacttcacctttgctccgtaacaccggatctgatctttttttgaaccaacgagcccccattgttatgaaatatttgggtgatctcatcaatctatatggatagagcatcgataaattctgggacacgacggttggtcgtgccccacacctcttctcgcctcacggcgattctaacaacggacgcgctggttccaaaccatcgcgtcttctgttgccgcctctctcccgaatatatattgtaaccattgttatcaataaaggatcgctcattcattctctacattcttgtgtgcaattctctctctcactcaatctctctcgctcaatcaattctattcacaacacgttatcatcactttcgctctcgcgaaggagatcgcgaagtgaaaggaagaaacatcgcttttgatctaatagaaaagcgaacagaagaatcaacaaagaaggtacgatgcctacctttcattggatcatggatgccgttttcggcctccctcgccatcagcgcgcacgccggcttcaccttcttcttcgtcgatcgatgaggaggacgcgccggggatcccgcggaggcagggctagggttggtggccgccgccactaccctcgtcgtgtgcctgcaactccggttgtggccccccccccatccctgtcgcacctcctccgcctccggttgccgaagcacctcgctggatccttgtgcaaggggtacagtattgtgcctaccatggatggacggcggtgatgacaatgcccggcgagccgtgtgaactcccactggagatggagtcgctgttggccccgttcgtcgccactccatcaccaccaaccgctccttccccacctccatcaacatcgcaaccgacgcctagctttcgacgctcccccactcccgcggcaccaggattcggccgcaccggaaccatggcggtgcgcacgtgggagccgcctctctttacaccgtctccaacacatcgccacgctggagccgccgctgcacgccgtcccggcctccgtcatacgttcatcgctgttccccacggctcccggagccgcacgataccaaacggcgtgggggggaacggtattcggatccggccggtctccgactccgataaggagtcgggatcgtcggcatgccgccggccaatgagggggacgcggcggtggcggatggtggatggcagcggtggaggtggtggtggatgggagatggcggtggaggcgagtggcagcggcggaaaaggtggaggtggcggctgcatcggcggtgcccccacggcggcgcccccatggcggcgtcggcggcttcgccacggcggtgtccgcggcggcgaactggcggcggtcggcggcgaaccggcggcgaactggcggcggacgacggcggcagacaaggtggaggaggcggcgccgactcggcggcatcatggcgggggcggcggcacaaactgcaggggcggttagggttaaccctaacccccacgccccttcagcgcccccttttcccctcgggcccaatgggccggttgcactgtagcgggggtgggctgaatcctattgatttcggcccaccacccatttaccccttaaatttagtttttattttttattttcagcagcaatttcactttagtccctatattttatgtaatttagtcgaaacagttcatcagttgtacaaacaattatgtaatggtcctatagaccactgatgttatgtgtttattaacataggtgtttatttaaataccttgtttcactaaatttatttgttgtcttaataacatgccttttgcatattatttcaagacacgctctactttctctataaattttgtattttgatttagcaaattctcttaattatgtccaacataattaatggaggatttaatgcatgttccacttcacactttaacttggaaattaatcacatgtcgatggagtcctatactttggtcatatcgaccataacttaggcagcgagtatctcgcccatcataaagtggtctatattttgagatgattacccgatggagccctagaaattggccgcactggtcataacttaggcagcgagcacctcgcccatctcacagaggtctacatctcacgatgattacccacatgtgttcttttccaagaatatgttttgagaaatgagattatttgaaatttggttgaacacaaggtagtggagttctaaacattggctacggtatattcaccataatatatttgcctggagaccgtattttaggcagcaagtataccttgcccactattaagagatctactccactgtttaattacttgaagattatccacattgtgccacctaatttcgaattctaactaaaaattgtcaggtccataacctacatctttcgaaacattacagaatatgaagttttacatttcgcattgagattacaaccttaatatcatgtttttattaatttacctctgtaaattgataatgttaaccatgattgtagggacatggaaacaaaagagttcgacgaactcgccctcgatgggactaactatcccatatgggtttctgatatcaaaatcaattttgcctctcgggggattctaaagacaattgaggaacccaatgatggggatccggcaattgagcccaggaagctcaatacagccctttttcttttgagactctacattcacaaggatctcaaacatgaatacatgttagagacgagccctctcaacatttggaaagctctaaaagagcgttatgataagcaaaaggaactcatttggcctgaggctaattatgagtgggttcatttacgcctacatgactttaaaactgtggcagaatacaaccatgctgttcataacatttgttccaggttgaagttttgcgaacaagagccaacggaggcagaaaagatagaaaaaactctatccaactatgcttccggaggacaggatactgactcaacagtatcgcgctaacaatttctggaaacattctctgcttatacatacattgactcaggcagaaagacaccatgagctttctttaaagaatgcccaacagcgcccaccgggctctgctccactacctgaggtgcacttcaatgtacagaataatgctgagaataagaaaggattcaagggaaattcttcgaataatcataagaatctgactggaaagcgcaaacgcaacaacaacaggcgcaaattcaagggtcgaaagaaaggaaaagggaagggtaaggcaccacaacctcgtagcaatggcaacaagcattgcaacaggtgtggatctgacactcatgtcgctaaagactgccgcatcccgaaacatcttatcctcttgtaccaaaaatccctcaaggacaaaaaatcttctgagaacccaagatttgaagcacacttcaatattacacatgaagagcaccctgaggttgcaagttctcaccaggctcctgctgaaccagagagcaacctcaatgttctcccagaagatgtcgctccactctctacgatggatgatatgttcatcgaatactgctcaacggacccacttggagatttgcaatgatctcgatgcgtcccacttggagatgaagctgcccttatctcagtgtgcttgaaacagtatattgatatcctataagtttgccaaataatattggttgtaataagtaaataagtacgaactcccttgtattgtaaggttgtatggcttgttagtcattagagtatgtactattaacatatgtaaacgtcatactatgtatttgatgttttaattattgtatctatgtatatatattggataaagaattcttaatcatgcaattcttctttcattatagatgtctaaggatatcgctccgattggagaggaattatgtcttgtggacagtggtaccataaactctatacttagggagatcaaatactttcaaactctcaaaaagagagaaggcaaagtttgactatcgctgggcgcgatactgtgatagttggctcagaaagagcaattattacactcctaatgggtacacaaattacaatcgaggatgctttattgtatcctgattcaacccgtaccctactaagttatagagatatccgtcaaaatgggtttcacattgaaacccatatggataatcgagaagaatttcttctcttaaccaaacaaaacggatatggcaaacgcatttgcgagaaaattccatctctcacatcgggttgtactatacatacattaagcccattgcacatgttgcgtacaaagtaatttttcaaaatgttgatgcattccacacttggcatgatcgacttgggcaccccggtatcgggatgatgagaaaaattattggcaactctattggtcatcatttgatcactgacaaatttctcaaatcctctgatttcgtatgcactgcatgtgctactgggaaactgattttgtgaccatcttatctcaaaatcagagccgaaccacttaaattccttgaacgcattcaaggagatatctgtggccctattgtgccaagatatggaccgttcaggtactttatggttttgattgacgcatctactagatggtctcatgtgtgtcttctatcgacacgaaaccatgccttttccaaattgatgtcacaaattataaggctgaaggcaaattaccctgaacataggattcaatcaatccgtatggacaaagctgccgaatttacatctcatgctttcgatgattattgtatggcattgggaattcaggttcagcactctgttccatatgtccacacacaaaatggtttggctgaatcattgatcaaaagaattaagcttattgctcgaccattattaatgaattgcaaattaccttcgttgtgctagggtcatgcagttctgcacgctgctgaccttgtccaactacgaccaactgcatatcatgaaacttccccaatgcagctagtacgtggaaatcctccaagtatttcccatttgcgtaagttcgaatgtgttgtatacataccgatctcaccaccacagcgtaccgctatgggcccacacaggaaagtggggatctatgtgggattcaaatctccgtcgatcataaagtatttagaacccttaacaggtgatctatttaccgcccggttcgctgactctatctttgatgaggaacatttcccggcattagggggagaattcaagtaccaaaaagaatgccaggaaattgattgggatgcccagggtattccagcctcagacccacgtactactgaaactgaacttcaagttcagaaaattatacatttgcaaagacttgcaaataacatgctagatgcatttaccaattataaaggtgtgactaaatctttcattcccgctcagaatgcgccagaaagagtggaggtaccaaataaaagcactcaacttccactcactaaaaagagaggaagaagtatggccactcagcgagaaacaattgctaataagcaaagaaagacggtaaatgcaaaccaacctttagttggtacacaccaaattgatactatatgtcaagcagatcgtgatagtctacaacctagctcggtggtgcacaatgctgagactaggaattcggaagaccatagacacattgtttcgggagatcacaatgagtctataagggttgatgaaattgccatcaattactctgaaactggagaatcttttgatagaagagctataattgtcgacactaatttttctgaacaaattgctgagtgcctccaagttgatccagaacctaggtatataaaagagtgccaaaagcgctctgactggaacaaatggaaggacgcaattgacgcagaattagcctcgctttacaaaagagatgtattctcggctgtaatgcctactcctcgtggtatctttcctgtgggatacaaatgggttttcgtccggaaacggaacgaaaacaacgaggtggtgagatataaagcaaggcctgtagcacaaggttttacgcaaaaacctggcgttgatttcaacgaaacttactctccagttatgagtggtataactttctgatatttaatatcattggcagtacaaaatcgtctatttatgcagttgatggacgtagtgacagcatatctttatgggtcacttgattctgatatttacatgaaggttcctggcggaatcgacatcccgaatcagaaggtaaattgtaacatgtattgtgttaagttgcagaagtcactttatggcttaaaacaatcgagcaggatgtggtacaaccgattaagtgaattcctttcactaaagggatatactaaaaatgatgattgcccgtgcgtctttatcaaaaagtcccccacaggattttgtattatctcggtatatgtcgatgatctcaacattattggcaatacacaagatattaatgaagcacatcatcatttaaagacggaatttgaaatgaaggatttgagtcaaaccaaattttgcttaggtctacaacttgagcatttaccttttggaatccttgtgcaccaaagtgcatatacccagaaaattttggagaaatttaatatggacaagtcatatccttccaaaacccctatggtggttcgatctctagacgtggagaaagatccatttagaccaaaggaagatggagaggatgtacttggtcctgattttccatatcttagtgctattggcgcacttatgtaccttgcaaatagtacgaggccagatattgctttctcggtaaatctattagcaagatacagcgctgctcctaccaaacgccattggactggagttaagaatgtcattcgatatcttaatggcacaagagatcttggacttttctttaaaaagaaccaggattcgactttaattgggtatactgatgctggctatctatctgatccccacaacgccagatcacaaacaggattcgtatttttacagggtggaactgctatttcatggaagtcttctaaacagactctggtagccacttccacaaattattctgaaataattgcattatatgaggcgtcacgtgaatgtgtatggcttcgcagaatggttaaccacgtattaacatcttgtggtattggttcattggaatcacctaccattatctatgaagataataccgcttgtgttgttcagatggaaactggttatattaagagcaacatcactaagcatattgctcataaattattttatcctcatgagcttcagcaacatggagagataaacatcttgcaaactaagtcatgtgataatcttgctgatttattcacaaaatctctaccatactccacattctttaaatgtgtcgaaggaattggtatgagacgacttaaaaatttgcaggattcagggggagtatcttcctctggaaaataacctattttcgtcatattatactctttttcctttgtatgagttttaccctttaggttttctcatccaaagtttttaacgaggtaatatcaatataagcttatatgtcttatcatttggcttttccccactgggtttttactaaatgataactatagacattatactattttggatcaaactatgagctttactcatagatctaaaatagtccataatatatatcacggttctctccttatttttcccactgggttttcgagtagttttacgtgatgtatttaactataattatttctaagattatctttacagatatctggaacactaaatgagtaatgatcaaagctggattcgatcaagggagagtgttctgaaatatttgggtgatctcatccatctatatagatagagcagcaataaattctgggacacgatggttggtcgtgccccacacctcttctcgcctcacggcgattctaacaacggacgcgatggttcccaaattatcgcgtcttctgttgccgcctctctcccccctatatattgtaaccattgttatcaataaatgatcgctcattcattctctatattcttatgtgcaattctctctcactcaatctctctcgctcaatcaattctattcacaacacccatgacccgtgcctgcgtgagggagttgaggccttgagggtgcctccccgctgctcctcgcccgcaaactcgctgcgttcattctttcactagagttagacagacatgttgggccagccgagggatggtgattgaggaattactaaactacacgtgctaatattagtttctattcctaattaactgtttagaagttaatgatggatactacaccgtaaaagatctggagacttacagccaagccactttgttctagaataccggtctcgatctattatttttgcaactgtggctaacgttgacttcacttcatcaaatccaatgtcgtttcgacttcgctgtgggcgttgtttgctctccttcttgcttgatcattcagtataaatatgttacccgtacgtgctgaaactactgcccttgaagttcctcgatcggaaagcagattctttcaaaacactgatgaagtgtaattaatctctatctttgttctcctgttcttttctttttgcccatttctgttttctaattaatgtatgcgtttttgttgagatgatcaatttcacactagtcttgagagtgtttttccttcaggcagacttgccttgagagttgacaatgtaatccaatcttttgtagggatttctccaagttaaatatgagttatttctttgatggaaaacatatgttggcttcatgatactgcgttagtgttacattgatcatcgcgattttgacacggtaagcaggctcaatccttggtacaattcatccgtcactagtaaaaagtaatttttccatacgagtcaaaagtgattttcacgtgccgggtctacgaaaatcgctatttttccatacgggtgacccacacgccacgaaaatcccattttttccgtacaggtgcttctgtcgtccacacgcaaaaataaaaaatctgaaaagaaaatcgcaaaatgctagctggtcgggctctcctgctactggtcagggcaggggacggccgcagccagatccgcgcggatctaggccatggagggccccccgctgccgccgtctggtccgggagagagagagtagagagttctgtccgggagagaggagtttgagatagagcgaggagtatgaggagacaggagaggagataaggatgatttaaaaaaaaaatgaagtgctgagaaggaagaggaggtaaatcagacttatggacagatccttaagaagctcgtctacgaaaatatttttttccgtgtgacctcttaagtggctcgtctggaaaatcatcctaattttgcaacgacaccttaagagggccatatacgaaaataaaattttacagacgcgaacacttatgatctatctacaatctattgaagtgtttgtacaggaaaattatttgtgtagtagtgggtctcatacacccactgtcatttattctggtttgcacccccattatatccttaggaatgccttaaaatgcttctcagctaccaaaactgtaggctcataaaaattaattaattaaatactacctccttaatttctcaatagttgctatctatggcttttataacaatatttgagcatttatgttattaaaaagttagtgcaaatatgataaagtacatgccatacttaaggggtctttaatgaaaaaggtcacgacaaaagaaataatacttatataatttttaaataggacgaatcatcaaatatcgggcttatttgttttgataccaatttactaccctactaaaattttggcaacttcaatagtagcaagtagatgtttgttttactaccaaattttacccaccatagatcaaattgaatactacccaatttggtagtgccaaaatttaccaatgttttggtactacctagattttggtagggcaaaaattggctccaaaccaaataagcccatcatatcaaaagtcaatgacattatatataaaaaaaataaatggagtgaagaaaaatatacagctacatctcccacaaacttaagtggtaaaaagaaagttcgaatctcgtgtctcctatcagctcaaacttatagtcatgatgagactttaagctcttaagctgcttgattagatcgtttcgtatctttatatgcatatttagtgctttttagctattgttaatttagtcatttagctagttatttccaaactatctattttgtgatttctttatattagctagtgtttattattgtgttaatatatgataaagtggtcaatttcagattataaagatgatataaatgtgttaatgaatctaacaaccttcacgagctagctcacgagatgaaccgagttaattacctttggcttgttaaaacaatccgatcgaaccaagcctaattaagtcgaaccttaacgatcagggctgactcgttatccaccacgctaatcatctttttaagatggtttgtgtcagaagtagtagtcaggaccgaggattcgaaagatgatcctctctagttgtactctttcttttcgaatcttcactagtgaaatgagacaagaatgtgccacatcatcttagaaatatagccgttggattagctaaggaaaaaacgtgaaatcaattttaacggttcgatcgaacttaaatactagaggtaaaaagcagagggttctagacccttcaagcaggggatgcacgaatgagaaaggaaataaagtgtggaaaagaatgatgaggtgtcattagcaagagaaggtgacgtgtatactgatagagttaaaagtagtaattcatgtgcccattcaaatattcaatcacattatcacactgttcacgcattctcataacaacaatttattctaccctgacacacctaacctctctttgtcacagtggaaaatttctcagagagatcacacaaacagagtggagtggcgtggatgttttgtttcttataagctgatacattttggaggtttataaaccacaaaatgccaaccaattgtatttgaaaaatatattgtgaaggaatatatttttacgcacagctaaattctataactttgggttttacgctaaatttcagaaatttatcataatgataaccaattatttattgttatgataatatttagttgttaatgataatacttagttattaacgaaagggcatctagcctagtggttacagtgaccgaagtagtacccaaggtcctgagttcaaatctcctatggagcgaatttcagattgggttgtttgggtctaagtttcatatttcaatggccgtatatatccggttggatatagaggccgggtaaaaaaatacccttctcaaaaaaaatatttgcgttggaactagatttcatctatgaacacctattctattacataatacatatatgtacgaagtagagaataagcaaaatatgagaggagtacaagactcgtgcaccagcggagatgacaagaagacggcaactcaagcaacaacgaataaggcggaacggaacacatggaaaggggaaatggtaatacagaagatgaatagaaatcctaaccctaagcactgcactcaccattttgttcaacaaatcatgaattgggcatttcagattacaagtctatttacaatattcaatacagagagacaattgttgtggtaattattgtatggaagctatttgatgttattaattgcaaatcatgataaaaaaatgttaattttcaagcaacacgtactttctgtcaagtatgttacgcttgcattgtatgatggtagtacaaatttaagcttattattataattaacatgtagacacatctaatggagagaaggttagagttgcacaaatatacgacttaataaaatgctagtactatgtggaagacgcacacgcaccacctcacacacataacacgtaccgacgtacgtatgcatcaactaatgtgcccatttaacacacgtaagaattataaatctgttgacacactaaactcctaattatgctaacgatgattcactctagctttttactttatgaaaacaagtgcaattgcctgtacaatattcagaatataatttccacttcccattaatcgaccaaattttgattaccactatctgcacgtgtccttcgaggtatttagtacatgatattaatattttaatattgctacaacaatatactccactcaagtgtcttaattgaaattaaatcatacattcaaatatacgcagacctttcaactaattctcaaagcttttttccaaagaacaaatttcaaatacccaacaagtataaaatgttataggtctgcccccaaaacccactcttctcagtctcctcaaataatccatgaaaaatatagaaatatggagtaaatttcagtctcctcagccccgctaatttttttttttttgctatatgtaaataggaagggtggttgtagctttatatagtttattcagacccctattatcccctcctacatctgccactgattaaaccctcccagttcctcggtggcagcggtagctagctttgagcaaagctgggatccaaacaggaggaggtccaggattcgcatgatacgatgcggtcgacaccttcctcttccgccgatgcacccagcggcaaaatgttgtggccgacttggtcgctgtcgaagtgtcgataccgtacccgcccgccacctctgcgcctacttgcctccagcagcgctgttccgcggcgcagtcccgacgatggtcggccgcgcgtgcgcctcccctgcgtcccgttgtccccgtcgcgcctcccctttgtgtccgcccgtagtcctggcgacggtccgcggcgcacgcgcctccccttcgtgccgccccacggtcgccgccgcctgatacttcatccctacgtcgcgtcgtcgccgtgcctccccgtcacctgttcgtgtcaccgccgctttgttcgtgccgccgccgccgccaaatcctctagggttttgggatgcggagcctgattcacacagctacttgagtgatttatttactcacgagaggtataacagtcattcacaaattacaaaatcattttttattttctcccccatttgttttactcgaaaattctggccacactctagagatttgataatttaacagtttttaaaattggtttcgattatttgacatcctggcctacttttaatcgttcaaatggtaccacatgttatcctcacaagtgctaactaaaacaattgggaaataaaaaaagtgttaaattatcaaatttttcgtcatgatcaaggtcaaacagctacttcattttgaaaaaaaggtaaaaacacaatccctaaaaaggtaaaagtacaattgaatcggaaagcaagggcaagaacacaattaccccaaacattttatagacacattaaaaattgcctagaaaatgtgtactctagagacattgtagagatattttcaacacattttatagaggcattttttttacactttaaaatgcgcctaataagtgttggtatttcttaacgacattactagaaatataattcccaacaatggcgcagaaatactcctggtatagtatggttacagagttcatccgcaagcgcacagatataccattgtagcatttcacccgagaatattccaagggtatcgtatttattttatcacgtgggaaaatcatgtagagagaacttgactaacaatttatatattacttgttataatcatattctaagcaagggttaagataatttaaaggtagagtgacacacaagcattaactactcattctcataatatattatctaagctaagtggttagaaaagagaaagataatctattcctatacttctaatatacatagtatacatacattctagttaactgatatactagctaatactttcgatccaatgccctcctggtacttcgagaagccacccctgactgccgagttccttacgacagcctgtcatgaccatacaaccggagctaaatacggagaaataccctccccagggaattaacttaggattatataccagcgcagaggaatacccgtactgaactgtcaccatcagcggcccacctctcatccgcaatatataaccctaaataatgatatcccgtaatctagacaccacgtctaaactaccagatactactctaatatcatcatcataacatagagtaattgcataagcaaacattgtacccgcaccaaagcatctcccagataagctagccgtatattcagcataacatgaacataatgtaaagtaggtactcatatactcggaaagtatttcaataccataaatgtatttagaagagtattctaataaaagtacaaagcttacaaaagagaagagaaaagctactagagccatacccaaactcttccgaagacttccggactcctgattcctattctaattctatttaccagctagatactactatactaaacttgagagaaatgagagagctattgcttaaggtgtgtgagtgaagtgagaaggggagctccttttatagctgaactatgacggttgtgacggttggaatggtcggtaataccctccaaccgtcattggggcttcatctcaaccgtccagccaaaacctggatccaacggaggcgagggaggttcggtcgaactaggggccggcccaaccagcccacctttcggctggcggccacctctgttgctcctttttgtagacttatgaattttggcccagtttgacgtgttaattctgagttcttggcccattcatgcataagtctgattctcgacatcgtcagactgatttatcttccatgttgatgtcgattctcctccactttagtgtcattctctgcaaaaggttagtatacctaatactagtggaatattattattctaacatatttatgcattgcaagcatcactagttctcttctattttggtaatattgacgatcgaaactgatcgataacgaccgtcaacaatatgtaaaggcattttaatcaaatatttaaaactctgtagagatatttctgaggctctgttcttttcttcaacaccaaacatcaacttccttgtttttcattagcacgcttttcaaactgttaaataatacattttttgcaaaataatttggtaagtttgttaaacaatactcaaggcacaaatatacaattaatgacacgggttaagttggttagtttattgaagacaaaaatgatttgtccaagagatcctgagttcaaggattggtaatagtgagagaaaatattttattctctttttttacaatggtttcatattaccatcttatagatattttataaaaattttaaaacttcaatctactattataaaaattgaagatgttttcaccggaatttcggcacgtcatcgtgtttgaatcgtttttatttttatgttttgtttttaattttatgtttctgtcaaaacctttttcttttttcttacgccaaagtgtccctcttatctgagacgtgcgtgaattatttgggcttgcacgtttccatgtgccccttgccacatgcagcgatcaggccagcgattaagcccatttttcatacgcgcctttgcgcgcttccacgattgggcccacaacgtccttgcgcacaatttttcgcatgtctgattggtcccgagacgcccttgtgcacgcgattttgacatagatccagtccttctaaaatgtcacgaccggaaataacccaacgggcgttccttacgtgcgtgtattattccttgtcccaggaggcaaggtacaccaaaagttgatacaattcagagtttaacaagcggaagcgtaaatagttaattattacatgggcggcgaaggcccagctcacacaaagacaaacgggaaacagcggaagactagggcgacgaccacaggcgtttgacggcaagcacgagctaaacaccaaagccttcatcatccaggggctcctcttctgggtttgggaaaaattaagcaagactgagtacaaccaccgtactcaacaagacacacccacaagtgcaacataaatgcgagggagtacaatggagttatagtataggggttaggttttgcagtaaacagcatttaaaagacacttagttgctcgaagctaaatttaaaacacgatcctagaactatttaatattattaaacaaggctgtgaacccacacgaacctgccttaacccaaggcctacgatgattcagaccgaactggcaacccgaccctgggtcccagctcgtcccaagccaacccaggccaaccattccacattttagttgttaagcaggttttaagaattgaaaacactaacttgggtacattgctaggcttgcccataaccgagggcgcggctattcgaataggttttactttgatcagaggtgtacatctttacccacaagacacgtcttcctcacgtgcaaccacgtgccacataccaccatggcatatggacggaagacatgacatagtttccaacccatcctagccatagacaagagtaccgacccaaccccacctacggccggaacctccgggacaggtaggcaggactgagcccctagcagcaggacaccaggcctgtgccatgacttcttgactaccgggccgcagctcgtgtagcattcatttgtcctagagatgtccatcgacccccgacttcgtccctctccatccgtgtacttttgtttataaccatactgagccacaaactaagccttacccactagacatgtggaagtacgggagtgctttgcaacagaggcccgaagaccggtccttacgtggccgaggtgctactatcaaaaccatgcaccccgagcccagcctaaaaccattttgagggttttgaatagagggggaggtgtgcatccaatttcgcaataatccaaccattccataatgttcaagtgatatgaatattcccaaagtctagagttataaaaccacctaatgttgcctaattaatcagcgaagcatctacctaaattcatactagtggcaccatgaatagagtacccactagttggggttttgtttattctagggtgaacaaggtaataataacaatagcaataataataaggtcataacaaaggtaaacaggcatggctaaataaaacagtgataacgcgggaatttaaataaagcgataatgcattaatttaaatcaaaataatttcacaaactgggatccaatatgttcaaagatgatgtgacttgccttgctcgctttcccaaacgtcggcttcaacctccacgaagagcggatcttccgaagctgcagcgtctacacgagcaacggaaaagaaaagggcttttactctaataaactccatataacaagcaggaacaaagcacaaaaatgggttcttgacttcttaaggaaaaattagagacttgaacggtccaattccgagttcaaatagccaagttatggccatttgaagtttatatgctctttaaatgaatatttacgaatttcttcatttaaattttaatttaaaagggatttattgtgtcagccgggagagaggggcgcgcggaccaagtccacgggggtgggaaccacgcggcagcctcacggtccacggtggaccgggtgcacccgggctcactccggccggcgccgtgggccccacgcgtcagccgcagccgagggcgcgggcggctgacggctgggccccacgcggcaaccgcgcggcgcgcccgaaggtggccacgtcgacgcggccggcgggaggcggcgcccgcgccccgatggtcgccgccggcgaccactggcgcggcggagcggcggccgagagaggggagggaagggggaaaggaggcgacggtccacggctcaccccggggcgacggcggcggcggaggaggcggccggagcgaagggaggcggtggcgcggctcgggtcgacggggtcggtggtgctccggtggtcggcgagcgaaacggaggggtggacgaggtcggcaaggatgcggcgaagcttaagaaggcggcgccgaggtgggaggcggtccggggcgacgacggtggcggaccggagctcggcggcgacggcggagagagagagcgacggcgcgagctcgaatccggcgaggaggaagggcggcgagaggcggaaacggacgggagaagcgcggggagggtttaaatagggcaggggagagagagggcggccgagagaggaaggaaaccggcgcggcgttctcgggctccatcaatggcgccggtgggattaggggaggggtttccaaacgaatccaagggagagagggagggaaaattggggggaaagggagaggggatcacggggagtgattccccccacttaaatgcacgcggggacggcgggatgcggcggattcgacggcggcggcggcgcttggcgcaggcggagcggcgggagcggcgggaggtcggggatgacgggtgggccccacccgtcagtgagggtggcgggcgggcccgcccgtcagcggcgcgcgcgctcggagaggccgagtgggccgcggggaggaggagggagaggggaagggagatgggccgagccggcccaagagggggaggggggggattttaaggtttttcttttataaaatcattttaactttgtttatttcttaataattattatttgtgctctgaaaattccactaaaatttatttacacattttaggcttttaggaaatatacaaaaatcctccaagccttatttgacttttaactttgcacattttaatttttgaaggatttcataagtattttaattattctaggcataatttagaggatctattttagggtcgatttgggacgcgacataaaatcgatggtgggattgtagaatgccacatggcgggcctaggaatgcttgttgaagcgctacgtgacaactttggagcgtttataggaagtttagtggacttttggtatataatacatagatttgatatatgtcacccagaatatcatagctaaaaatatatatgccaccccaaacctgatttctttcatttaattacactgtccagttaaatttaacgttgggagagctacaaaaaatatttttgacctaatgtccatactagtggccccatgaatagagtacccactagttggggttttgtttattctagggtgaacaaggtaataataccaatagcaataataataaggtcataacaaaggtaatcctcnncatggcggccggcaatcgaagtcaatgccgt

SEQ ID NO: 331 - DNA, 3211 bp, Oryza sativa
  unsure (1)..(3211): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaaccctaatgaatgtgcaatatatgtaaaccagattgtcacaccaaggttgcaagatctataaaagctataatgtcgtctaccacatgtggcttccgctcaaacgacttgatagagcgcataaacaaagatgtactgacgacgaatgcgctcttcgtcgccaatgcattcttggtggtgatccttgtgggagctggctcttatggccgtcgttaccggcatattgctttgaaccgctatctttttctgggagcatccactctagtcctaccaatcctctcctatgttgtctcctacgtcggcagagacaagtactacaacttgtttcacggtttggaatgcgttgacaaccgcgcattctgtctgctactatgggcagcgctgctgccaatggttgggatgaatacaagttcaatattgactgccgttcataatggaaatgaaggtgggaattttgaatcaatagcgatgcttgctcgacagatttggaccttcttccttgtgttgtactactacacaaaaaaaaaccgaagaattgccagatatcatcatatcaacattactgggccttggtttcatcaagattattctaaaatttgttgcatacgggagggcacggcgctccttcgctatgggacaaaatcctagtcttattgctggatatatggaagaattgtacagactacaggtatcagaagttgcagaggtgacaatacaaaggcttttagcactcgtggtaatgggagaagacaaacaacagattgagaaaggacctcatggttatcacttcaaacgtagcacttttagccagaacgggacaagtgcgatgacaagcaatggtaacttggtaaccattgacaaagtttggcatttggcagaaatgaatgatgctcttttggggccaagaccagcactgaaacatctctgcatgtcattctcattgtttaagcttctgcgaaggcgatttgctaggtacccactggttgaggcaggttctgagaaggcctttcactttgttcgtggtatattgctcacggatggggcagacgcagatcctgaagctgtgttcagggttatcacagatgagctatcatttgcttgggatttctattactcgtcccacccgatctcccatttgggtaagtggttgcccattatgagcatcatgacctcactctttaccatggcattttgcatcttcatcgtgattacactggcttggaaaattcttccagagtataaggactacagggtaatgtcctgcgaattaacatgcggtgaacaagataatgatagatttcatgatattggaagcatcttgttcgtgttggtgccaacgatctcccttcttctggtagttttgcttggtgaggtatgggagatcatatcttacgtttgctctaactggaccaaagttaccctggtttgcgcctacacagcaaagccatcatggcaaaagtctcgaatcatgagacgattgattgcttgttttctgtggtgcagatgcaagctcatgaattactggggtgacaaaatgggcatgacctctctattagatccttgcaagaggaaaggtcatattaggcacctattcaggctgtctaaagcaatgaagcctaccaagataccaaagccggtgaaggctgctctcatcaactcacttaaaggtagcaatgggcagctgagcaatggcatagcatctttgcagaagtgccatctgcgtgacgatattcgttgggcttgcaatggtgaagggacatctgacattattcttgtttggcacattgcaacttgcatctttgagatcaggcacatgcatgatccttcagaacgtcatagctctcctgatgagaatgatgatatgatcactgccattcacttgtcaaagtactgtgcatatttgctagcatcgtgcccagagctactgccagatgacactccatggtcaaaagaattgtataaatctgccaagaagatcaccgactctgttttgggcagcactgatatgaggtgtttcgaatttgaccgcatgatgcaattactgagtgaaaaatcaaagagcaatgaggtggtgtgcaaaggtgtacaactcggcaagcagctggttgatggaattcagaatgaaaacaaggggtggaatatgcttgctgagttttggtcagagatgatgctatatgttgctccttccgacaatacaaaggcacatgcaaaggccattgccaggggaggcgagctgataacaatcctctgggcacttctcactcatgctgggatcatcaggaggccagaacatgacaatgttgtttaagggagcaatatgttttttttatgcactgtttgtctactttaagtatgctgtagtactatttataagtcaaccatgcttgtaagaactaggaaatattactgctgtttatcgttcgtgctaaaaatttccacatttgtaggcgtatattggtgaaaccaagtccattttgagataaatatattgtgaacttttaaagcttgtatggtgctgaagttatattagtgagtcaatatatgttgtaattatacaccggaagtatcaagtgccaaccccggtctagtgcaaatattcaacgtccttaatgtatcaattgaaagatggtgccagatcgaacaccttaaccccaccggacattactttttacttgtaaattataacccacttactgcaattaagacctaaaatccaacttcatttttacgttatcgtcaattctcagccgtggatcatagattgaatgctttgaccgttgatgaaaaacatacatatggtaaattaacacaaccaacccaatacaccacagccccattagaccctgtttttttccccatgagggccatttatgatgggggccaattaccggagggtttttttaacaagtaactttttccccaatgtaccaaacccaattgggcttaacccaaaccgaatggacggccctatttcaaaaattttaattgcccaccattgtaaca

SEQ ID NO: 332 - DNA, 33718 bp, Oryza sativa
  unsure (1)..(33718): unsure at all n locations
gcgtgtttgatggacttcctgcgtcggatggattgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatttgttactggcgtgtacataaggatgatgcactctaccatgagcaagtttcttggcttggagacttacatcaccgctgcttccctagtgatggcagattatgcagtcctacttctgatcaacactagatatatcggagtattcatcattccagtgatcctgcttgtcttcatcgcagcactctgcaccaaattgtgggacaagtctagtccttacattcagcaggattacagaatcagcagagtttccttactacatgtccccaacactgagtggcttctgaagttggcaacgctgccgtgctggttgcagcttttgtccagcacaatactgaatccagataatgaacagcaagacgataccattgtgttctcgcagttcctcctgttcttcagctccgcactcggtgcgcttgcagtgatggttgccaaattacccgcaggtgtcagccccggtgcagctcaggttcttccagtcctgcaaaagacctgcattgttctgctgctgataacagttcacacgatggctgcagaatggattggggaagatgtcatagtagcctgcattccaggactcgttgcagtgctcgtgtggttcaccgtacatttcgaccatgacgcgaggaatgcaactgcagttagcatcgacaatgtgttgtcttacagatcgcaagccgtcaccattctcagctctaccgtagggcttctcgcatacctgactggctcatatgctgcgtacgagagggaacttgtgaaatcccggtgcaggtggagcttgtgcatggttagctcctcctctgctctttcacacgtcaacttgtggatgcttcagcactggccggaaagaacatttcacttggaagagctgctaaagctgttcaggttttgcaggaaaatttgcttgagcgcaacacttgtgctggctttgatgtcgatcggtggatgggttcgtaatctaatagccggttccatagctattgtttcagcgttggtggggtttgcgcttttcgtaaccatgggtcgtaagcctgagcctcgtaatgtttgtaggactaggaagaacgctgccagcaggtttgggcaggacgatcaaaatccatcctcgcaaagattttcgaaagaatctcggccgtccgggggtttttttgcacctgcctttgagtcttttggagactttattgacaggaaattgggaattgcaaattaagtcaactagttgccaacctggcctgtgcattgtattggctattattatgtaaatatttgaaaggaatattattcgtacgtattgttgaaaatatttcttaatttttatttttgcttcaaatgtattttacatgactgccaatcgaacaattggttttttaatgacacaaactatttaattatgttgagaatttaaaaactctatcagttatcattattaatgtaataaatcataaaaatgtagcactcggaacattgcatataatttacaatataatgactacttcagttccaaattgcaaaaaaatgttttccacatttgtatcattggtgtatgcaaatttctctctttcatggattaacatctcaatctaaaatttatagacaggtgatggcatgttgaatcctaatcggtctagtttcagatgatggacctgttcactttgatgccaaaaaaaacattaccaaattttggcatagttgccgaaattttggcaacttgccaaaattttggtaggatttcttatatagttaccaaaatttagcagcaaactaaatgtagccactttttttttgtaactttaccaaaatttgataaggttgaaaatggcatcaaagtgaacaggcctgatgtcatgttgagtcaagataatattttgctatatattatctatgtgagtaccaaaatatatgagtgttgcaacgggtttaagcaattctaattactagatgatgtcccgcgctttattgccagatatatgttagttattgaagaaatgatgaaatgatttgaattgaaatattataaaaatgatttgtacatgatgatttagcatatgtatgtttagttttagaatgaaataaattatagatataattactgtatgtttgcatgttgagctttatatgcttaatgggttgatgtgacatgcttgcatgtaggttttatgagtgctaataaatactattcttgcacgttgagtattgtgtgattaataggttgacgtggtatgcttgcatataagttttatgagtgctaataaatactgtacttgcatgttgagttttatatatttatagtgggcattaactttatagaaataagtgatatgtaatactttgtagtgcccatcaacagataaacagtcaaatacaatgatagatatatttataacttgcatatccaggggtgaacaaataatgttctaaattctttgaatgcaagtaattttgtgtacatcttacttaatactatgaaaaggaatattttaacctaggtaagaactaagaaccaaaatacataattaacccaataaacagaaaaggggctgcctatatactatcacaatgcatccaccttattgtctacctctccctcttctggcttagattgacgcgcttgagcagatttgtgcagccaccgtgccgtcgccatgctcctctcgtcttccctcgccaccactgcccccaccttgtaattactcttgttaccctcggccccacctccgaccatgcccacagctggatccatccctgtggcttaagcaccgcctcgccgcccaagaccattcatctaaggctgagagaaaaccccctcatgctggtaggttttatccattttgtaatggaaatgtacaatgtctctcccaaatataaattggctgcaaccactgtgtgcaaatatcccactgtaattgctgggaattccgaactttatgtgcaccgcacttctgaggttggtttagactcaggaactgtaatgcacgaaacttatgaattgttcaaagatggcaggcatcctaaacaagctactacctccatccaaaaaaattggacactctaccgccgggctgatgtcctgaaatttcgtttagatatttaatcagcgaaagtggggctcacatgtttctaatttttttgggtcgatagattcctcacataagagcatcaccaacagatacctataatttcctctagaaaagttgtttttcggtttcttaaattgaaaataggaagtagaaaaattgatctctataagagaacacctaaatttaattccaaaaactagaagtagacctttctgttaaactagaagacaccaccgccgctggatggcgtgggcatgcaaaatcaccgagcgtgaacattttgcctctcgtgcgggaaagggagtagaggcgcgggagcaacagattgggggtgggagaggcgagacgacgctcctcctcatattgaccgagcgagttttcgggataaggggattccaaaaattgggcacgagattaggggatctgttggagctgttttttttttgacgaaatccctcaaaattagttttgggaataaaataggggaactgttaaagatgctctaacaccgcaaaaaccttatcctcacgtgttatctcgcctactccatcgctcctcaccccgatcccaatccttctccacgcctctcctctccactaccagcattgacaatggcgaggcgggcacgcgttgagtcgccagttgtcgcggcgctcgttgattcgccggccgtagtggctgtggaggccatacgtgagaggcgtgcgccgattcaccggtggtgggcacgcgccgagtcgccggtcgtcatggctccggaggttgtgggcatgcgctgattcgcctgttgtcgcgtggcgggcacaattggcgtctgtagtggcagtggaggtcatggcacgactgaccagaagggccggacgaatgcgaagtgtggcggaagcagacctccactcagcgtaggcgagacgaggaaggcgaggaggacgcaggcggcatggtgatgggggctcagcgtcgaatcaaatcctggggacaatttggtcattttaccttgaagctaattttggctgtcaaccttaagacgccaattttttttggacggaggaagtagttatttcatttgatgaaaattgtacaaatgttgcaatatttattgaagtagttttctttttcatctgcaattatcttcgaactattctggtagttctgaacttctgatggccaaattttctaatcgtcattatagggggggcctaatgggtgatcgatcgccaggcgatcgcccaagcgatcagcccccctcccctatactccatacactcctccctcctctcccctctccctcctccctttcttctcttcctactacagtacaccacacaattttttttaaaaaaacaaaaagttagaaaaatttatgtataaaaatactatatataaaaaatttgaattcaaattaaaatttgaatcgggtatgtaaactttagacttataaactttaggtgtataaactttagatgtatagaaatactatatatagataatatttgaattcaaattcaaatttaaatttgaatcggctatgtaaacttttgacttataaacattaggtctataaactttagatgcataaaaatactatatataaaaaatatttgaattcaaatttaaatttgaatcagatataatttaaattcaaatttgaatcgggtatgtaaatttttgacttataaactttgggtctataaactttaggtgtgtaaactttagatgtatagaaatactatatataaaaaaattgaattcaaattcaaatttgaatcggatataaaaacttttgacttataaacttttggtctctaaactttagatgtgtaaacttaaggtgtataaactttagatgtgtaaacttaaggtgtatataaactttaggtgcataaatttactaaaataggaaagtaatgcggtgccaaaaaaggaaactaggtggagggagggaggggagggggattgatcgctaccccccgtcccaggcgatcaatcgccgattaggatttccgatcgttatacgctatagtatactatgaatcttaggttatttataagggcgtgactaaacagctaccggtcactggtttgtcttatccagctaccactccatccagtataaatcccccttcaacttaaaagatacaatagagtgtgtttttttaacctttttaataacttatatcttttaaatcacatattgtttttaagatctatttgcatcattgtactccactcaaaatatgtgacaaaacaagatccatattgaatatattcaaatattttattaattgaaaagtaaattattacatgttatgaagtaacttccatgttatcaggaagtaatttttacatcttatacatgattaattgtcattagttactccatcaatgttttttacaatccatcaaaggtttttgtcgatgggggatacccatagaccgaatatagagggtattggggtccgttggtacgaggatctacgtaatacgacatcaagcaaacagaagacaaggattatactatactggttcaggccccttggaaggtaatagcactaatccagttggtacgggattatatgatggaaaccatagggtacaaagggaataacagaactcgatgataccgacaagagcgtagtcaagttggtctgactagatctcccagcgacttggctcctacgcgctccggctctgtagagtgtggggggtgtgttggcagtaatattcgatgtcttaggtcctgcccagggggtcccttatataccgcgggtcagttgatctccaagtaggactcggagatataggacccctcacgatatggtaaagactcagtctcgtccgagtaggactcctcccatccgtatattttgtttctatcacgtgacagatttccttatcgtatacggaaactatccgtatacgcgtgggtatgccgtatcggtacccactgtacatccaaggatagagggtataccttatccgtaacccaaacagtagcccccgacttctgcttaaatgagctcatgttatcaatcgcgacttctgatgtcggaattgttgtcgttatcatctggtcgatcccggtgtgaaaaccgtagagacaaagagtcatcgacaacgccgcgcgaagttcaacggtcatgagcgaatttaaattgaagtctgaaaaaccaccgtccgcaacgtacccataattttctggcagcaatctctctcctttccttggaatacgcaccatcgggagtgcgcttatttaaaggaaatttgggaatccatttgaagtccgtttgccagaaagctctcctgccctctagcgctcttcgtcttctccgttccccgtaaagaaaaccctagctcatttccttcatccagttatccggcgatcctctggcagcgatggatcttgagaagtcaacttcgaccaccgcgtccatgaagaagctgtaggacgacggtgccctccccggtcgcgggaccatgcaaagggaggctggaggtacagaacctgaaaccatcttgggccgcatggatgtagtcgaagattatatttcttgcggttttcttcctccgccttccgagtttcttcttctcgccttgaacttctatggcctttctttgcttcacctaaaccccaactccatcgcctttctgagcatcttctctcatatttgcgaggcctacattggggtagtgcccttccttgatctcttccgcttttattatgagctgcgctggatggaatccaacagggtgtctgtatgcgtcggattccgacttcgggatgacctgaagtcgcgttacatccccttccagtgcccctcttctcgcagcaaatggcagacgagatggttctatctccagatagaaaactcagatcccgtcctcgtggtccctaaggaccagccagaaaaaaatcccagagtggcccgccaaacccgccctgactccgaagacggcggttgtcgggatatcattgatgatctccgaagacggcggttgtcgggatacgaagtcgctgccgacttcataggtcggcggattcaaccgctgtaggcccgtgcccatccggcctttgattactccgggccagaggacaagacccgggtctctcctcggggtatttttcttgcatttttaatattgttccgagtgcatctatttctcctgacttatcgagttcccgttctcgatttataggtctggacagtgacaccgtggggcgctgcgttggccaaataatgatcagcgcaccctcgggggcgggcgacatccccgtcccacttagcgacaaggactcggccgagcgcgccacgacgattaatgtgagtgtactcgataattcctttacattttctgctcgagatcgcgtcatgacttcacgttgtgcaggctctccttctgacggacgtcatcggacccctcgtggatcactaggcagcgacgtcactgaagaagcgcgtcaccaaggaggcatctgacgctgctgctaccaccacaagcggcagcaatgttcctaagaaaggaaggaagttctcctccgtgatcgggacccaccggaaggcaacgagcccggtggtaagcttctgtttcgcctttgagtgtgtaatcagggcgacttagcctcacatcatgttatcttactcaggactcgggcgcgtctccaccgcctcagcgaaggcagaggttggtgatgattggggagaagtaagtcaatgtctttgaggttttttcgttctcaaagtttcgattacctcgcctcatggggaagagaaaaaatcttggcagggcggcgtgggcaaaggcggcgcaaggcgggactgatgctgcttccaacgcgtcccctgcggcgacctcgacagaagtcgtggttgcttctaaggactaggagacggcaccgagtagccccgtcgtcggcctcgcgcctacccatcgtctatccgccgattccctcacctgggaggagctccaagcggagatgttgcgcatcctccgggctggcgttcgcggtgtaggccgcgagatcgaggaggccaaggcggcggcgttgtcggcaaacgaacgtgccgatcagctggcgcgcgatctggtggaggccgcgaggacctctaaaagatgagggagctggtggccggcaacaaaatgcagcggcgcgggcttgagcaccggatgtcagagctcgagggccatatgaccgacatccggggttcgctacggacgtcgttcactaacctgcaccagctcgccggggagtgtggtgtcacgactacaatcccgacacaccctgatgagttctcgctgacgtcgtcgctcgtggaactggctatggcgatggaggagatcccctccaagcatgaggccaggatcggcgaggagacgtcaaacgacatctacactggggcgtgccatgtccttgtgtgtatgaggctggcgtatcctgatttagaccttaagaaggccttggatcggggggccaccgatgacgcgcgcaaggctacaatggaggaagtcgttgacttgggggagtctgtcctcctcctttttgaagagtaggatatttgttttcccttgtactccttaatcttcatgctgtaaaactttatgtgggctcgaactgctttcagttgtttcccttgtcttcttagcatgtgattctgagtacctttatcattgtagatgtgttgctgtcgaggatgtccagcagcgtgggcagcctgatgtaccagcggttgttctggcgctcacacttgagccgcacgcgccgctggtggaagtcaataagagcccgttcgtggagacgaacatggcgatgacgtccttaggtttgtgcctttatttccttcgctcctcgtgctcgaattgacttaattagccgtgttctcgaaagagaagagtagcttgacttagtcctttccgtgttgggcagattttgagaacgcgttagctgaccgagatcgtcgaatccagtattggaagacgaaactcgaggtggccgagaactcgagagagccatggttgaggtgaagaaagaccaggccgtggaagccctccgaggtcgcgaggtgtggttcaactcatacctcaagagttgctgcacggcggtggcggaggtttgcaaggagctccgagttccccgcggagatcccgaggagtcggccgctggttatatctcgtggttgaacggggcctgcgcacagctcgaagggattggcaagcacatcgacgagaccctgaagtaggagtgtcgtcgagcgagccgctacgccggtggacatgtgctggcctatatccgagatcgtcgcccgcagctgcacctcgatttccttcgcaaagggttttcgcgttctcggaggacacctgcggagatcgatggtcttgcgcagtcaatggcgctgcttgccgagaaggttttctgctccatggatgggcgttggccgtcctggtagcttttgtatctctgggtatgttgtgtatgagtgtttttctcacattgcaactacggttagtcacttgagccattcactctccctagccccagccttgtcggagaatcgttctcggaggataaggctcctagacccttgacctgccttggttgaaaaagcactgaccctagcccctagccgtaaagttgaaaaactcaatttctgatcacacgacttggttaatacgcacggtgagaactcttacatgaccagatcttacatggtcgtttgtctctgcataattcgaaaatgccttatccgctctgggcgtccccagccgaagttcccttaggttcctcggaggccttgccaggacagcgtaaagggacatgaggataggtttcaactctaggtgtcgtcgtggtaagggatcattgggaaggaacactttgacaatattctttacctgaaatcaactttattgaaatcgcaaggtatctgacaaatatggatactattgatttatacataaagtttacgtaattgatccatgttccaggaatttgctaactcgtgaccatcgctgtctgcaatcttgaatgcgcccggccgcaagacttgcgtgatcgtgtatggtccttcccacttgggtgagagcttgttgcaccctgcttggctttgaacccgttggaggacgtaatcgccgatcgaaagtgtgtgtgctctgatgcgcttctcatggtatcggcgaagggcctgctggtagctggctgatctgatggcaactctttctcgatgttcctcaagtagattcacatcgtcgcttcgctgctcctcctgctcctcgttggaatacttctgaactcgtgtgctctgatgtcgtagctccgtggggagcatagcctctgagccatacacgaggaagaagggtttctccttattggatgttgtcggtgtggtacgcatggcccatagaacagaggggagttcttcgacccacttcttgtcatgtgacatgagtctgtcgtggacgcgggtcttgatcccttgtagtactatgttgtctgccctttcgacttgtccattgctccgagggtgagaaaccgtggcgaagcaaatctaaatcttaactcccaatccgatgcagtagtcctggaagtcggcactaatgaactgggagtcgttgtctgttatgatgcggtgaggcaatcagttttatcttcttttctcatactacatgaaaaacaaaattgaaaggaaaaaaaacaatcagtgcttaaaacagatttatagaaagttacttctgaactattcaaaagttacttccaattaacattgaagtaacttttaaaaattgttaaacttacttgtactgatatgtgctgattaaatttaatttctagatagagtcatatttttatccgtacaacgaatttacttctaatgtcgtgacaaaattactttctttttgttttaagttacttttataatatatgcaaattacttttagactttattgaatttatttttatatgtctaagaagtaatttagtgaaatctaaaagtaatttagatatattatgaaagtaatttttaatttttaatcaaaatataatcatgtgagatcttgttataaagatttaattgttacgaacataacggtgtaatcggatcgtagatcggatgagtagtttaagagaaaattttatttgaaacataggtggttcctatttgtttgatggactagtagtatgttttcagtaaagtaatggcttcagttgtgccgtgccgtaagactaaaccaagaggtttctcggtttagattttgggtatttataaacaagtacctaatcattatatggaaagccaacaaataggtaacacagtggatattttcttcccgtggaagacagtatttaattggagttcttcgtctccgttatatttggattaggtaagtagcacatcctctcaataatcacagattcaacagttgacaggattaaacttgatcaatcatttgtagattttaaatgaatcacttacagagttgagataattaatggtgatattgtcgttataatgtttttcgaccttctctttaaatcatttggatcaatagccatataagtgagtgtaggcaatagtgaatggcatataaccaatgtaaagaacttaagatcaatatttctagtgattttgcagaaccaatttgccatggtattaagaattcggaagtacaaataacgagatttcactgaaaatatcaccgcccattatcatcagccctgaacaatacaaatcttaaaaaaggtttccatcaattctcaaagtaggaagttaattttattttgtaaacaaggaaagtacaaaatatacactagattgtcttagtattgagaaatattttacagtacttgaggggtgtagcatacattctagtcataatttgtgatctctctaatttgatacattcctagtatcgagctataggaatagttaagaaaaagagctacaagaatacaacaaattaaccataaacatcacatactatagcattcttaaaaccataatcctcttacttaatattcctaaaaggaaacatagcttgcactgattttgtgagtcggtgtagtagctgacgaagggaaagaaacgattttgtgatttttcccaattcacacaccttcctgacgcacaacgactcaagctcaacaatgaagacgccatcttcttccgtgccaaccaagatggcgctgggaccttcggcaactacagccaaacacgccgctccttgccctcactacgccagatcctcacacctctgacgggatacctgtgacgggcaaacgaattggtcagtagtgaccattacctttgacgggttatacgggatgccgtcaccggtgaggcatctgcccgcggcccgtcacaggtatcccctcacctgtgacgggccgaaaggaaaacccgtcagaggtataccagtgacgagtttttcttccaacccgtcactggtatcccctcacctgtgacgggccgataaattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacaacaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgaaaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcgtaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttatgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaagctttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccatggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctatatatgttcggaatgatcaatagtatattgcttatgaaatagtcaaataaaataattaagtgaaacacccactagaagtgaaataaaataattaagcaagtattagcattggaaataatataattaaagtagtataataatgaagtgcaattactactgttagtgaattaaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgctgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgcgccctcctctccaccgccgccctcgccgccgccaaatccgccgccctctccgccctctccgccaccctctccgccgcctcctcctctcgacctcgacctcgacctctccgccaccatctctgccgccgccctctacaccgccctccccaccgccgccgcctcactcactctctcgaccgccgccgtccttctccatcgacctctccgccgccctctctaccgccatctccgccctctacgccgccctccccaccgccgcctcgacctctccaccgctgccgcctcactcactctctcgacggccgccgggacctcctctcagtcgccacgccaggaccgtcgtcgccgccaccgggatctcctctccgccgcctcctcctctcgaccgggacctccacggtgagcccactccccccgcctcccctcgtttactattggtcgccgattaaccccctcttctcctcctcagcgccgccgtgccaagaagccgccgccgcgccgccgtgctgagaagccgtgcgccgtgcgcctgccgggactcgtcgtcgccgtgtgccgcctcctctgctcgtcgtctcctctccaggtacccctctctctctgatgcccatgaatggaatggtgcagtggatggatgaataaatgatgcaatggaatggatgaatgaatgatgaactttggatgaatgatgaactttggatgaatgatgcaatggaatggatgaatgaatgatttaagtgccattttgacatgtaaccattcatggagtgtgtactgctttatatgttgttttgttcccttttgctagaactattgaattttggggataatgtttacatttagctgaaaaaggatggattgatagattggcaacagtgttaggggttatgttcccttttcctataaataaagcatatacagggtttgaaatttagttcaaatggaaaatacaaaatgcatggggagttttggtggattggttagtgtagtccatggacggaaccgacctagtcaccaaaatttttcatgcattttgttttctataattctttgataattaaggacctttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaggatttgcagattatataaacttgttgatttatataccctttttgtctatgaataggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctacacccctgctactgcccctacacttgttcacttgttccttattaaatggccagtgtagagtagttatatacctctacacttgttctttttttatgcataagaacagattttgtgcacttgctctttttttatgcataagaacagattttctgcacttgctcttttcttctggattgataaatggccagtgatgaattgctcaataaaaacagattatctacacttgttcatttttttatctattcttctttttgcccctgttgtggctcaatcagtaatgaattgctcaataagaatagtttatctgtacccttattgtgggctgttttttaaatttgcatgattgactcagtggataagaacagagtatctacacttgttctttttttatgcataagaacagatttgctcttttgatgttatgatttcctctttttatcccttcatgcaaatgaatataattgatgcatatttctgagcaaaactgaggccatatctttcagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgatttagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctgctgttgctgtttatgtgaatctccccttgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttattgataagaacagatgaactacacttgttctattttattttctatttcctcttttttctgcacttgctcttttcttctagattgataagaggagtatatctagacatgttgttttagttaatttgcccctgctgttgctacccctgtggcatatatactcctcctgctgctgttttatgtcaatcatgcaaattatgtacccttgctgctgctgttttttaaatttgcatcattgattcagtggttatatacctctacacttgttctttttttatgcataagaacagatttcctgcacttgctcttttccttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaccaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattacaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcggacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgcttgccgacatgaatataccccgagtcacaacacctgctgtgcaaccaactcctcgtatacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgtagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccagcgcaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacatgaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctccttttttttcccttattgacaggttgtggaggttcacaacgaacagaatacaagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtgtttcagagggcatggctagcaattcctgaggctagccaatatttagcatttattttttttctggaattaactcatcagtgacggttcggaagaaacatccgtcgcaggtaacttcacctgtgacggactcgcaaacgtcggaccgtcacaggtgacccacctgtgacgggcttttactttcgggcccgtcacaggtgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgagcgaaggatcgtgctagggagaaccaaaagccgtatcctggtttttatgacgctgtcccatatcctcctaattataaaattcctgaatttaccaagtttagtggtgaggatagtaggactacatatgagcatgtagatcaattcttagcgcaatgtggtagggctagtagtatggatacatgtaagttgcgcttgttttctttatctttgtccggtactgttttgatatggtttacttctttaccggcatattctattggtacttgggctcaattagaacaaaaatttcatgattattttcacactaatgaaactaagcttaagttgtctgatttaacatcggttaggcataaatacaacgaatctgttgctgattatattgaaaggtttagagatattaaaagccgatgttttagtttgagaataactgacaaagatttggccaacattgcatatgatggattgcttgattctattaaagagaaattaaatggccaaatatttcttgatgttgatcatgtgttgcatgaagctctggctcagaaaagccaagtggatgataatagtttaaatgctagtttagatgatagtgcaatatcatgtatagctgagccaagagatggttcggattgtggtaataatttgtgcaatgatgccgtgacaagtatagccgaatcaaatgttggtccggattgtcttactaacttggatgataatgttacaaccattatagccgaaccaagtgttggttcggattgtgttactaatttagacaatgatggaatagccgaaccaaataatggtttagattgtgttgctagcttagagaataacatcattgaaaatatagccgaactaagtgacggttcggattgtatcacaagcgaaagtgaaatagcattgtcacctaagatcgaatcacaaatcggtcatgtggatgttagaaaagatgatgacaatgtcttgcgggatagtggtgcaatagaatccaaagtagttatgcatacatatcaaaggccgtatcctgaatatgtagattcggtcccatacccgcaaggatttgaggtgcccaacttcacgaaattcacaggtgagaatgctaggactacaatggagcatatcggccactttattgatcaatgtggtaaggccggtagcgatgatttgcttaagttgaagttgtttcccctttctttattaaactttgcatctacatggtatagtttgcttgctcctagttcaatttctacatggtcacaaatggagcatgagtttcatgattatttcaaagatgcaagtttgatggagcaaagaccgattgatacttcatcggtcacttgtgaaactatttcggttacatctatgcctaaaaccggaattgttagtgatcctctccctattagttctattaatgttgacaaaaagaaagggaaaagtgttattattggggatcctcggcccaagaataggatcaataatgcaaaggccggagatcataaaattgccaaggatgagtcatctagttcccaaaagaccaaaaagccgaagctcacttttgagatgcttatggctaagtacaagaaaggattagccggtcagcgatttgataatcaaacttgtgattcaaaaagaccaagatcatctcgtagaaagagatttggtcaaacatcaaagcaatcggagccatcaaccataccaactccatataaacctccgattgtgatgccatggtatccatatccaatgtcactatatggttatccttttatgtattatatgccatggatgcctcaaccacctatgccgtgtcatcaaggatggaagcaatcacctaggacggtaccaagtcattctaactcaagacaagaccgtttcccacgaaagaatcggtccggtggatcaaaggtgaaaaaggtgaagaaggtgtgggtgagaaaagaagccaaagctccagaggtcgttgctatcaaagaggagtctcaagatgttcatgtacctactggagatgcggtggaaaccacgcaagcaaaggagatcgaagccgacgccgtgactatcaacattggtggtctaaccgagacagctggccggtctaaccgccaatctacggccggtctgaccgaccttactggccggtctgaccgacggcttgtggccggtctgaccgggctcagtggccggtctgaccggggggcaatggagaagagtgggaaaattgagagcaacataggagcttccacttcgaccaaaaatataaagaatcattgtttagctcctggaaaataaccacagccgaagtggataccttccggcttatctcgctctcaaaagaggaggctacaacgtcttcgagtcataggtcaaaaagaagaagaggccgaagatgtggagaacaagacatgcaataatttggagcctcgaaaggcacctaggcaaatgtggagatccaaagaggtaaaagttaagagaccagtgatttcccatagtagagataaatccaatttgatgatagaaaaatcaacggtcgttagagataagtctcctacacatgatgctatgggtgttagtgcggtatccgtcttgccttcgaaatcgcgcaatctagaaaagccgattttgcttggggggcaagacattaatatgctcatcagggaaccaagagaagatgaacggcgatggatacaacatcacatctttgagccgccgtttgttggatgctaaggcaaggtatgagtttattgtgtttaccattatattatatgcctatgccatgttattagaacattgcttgttatctagcacatgtgtgtttttgcttatcaaattgatattatacatacatgttgcaaatgccagttctaggtagtagaattggtaggttggcatataatttgtttgaagtatgatttggctcatgactctttgatatttatttaaaaccaaatcatatgtgtttttatggatcaccatataagatatagatttcatatttattgcgccatgaaagttttgcttattagtaattcggctaatgtcaatggtcaatatgatgatttgctttagagtgattttctttaggaacattggcattgttaatattttacatacatgctcaagccgattacttacatttgtagtttattggaatctatgcatgtgacacatatgactttggtgattcattattgatcatacttcaattggctaagtgttttgatgccatgatgattattgtttcaaaagccatttgaattaatattcatctagacatgttagttggatgttataatttttcatatgtctagagaggagggattttggtccaatagtttgatacactaagcatttggttataatacgaagaaaggagtattttttactagaaaagccggtgcttgatttttatgtctttggatgaaattggccaaatcatagaccaggggcggtctgactggaattacacggccggtctgaccagtgatgaccagtggtctgaccggctctgcatggccggtctgatcggcattccgtggccggtctgaccgatctcgggcaaagagctggggggcacgttacaattgattaaaaggccgaattaattgtgaattcggacatttgtgcccatgagttagaaatagcttggagaattcctttgattagatatttgaaagatcctacacttaaggttgatcgaaagattcggtggcaagtgttcaaatattatatcgccgaaaaatagatggagtattacttagataatgatcaatctaaagttgctaggagagtagtacatgaagggattcgtggaattcatcaatcggccgtaagatgaattggttgcttagaagagtggaattctattggccgaaagtaattgatgattatttcaagtgctacagagggagtgaagcttgtcaatggatcggcaatgttcatttggcgtatgtcgctatattgaatcctatcattataccatggccgttccaaggtagggctttggatttcattggtcagatttatccttcgttatcaaaagggcattggctcgtgctagttgcaatgggttacttcactaagtgggccgaagccgtgccactcgacaatgttacttgtacgaaggctaatggataagccgagtcgagtaataaaacattgttgaaattgccgttttgccagttgaggtaaatcttggctctcttcggtatttcaagcaagacgacatgtcggttgaagattacaagaccttgatgggaagcaattttgaagacgtcattgacaagcgtttgaagacttcgaaggagatgaagacacttcaagacggtgttttcagagagcaattaatgggagatagcttgaagaaatacttcccgagcatttggtaagatgcttaggaagtcctatggccggtaattggattatcgccctgagataacatgttctatgcttttaggttcacgtatgttcaccaaaaaggcaggggggcatgtgtttacacccaaatttggcacctatggacgaaatagggaaaaattgccaaagtttggaaagtgccgggtttccttcacagggccggtcagaccgcaggtatatgggcggtctgaccagctatagggccggtctgaccgcaggtatgtaggcggtcagaccgtcagggtccgagtccgagtctgttttcgtcggatctcgggtttccttgctcgggaaggcatgtttcgtgtttcctttggtttctatcccgagttggacatggagaagggcctgtagagggcaagaccaacccctatttaagggacaaggtccggttcattgtaaaacccctgaatacaatctacttgaatcgttattttactatgttttctattttaccctagtttagtccatctttgtcggtttgcgccgtaaaccgtccgccgccgctgcgagagtgcgacacctctttgtaggtttgtcctgaaaaccttccgttttgcccacgagacgggtagctatcctcatatcgatctaaatcggcctagaggctgattttgatctctaaatcggctccgctagccggtttagcttttccttttgcaaaacccatcttgatttggccctttggctagatcgtggtggttggcgactccatatcaccgcaaggcgtttaggtgttgcgatcgtgcttgtcgacttgtcaaaaaagttgccaacacataccacatagtttgcacggtttatatggagttggtatggttgatggctctgattgctttgatgtttgaccaaatctctttctacgagataatcttggtctttttgaatcactagtttgattatcaaatagttgaccggctaatcctttcttgtacttagctataagcatctcaaaagtgagcttcggctttttggtcttttgggaactagatgactcatcctttgcaactttatgatctccggcctttgccgaggatccccaataattacacttttccctttctttttgccaacatcaatagaactaatagggagaggatcactaacaattccggtcttaggcatagatgtaaccgaaatagtttcacaagtgaccgatgaagtatcaattggcctttgctccatcaaacttgcatctttgaaataatcatgaaactcatgctccatttgtgaccatgtagaaattgaactaggagcaagcaaactataccatgtagatgcaaagttcgacaaagaaagggaaaacaacttcaacttaagcaaatcatcgctaccggccttaccacattgatcaataaagcggccgatatgctccattgtagtcatagcattctcacctgtgaatttcgtgaagttgggcacctcaaatccttgcgggtataggaccgaatctacatattcaggatacggcctttgatatgtatgcataactactttggattctattgcaccactatcccgcaagacattgtcatcatcttttccaacatccacatgaccgatttgtgattcggtcttaggtgacaatgctatttcactttcgcttgtgatacaatccgaaccgtcacttagttcggctatattttcaatgatgttattctctaagctagctacacaatctaaaccatttcttggttcggctattccatcgttgtctaaactagtaacacaatccgaatcatcgcttgattcggctataatggttattgcattattatccacgctagcatttaagctattgttatccactcggctttcctgagccagagcttcatgcaacacatgatcagtatcaagaaatatctggccattcaatttctctttaatagaatcaagcaatccatcatatgcaatgttggcctgtcgcgaccgagaaaattgccttttcccgaacgctagtgtattaatccccgtcccaggaaaagccggggtacaccaaacaaacatgatacaaaaggaacatctttattatatcgataatatttacattattacaaaggcacttcaggcctgacaaacaaaaataaacagcagcggactagcgggcctacggctccatcttcacaggcgctcaactggggtataagtcaggactccacctaaaacttcttctccaaagcttctcttactgaggggggggggaagatagagcaagaatgagtacaaccaccgtactcagcaagccacaccgggagatgcacgattaatacaaggggggtacaaggggtaataataatagggttgggttttgcagtaaacagcatttaaaagtcacttagttgcccaaagctattttgtaaacacgatcctagagctacacaatattattaatcaaggccgtgaaccctcacgaacctgccttaacccaaggcctacgatgattcgaaccaaactggcaacccgacctgggtcccagctcgtcccaagccaacccaggccaaccattccatattttagttgttaagcaaattttaagaattaaaccactaacttgggtacattgctaggcttgcccatatccgagggcacggctattcgaataggtttactctgatcagaggtgtacatctttacccacaagacacatctttactccgtattccatggccttggaacccgtcgtaaacatgtgacataacccttcacccatcctagccgtgaacaaaagtaccgacccaaccctgcctacggccggtatcccgggacaggcaggccaggattgagcccctagcaacaagatctagaccgggtgcgccacacacataggggtgagaccacccgcgtactagtccagtgccatggcatctcgactaacgggcactgacccgtgtagtcttcatttgcctagacatctcaattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgaagaccggtccttatagtggccgagttgctactagcaaaaccatgcacctcgaacgtagcctaaaaccattttgggagttttgaatagagggggggggtgtgtgttcaattccatcacaagccaatcattccacagtgtccaaatgatatgagcattcccaaagtctaaagttaataaaaccacctaatgttgcctaattaatcagcgaagcatctacctaaattcatactagtggaaccgttaatagagtacccactagttggggttttgtttatcctagggtgaacaaggtaataataaacaatagcaataataataaggtcataacaaaggtaaataggcatggctaaataaaatagtgataacgtgggaatttaaataaagcgataatgcattaatttaaatcaaaataattttataaactaggattcaatatgctcaaggatgatgcgacttgccttgctcagagagagcggccttccgaaccttcggcgatgaccgcgaaccacgcttcgggaacctccggaacgacagaagctacgcgaaacacacaagcaaagctacaagcctataaagaagcaataacaatacataaaaagaaagcacccggttctttaggttataacaaacattaggagacttgaatgggtcgattcagagttcgtatgaccaagatatgatcatccgaagtttaatgctattatatggagatttacggattattataattaggttttgcaactataaaacatgtggaagcgctagcctggaagagacaggaaggctgcgccgttgacatgcggaccccacatgtcaacctaaaggaccgcagtagaccgagtacacagagacggtccacgggtagacggaagcagaccccgtgtgtcaaccgaggtgagtggccgacaaacggactccactagacaccacgcgggctgcacacgtggaaacaacgcggctaccgagcgggcacactaacacggacactacacggtcaccacccgcacacgtgaacgactaccgacacaggtacacgggtaccggggtcgacagccgcacaacgggtacggggtgacaccaaaaggacgaggacaagggcgacgagggagagatccttaccaccacgcgacgaggcgtgggaacgacaacgacgaaggagcgcggcggagacggctcggggacgacggaggcgaacggcgagggaacgacttcggcggcgatccttggacgaaggtgagacgcggccggcgcagggcttgacgacacggagacgaggacgaagatgacgacggggctgcagcggctcgcttgatgaaccacggatggcgaaacacgatcgggaggacgacgaccggaacgggcgaggaggcgacgagggcagccggcagcagctgcacggaggtgaggacgacgtggaacacgccgctgcgatgcccacgacggtggcggcgcagcgagacgacgagccggcgaggaggaacgactgactggaggagtcgtcgacgaggacgaacggagacatccatcacatgggtccatcaatnntcatnccac

SEQ ID NO: 333 - DNA, 7483 bp, Oryza sativa
  unsure (1)..(7483): unsure at all n locations
ncgnttttattacaacagagggtgtgtgccgcgacacgatgngntanaaatnagtatcatatgttntacacgcgggtttgtggcatcaccagangcacatatatgtctccgcattaatatgcgcaccncgcgngggtgcgtgttatanaacgngagtgtgtttgtgtgccnacacncacccacacatgtttgagagagagacccgacctctacccacgaatagtgagataccccttgagagggctgagttataagaaagagaggcgccgccctcttcnacaaagaggaagaagaggccgcaccgggtatcgcggtaaagggacgaggtttggaacacagagagagccgcaaaaggaagttttccaggggaaacccgccgtgtgttcttaataagttcttggggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaaggcggggagaggcggggcggccacgggagagcgcgggagggggctaaaactggagaacttaccgagggggttccattttataggggaggatagggtgctggccacgggaaaggcggagaacggcggcggaattcgtggccggctgccatggaaggtggccggggttggcgcgggcgttcccgacgattgggggcacgaatcaagggggaaaatgggggaaatcaaagaggaatcaatggggattaattccccctatttaatttggaaggagccgacttgaatggggcggatttggaggaggaacggcgctaggtttgcacgggagagagaagaggccgtgcgggaggaaggagatgaccgggtgggtgggtcccaccagtcaggcgcgcggtcagcgcgcttgcggcgcgcgtgagggggggtggcggctcgggaggctggggcggctgggtggggcggcttgggccgggaggcggcccaggcgggaggggaggaaaagggagctgggccgagggggggggaaggggaggcccaagagaaggagggagagaaggagagggagagaaagagagggaggaagaaaggacttaggccgcgggccgagagagagagggaggactttgggccagacttggcccaaaggaggaaggaggattatttttaggtttttctttttaataaactttgataattgtttttgttgcttaataaatatttccggcgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagaaaatgatttttatttcgggatgaatttatcaggacgtgacatggccaaatctttgtcagttattttcaaactaaaacatcggcttttaatatctctaaacctttcaatataatcaacgaaagattcattgtatttttgccttaccgatgttaaatcagagaacctatgctcaattttaccagtgcaaaaatgatcatgaaatttttgttctaattgagcccaagtataaatagaatttgccggtaaagaagtaaaccatgtaaaagcagtaccggataaagataaagaaaacaagcacaatataaaagtatcactattagcctcaccactaaacttggcaaattcgggaactctataatttcgaggaaacgacacattgtcataataattaggatatggctttttgtatgctctaacacgattcctaggttcaatcccgaatctattcctcataatatcactaatcatatcctccatgttattaggtccttgtggatttggtggtgggtttggtggcctaataggttgggtttgtggcgcaatatgattatattggccttgcctagtatcgggaggatatcccctagaaacatcattataagcattagaaatatgtgggggaacttgaggattacttgtagcagtagatacaggaggatcaaatgttctaaagtgatacaaataactagcattagtcattggatctatgccctatattgggacgactacgccggtctgaccggcccagggcccggtctgaccggcgtcatgatgcgcggtcgggccggcctgagagccggtctgaccgctgggataaaacccggtcggaccggccatctggccagtcggaccgacgggataatacccggtctgaccggccatctggccggtcggaccgacggctgcgtcgcggtctgaccaaccgtcaggctcggtcggaccggctgtgaatgccgttccgttggttttattacccattggatctataggagattgatcaacagtggtataggctttatcctttaatgtataattatccataaaagaacctagcctactccttaaaaatccatcaaccttatctttaaacattacatctaatctaatctatctttaaaattagccatagatgaatctattgtagatgcaatttgttgttggatagattgtgatacctcgtcattacttaccatgtcgggagcgagcttgggacatggcccgggcttgatgatcacaccttgacgagtcctagtagttgatctcatcaaggcctcccgtgtgagctcgttgatgtactcctccatagctttacgatcctctccttcgaagtcatctaatgtgaccggcatcacattagatggctccacctccgtcttggatgatggcttcgtcatggcgaagtcgaagtcgagttgacaatgaacggatctcgtccccagcggactcgccaaaaatcgtgttggcaactttttgtgacaagtcgacaagcacgattgtaacacctaaacgccttgcggtgatatggagtcaccaacctactcgatctagccaaagggccaaatcaagatgggttttgtagaaaaacagctaaaccggctagcggagccgatctagagatcaaaatcagcctctaggccgatttagatcgatttgaggataactaacctgtctcgtgggcaaaacggaaggttttcaggacaaacctacaaagagatgtcgcactctcgcagcggcggcggacggtttacggcgcaaactgacaaagatggactaaactagggtaaaatagaaaaacatggtaaaagaacgattcaagtaaattgtattcagggggttttacaatgaaccggccttgttccttaaataggggttggtcttgccctctacaggcccttctccacgtccaactcgggatagaaaccaaaggaaacacgaaacatgccttcctgagcaaggaaacccgagatccgacgaaaacagactcggacttggaccctgacggtctgaccgcccacataccagcggttagaccggccctactagccggtcagaccgcccatatacctgcggtctgaccggccctgtgaaggaaacccggcactttccaaactttggcagtttttccctatttcgtccataggtgccaaatttgggtgtaaacaccaggtagtgggtgaatcctgatctgccatctaattttatgaaaaacccaaagtcagctaagagtaaaacttgttttgtgaagaaaatagttcagagtaaaaatcgtatagagtttggtaaacatagcatttttatttttttgaaagtattactaaatgggaatttctcccttggccaacttacaaaagggggggggtagggcacttttggtcttttcctacagtcgtatggctctgataccaggtctgtggacccccatttttataacaggaatcaatcgtgtaacagtaccatttccctggatcaagtagtctggtacacacgagttcatagctgaaataccaaatgcacatacacgagagtctagtgcgatttattacatcaaaagcccgcaggcatagtcttagatcatcgaaccgagcggtccggaatacatcccaaaagcagagatagataaggcagcggaattaaggcagcggcatgccattgccacaggcaacgaccgtaactaagacctactgagcgccatcgtcttcatcaccctcctggtaataggcatagggatcctccgaagcttcatctccggcctctgattaagtttatatattgcaagggtgagtaccaactgtactcagcaagccaccacagcaacaatgcacatgattggaatatttcaaggaatggctatggttcttttgcgcaaagcaagttttgcaactcttttcacaagcctaagacctagcatagactgaccaaattttagtactagttcatattaagcaatgacggttctgtccaccatccattgtgatcccaaggatggcttcccgccattgagtcgtcatgtttttctaaggacgtccatcttccctcctctcggaaagtggctccaacaacataaaatcatcatgcaatgacccatcccacacaagttaagaatttagagtctagccaagtgtaatacatgtcctggtgctcaataaccgcgagcacggctattcgaatagatttggtttagtcacactgcagtggatgtacactttacctgcactccgcaactacccaacacatgagcctcgtcccaacacatgagacgcgtcacggcaaagcttttcgataacctcgcattggcagtacccgctccatgaacttttcatcctcatgcactctaggcgtacacagtttctagcagtgagaggagttctggcgcaccgtagagcccctgcctcacacatcaagaaaccactatgcatggatactgcctctgctcagctatttacgctgctaggtctatccccatacgagaagtgcggttgtacgggggtcgtttcatgcttaacttcatggctcggtccttaattgaccagggacggtactagcctttcccagataccacccacatcctccgtccgccccagtctaaaacaagtgtttaatttcattcctactttcacaaatcatgtcatcattatcatggcaatgtggcactcatgtctccacatgccgcatctcaattacgttcccaaaggtaattgcccaagcatatagcatttgataaaatatgagcatacataaatctagagtagcatttctaagcatgggtcatagttgactaaggactcatacgtaattatggttacaaggatttgaaggtaagcaataatcaaggcatggcataattcacaagtaggatgtttatcattgcatgcgatcttatttgtaaacaaaataaattttgcaattgggatcaacatgttcaaagaatagtgatgacttgccttgctcgaagtcctgcgggtcttgaccctcgctcggatccgcaactccctcaggctctacaagtgcgtgcgaagaattgatttgaattccatttgaattcaaataaaatccaataagcaccaaatcgaaagtgagcgcgggaggcgaattctatatcaactacattatttgcgaaataagattatcccttatccttagatattttgtgtttcctaagtaaattcctaagaatttaacacatttatttatctcctaaataaatctaaattcttaccgcaatttgattactcataaagtttaccaaaatagtctataatcatattaaattttgcaattctacgactataattaatccataattaaattctaattattttatattttctaaacttcttaattttactcaaatgcctatttattttctttctctttctttctttttctttctttttctttccctttttcttttctttcttttctctcccttttccccttttctctttttttttcttttcttcttcctctccctaccggcttctcccttcctctctctctcggctcttgtctccccggggcagcgacagcgaccgagcaaaaaaggagggggggtggcggcttaccgacggcggcggcggcggcggtggcgacgcacggcgcggcacacggcgcggcgcggcggcactgagggcggcggcgaggcggcacgaaggcggcggcgcggtggagagaaaagaggggagtaatatgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaggctctcggccctcggttgtgccagcgggtatagctcactccaagcgtaattccggtttcaccaaataagggttaacccggaaaaacatttgagcaaaggccaccaaagcccgaaccgtaaaagccccgtgtggtttttttcataggcccacccctttccggctaaaaaatagccctaaatcaaagcgcgcacccgcacgactttaaaaccatggttccccttgaactctccggcgctatatacaacacgcgcatacaaaactgtccctttacctccgaaaggtcgctttactacccaccataaatctacccgctaagagcacctcacaagaatggtgccaacacccctattctctgccgggctatacgaacatgctttgatcatcggaactcctattacagcttaaccgtggcaactcgacnggagataatgctctcaatcttacagcgtcctcgccacataaaacactggtctccttcaccaccactccaacatattattcgcatacaacctattctgtgcgctgtaatccacc

SEQ ID NO: 334 - DNA, 9080 bp, Oryza sativa
  unsure (1)..(9080): unsure at all n locations
cggaacaaatgatatagctcgcgagacgggaacgcaagaacatgagtaatgaaaagtctatagagaggagtncggcaatcgaagatatgttaagacntgtgacaagagagagatgagtaatgtatcgagtatagttcagtagagacagacactcaaggatatgataactgatacacatcataataaacantagggacatgatatgagaagagggtacagacgtaataagaaagatatacgcaaatatcattaattaggcagagtgtgaagagtagtgaataagcaaaaaatcctagaccgtgagagatgagaaaggtaantgagatcgacgagcgaagagacaagcatgaagaacgtcattacattgatgaagctacaagatgagaatagatcagaagcgcgtcaagaacgataangaataaatgaagcacataagagatgtaagagttgattatagtaatacactcgacaatgtgcattaagaaagaaagagtacaatcaatatagggataaaaacgggtaaggtgtttagcaaaaatataaaagggagcagggaagggagttgccggaccctaattgaggaccggaacggggcggcagggggctcaggacatcggaacggacggaagacacaagagggcgggcctaggagcggaacgttctcgcgagttgacggcactgggctcgaggcgcggcggcggctcctggcttggcaccggcgcgcggtgggcaagggcgcccgcgcaaggcaataggcacgcgacacgacgacgggacggcggcacggcgacaggcaacgcgacacggcgaggaacgccggcgcgacgacgggcaacgtgacggctacgcggcacgccagtggcacggggcgcgagacggcgagcgcgtggcgcgaggcgacggaacagcggcgcggcaatgtgaccgcgacaggcgacgcgacggcaacacggcacggcatcggcgcggggcgcgagaagaaagccggcgatggtgacggcgcgtgtcggctcgggcacggcagccggcgatggcgacggcgcgtggcggctcgggcgcggcagccggcgatggcaacggcgcgtggcggctcgggcgcgacaggcggcgatggcgacggcacgtggcaccaggcggtgatggcgacggcgcgcggctgctcggggcataaggcgcgcgcggtaggggaaagggcagggctagggaacctcgtcgagcacttacagcgcaatgaacagtgatttttttctatttttccaatttggttgtttttcctattcaaatcttgtcccaatatttctaattttcacacaagtgaggttctcccaatgtttgagttattctaatcggagggttcacccgagattaatattatccctatttatttttatataatttgcttgaatttaattagagtaaattcttatcccatcgcacctaaatttaattgttaccaatatggtcgcgataatattttatttatttccaaccttacctaatctttattttaaattatattttaatcagttattttgccaatctaattttagggtttattcctaatgaattattccttatttgcgatcggtaaactttgaaaccaaattccaataaaataggcaaataaaaatcggcatgatgcaatttattaaaaagtttttgaaggcccatatttttagagttttgattttcgttggtcgaattttcagggtgttacagagagagaggctctgcctccgggatttggacgcacgcggcttggagcgaccgagcatgggcggctgcggggcacaggcgcggcggggccgacgtggcggcgaccgggtggtcggccacgcgcgagcgcgcgcgcgcggctgcgagggcgcggccggattcaaacggcaacggcgggaaaccggcgctggtgggagagctcaatgagagagagagaaagagagagagagatagagagagagagcgaggaagagaagagagggaatggctctctcgcgtgcgcagcgcacgagcaagcacgtgaggggaggagcaccagaggggagagaaccaggctgagaggagatgggccgaaggagggaattggcccacaaaaatccgagggacgcaaaatagactttgacagagagattgaatttggagagaattggaggttagaaatggaatttggatatctttagagtcagacgaatatttggcaaggttttgagatttggaatttgaattccgaatttgattatttggactcagggaaacaagaaggagtcaacaccgggattcaaaaggggaatttgatatttttaggattgggacaatttatttggcggggattcaaaggatgcgattgacctttggaataattgaattggaattgggatcttgaggtggaggattttgttgccgacgagaggaaataacgatggatttgaattgagatccacggcacgacttagactcagcactcaaagaacgaaaattttcgcatataggattttggcgaattagtttttaacgtcccacgaaaagcggagcgttacatgttccttcacttacgcattgattttgtcttatagttgttctttgtatttgtctctcttcttataacttgatgcgtcttgtggaaaccctatcttccaactcgtctttgaggacaaaccccttacacgtccagagtgttcggcagtccccaacgccgcagtaagctggtctcgctccctccgtgggacgaactgtcctgctctttctttctcgactatctgctgcaaattagtagtcacttgttctatgtctggagtctcgaatagtatgtctccctcatccgagacttgacctgtgttgtgcgcccaaacccagttcttgctacgttccaccatggggtctaccagcagaggtttgccggccgctgcaaatctctgcttggtctcccgccattgatcgacgtgcccagcgtatccgattgacccctatctatgggtatatttgttcttcttcgcgaggtctgacattttttttcctcaaagccaatgcttcaactgttgtatgatctttaacaaacgtattccagtcagcctgcaatatatgtccaaattccgtgaacggtggcagattcttctgatcataatcccgatttagatcggatccaggagggtacacaaaatacttctgcaactcattccagagaagtgtcttgatgttgtcgtccaccgtttcccataacttgacattaatgggacaacgcgtcctgattagagtgccacaggtgttgctaaacttggaccgcactatcggtggctcgacgggcttcccatcctgatcgagagcaatcatgttgtaaatttccttgggtaatttattcttgcttctctcaccacgtctttttttcccactcccgcctgcacttatggatgtatccgtacgttcaggtgcagacgtagcagtgtccatctcaacttcttcctctctcctggtcctcgcgactttacgtttcgagcagcatcagacttccatctgcatagtataggtaactctctacaccattaggttcatgtcacatcatagttagtaaataatatatggctaacgatgttcagcacttatggcctgttccataggtatgtagtctggatcatcatcgcgaggggcgacttgtgttatttccattggaaacgggtcacttggtttgcgccacgtttctttactaaaagtgtcatgctgcttgttgctaccggattttttaggagcggtaccttcttgaggcgctattggtgcgttcgatggaaccttatcgttcgacatcttccaacttgacgtaaaaaaaaattggcataagtcccaatttaacataatttgacatatgtcccaatttgacttaagtcccaatttgacataattccaattttaacatatgtcccaatttaacataagtcccaatttaacataaatcacaattttaacataagtctcatttcaacataagtcccaatttaacataagtcttaattttacataagtctgagattgacacaagtcgcaatttaacataattccgagattgacatcagacccaatatatgtaacataagtgccaatataacattcatcccaatttaacataagtcccaattttaacattagtcccattttaacataagttccaatttaacgtaagtcccaatttaacataagccccaattttaacataattcccaattttaacataagtcgtaatttaaacaatctcacaattaaactaaagtccacaattgcacaatttcacaaaagtcccaatttaacaatccacagctaaacattctcaaaattaaacaatccacaatccacaattgcacatttcacaatccacaattaaacaatacacaatgcacaattgcacatttcacatttcttttttttaaaggaaatagtaccgggggacttgggaccggaggagccggcacggcggtggtggggaggtattgccggtggtgacggcggtgacagagaggggtaggacttcggggaggacccggcgtggccttggcggtgaggggccgggatgatttgcgaaggagccggcggtggcggggaagacttggcggcgtcgaggggccgggaggacttggggaggagctagcggtggcggggaggacatgacggcagcgacggcgagggggccagggagaggtcctggcggcggcaacggtgatggcgagggggacgacttcggggaggagccggcggtggcggggaggacgtggcggcagcgacggcgagggggccggggagaggtcctggcgacggcgacggtgagggggacgacttcgaggaggagccggcagaggacttggcggcagcgacggcgagggggccaaggagaggtcctggcggcggcggcggtgacggcgagggggacgacttcggggaggagccggtagaggacttggcagcgagggggaggtcttggggagtagccggcggtggcggggaggacttggcggcggcgacgcggcgaggggggaaattttggcagcctggcggctagggttcgcgggtgccaggacttagaaaattttcgctccccgcgctccctataagaactaaacaattagatgaattcttaggatgtaatttcaaatcacaaaatgatttaggttaaaatgacccaacaattcgaattaagcgattccgcgaactttgttgtcaatttagaaagagtgtttcgcgttcaacgtttgtgtgaattatttggatttcatttgaattctaactgaattcaaattgttccttcgtacgtaattatagagcctgagggagttgcggatcaaagtgaaggtcaagacccgcaagactttgagcaaggcaagtcatcgctattctttgaacatgttgatcccaattgcgaaattattttgtttacaaataagtttgcatgcaatgataaacatcctacttgtgattatgccatgccttgattattgtttacctttaaatctttgtaaccataaatacgtattagtccttagtcaattatgacacttgcttagaactgctattctagacttatgcacactcatattttatcaaatgctatatgtttggggcaattatctttgggaagataattgagatgcggcatgtggagacgtgagcgccacattgccatgataacaatggcatgatttgagaaagtaggaatgaaattaaatacatgttttagactggggtggacggtgaatttgggtggtatccgggaaaggctagtaccgtccccagtcaattaaggaccgagccatgaagttaagcatgaaacgaccccgtacaaccacacttctcgtatggggatagacctagcagagtaaatagctgagcagaggcagtacccaagcatagtggtttcttgatgtgtgaggcaggggctctacagtggcattgccattggtaggactgccatatgataatttaaaacatgattataacttaatgtgtgtatgaaaagctttccttcccgggtgcgccagaactcctctcactgctagaaactgtgtacgcctagagtgcatgaggatgaaaagttcatggagcgggtactgccaatgcgaggttatcgaaaagctttgccgtgacacgtttcatgtgttgagacgaggctcatgtgttgggcagtcgcggagtgtgggtaaagtgtacatccactgtagtgtgagtaaaccaaatctattcgaatagccgtgctcgcggttattgagcaccgggacatgtattacacttggctagactctaaattcttaactggtgtgggatgggttattgcatgatgaattttatgctgttggagccacttcctgagaaaggggaaggtggacgtcctcagaaaatcatgacgattcaatggcgggaagctatccttaggatcacaatggatggtggacagaaccgtcgttgtttaaatataaacactggtactaaaatttgatcagtcaatgctaggtcttaggcttgtgaaaagaattacaaaacttgctttgcgcaaaagaaccatagccatcctttgaaatacccctatcatgtgtattgttgatgtggtggcttgctgagtatggttggtactcacccttgcaaatataaacttaatcagaggccggagatgaagcttcggaggacccctatgcctattaccaggagggtgatgaagacgatggagctcaataggtcttagtgacggtcgttgcctgtggcaatggcatgccgctgccttaattccgctgcctcatctatttctgcttttaggatatattccggactgctcggtccgatgatttaagactacgcctgcgggtttatgttgtaataattcgcactagactctcgtgtatgtgcatttggtatttcagctatgaactcgtgtgtaccagactacttgatccagggaaatggtactgtttacacgattgactcttgttataaaaacgggggtccacacttttactcttaaattcaaggatatatactggttgtaaattttttttactgacaagatttaacatttgtaatatttttatactctcaaaatcaacaaagagtaaaatctttactcctgattttagatatttgttccggtctatcaaaaagtatctcgtggtaatggtacctcatgataccaaatcgttttcgatcgttggatctaacaatgaccatcctgcccagttagatccaacgatcggaaacgatttagtaccgtgaggtaccggtacctcgaggtaccttttgttggaccgaaacaaatatcctaattttatgcatgtgtagggatgacgtaaagagagagaggggaagaggagcccatcgactaaagcagaaaaggacaatgagagacaagaggtttttatttttacaaaaaaaaacttgttaaaacctcgcgcgttgcagcgggatattttgttgtgattgttggtttcatttggtaaactgtagtgttataaaaacggtaataagttcattttaggtccctcaatttgtcgtctagtccgaaattcgtccctaaaccgcgataccagatatggcacgtccgttaattctcaaaaccagtgcaaataaggtcccaaggtggtttatacaatggttttggctgatatggcacttacgtggcattgataaaatcagaaaaaacaatgggaaccacatgtcatcaattgttcagttaaaaataaaaaaatacagtgggaccaatgttatctcctctctttcacctcttctctccctcctctctctccctctttgtgttcagaggagagtggcatggcgagtggaaacattgttgagttgtgatccaaattcatttgcacttaataaaggccagcttctgccgtagctcagaggcacagctgatgcttgcttgaagtttggcaggactgataaggggcttgttggatatgtggattcagattttgctgcagatttagataagagaaggtcactcacaggttatgtgtttaccattggtagttgtgctgtgagttggaaggcaacattgcagcctgttgttgcccagtctaccactgaagcagaatacatggctattgctgaagcatgtaaagaatcagtttggctgaaaggattgtttgctgagctttgtggagttgattcttgcattaacttgttttgtgacagtcaaagtgctatatgcctcaccaaagatcagatgtttcatgagaggacaaagcacattgatatcaagtaccattatgttcgcgatgtagtccacaaggtaagctaaaggtatgcaagataagtactcatgataatcctgctgatatgatgacgaaacatgttcctgttgctaagtttgagctttgctcaagcttagttagtatagtgatttagcccgagaggctattttggcgccgaaagtgtttttttgtctttgttgtgttcagggtgaaggattgattcatgctacaagaaggaatttgtctcgaggtggagtttgttgagttgtgatccaaattcatttgcacttaataaatgccagcttaggccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccggagcttccaaaatagcccttctattcgagatg

SEQ ID NO: 335 - DNA, 3874 bp, Oryza sativa
  unsure (1)..(3874): unsure at all n locations
ggaaggaaggggagggcgatgttgaggatgtcctacgtaggggtaggagcttagggaagaagagacgaccgagtaaacagtatgtagaattgagggagagaagtaatccgtgtagccaatagggtataaaggaaatgggtaccggagtgggacatgaagataacgaagaaaggtagagactgtagaaaatgagcgtattcaaggtgagtatagacgagcgaaatgttgagaatgggagagacagatgattaagggtgagagtgtaggaattgtttgcgttaataaagagcgtataggtggggagttaggattagatggcggaaggggagagagaagaaaaagggggaaggagagggagggtaagtatagtggagaataaggttggggaggatagagagggagaggtttggcgtatgggtatgtatacgaaaggtatagtaggaggaagatggagtagggaaagggaggaaaaaaagaaaagaataaataaaaaaaaaaaaaaaaaaaaanaaaaaaaataaaagaaaaaaaaaaaaaaaaaaaannaaaaaaaaaaaaaaaaanaaaaaaaaaaaaaaanaaaaaataaaaagaaaaaaaaaaaaaanaaaaaaaaaaaaaaaaaaaanaanaaannnccccgcggtatggatcgtcatcctttttagggttccaccatatatatacctattgtaagccgccatgcggtgatgtaacctcacctcagatatagtgaagatattttgctggctggcgcccgtggtttttttctctcctattttgggaggggtttccacgttaaatctcttgtcttctgtgaatgatatattgttcttttatcgtttgttcgcctatcgtttcctaacaagcatgagctcattgcggcagtgttctagtaggattctggccgccgctcgtgctcgcgccagcgccagaaccctaagacgtcgctggagccccggcgcactttattcacggcgcagagtgatgccaccatcgacgacctaggctgggccacctcaccccgtcaaacgagctccggcggatgcttgtcctggcggtcgatgtctataactcgatatatatgtgaactgacatgtctccttccaaatcaagagcagcagcatcagcttacccactctttgctctccctcactgctatacacttaatggaaaaatggtcatttcccacaagttcaaattatcaatacaaagctagttgcagtgtccagttcttcgatcaccatctaagctctagctgcagcatataattcagagctagtggccatagcacgtactactagcttgatccgtggctacggtggcgtcgctagcgagagacccgaagtggcgggtgatggggccggatggcgcgatggtgagggtggagcacaagaacggcttttgggccaccatggcgggtttggaagatcggcaccgacgaccatccgagggcggtgcacggagtcaaggtcggcctcacgctcgccctcgtctccatgttctaccacactaggcccctctacgatgatgccagcgcccccgctatatatgtgggtcgtcatgaccgttgtcatcgtcttcgagtacaccgttggtaattgtgtgaccgatcgttgactgtcagcatcacacgtatgtcgcaacgacgtagatggaatgtggcacgtgcatgcgttgcaggtggctgtgtgtacaagggattcaaccaggacaccatgacggtgaatgcagggacagagagggagtggcctcgacgaggtggaggccagcgggcacggaggcagtggagggggtagcggcacggaagaaggaagagggtcttcatcatggcgaaggtggtggaggtcgcacgagtggcggccagaatcccacaggagtgccgcctcaacgagctctgccgcctcgtgcttctcctcgctcgccgttcggcgcgctctcctctgaacccaagagagagaggacggaggaggaagggagagaagagataggaaagaaagggatgacgtgggtcccactgtaattttttatatttaatcaaacaatcattgacatgtgggtcccgtggttctttttaacttaatttgtcaacgcaagtaggcaccatgtcaaccgaaatagtcatccaaactgcttgggacattatttacattggttttgggagtagggggacgtgtcatatctggtattgtggtttagggccaaatttcggactctgtgacaaattgacggacataaagttaacttgtttcataaaaatccctcactgttgaattgggccacgatcaacttagatgggcctccagtggtggaaaatatacatgggctcatgtggtggctgtgtgtgactgggttgggttgtgtttaatttgaccatatgctatgttttttcatccaacggttcaaaggcaatcaaatctactgatccaacgactgagaattgacgatgacgtgaaaattgaggtttgagtttaggatcttaattgcagttagtgggttataattttacagtaagaagtgatgtgcggtggggttgaggtgttcgatctggaccattcttcaattgatacattaaggacgttgtatatttgcactgagaccggggtttgcacctgatacttcccgtgtataattgacacatatattgactcactaatataacctcagcaccatacaagctttaaaaggtcacaatatatttatctcaaaatggacttggtttcaccaatatacgcctacaaatgtggaaatttttagcacgaacgataaacagcagtaatatttcctagttcttacaagcatggttgacttataaatagtactacagcatacttaaagtagacaaacagtgcataaaaaaaacatattgctcccttaaacaacattgtcatgttctggcctcctgatgatcccagcatgagtgagaagtgcccagaggattgttatcagctcgcctcccctggcaatggcctttgcatgtgcctttgtattgtcggaaggagcaacatatagcatcatctctgaccaaaactcagcaagcatattccaccccttgttttcattctgaattccatcaaccagctgcttgccgagttgtacacctttgcacaccacctcattgctctttgatttttcactcagtaattgcatcatgcggtcaaattcgaaacacctcatatcagtgctgcccaaaacagagtcggtgatcttcttggcagatttatacaattcttttgacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttaccaccctttgggcatggtgccggctccttttctgggaagagtggcttttttatcccccccaaaataacttaaaaccccttcactctggttttgggaatttaaatttaatcttaaaggaaataggccccctcttacggtgcttaataacggggggttgggggtttcccaaggtgaccttttatgtcaaggcctttacgcgcgctttggtttttatctttttttgtcccg

SEQ ID NO: 336 - DNA, 1756 bp, Oryza sativa
  unsure (1)..(1756): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaggtccaaatctgtcgagcaagcatcgctattgattcaaaattcccaccttcatttccattatgaacggcagtcaatattgaacttgtattcatcccaaccattggcagcagcgctgcccatagtagcagacagaatgcgcggttgtcaacgcattccaaaccgtgaaacaagttgtagtacttgtctctgccgacgtaggagacaacataggagaggattggtaggactagagtggatgctcccagaaaaagatagcggttcaaagcaatatgccggtaacgacggccataagagccagctcccacaaggatcaccaccaagaatgcattggcgacgaagagcgcattcgtcgtcagtacatctttgtttatgcgctctatcaagtcgtttgagcggaagccacatgtggtagacgacattatagcttttatagatcttgcaaccttgttgtgacaatctggtttacatatattgcacattcattagggttagactggaaaaagagttagcttataattaagaaattaaccacaaagttatattttttgtgtccctatttattctcacatgtttgaagctcttacctgacctatatggaacaaatcactaaaataaacaaaaaagaaaaggaaaaaagaagaatgtcccaaaaataccaccttgaatttcaatgttagaaatattccactctaaaacatgttctccttgatttatgccatcatagacttgacattaggtcaaaaatattttttgtagctctcccaacgttaaatttaactggacagtgtaattaaatgaaagaaatcaggtttggggtggcatatatatttttagctatgatattctgggtgacatatatcaaatctatgtattatataccaaaagtccactaaacttcctataaacgctccaaagttgtcacgtagcgcttcaacaagcattcctaggcccgccatgtggcattctacaatcccaccatcgattttatgtcgcgtcccaaatcgaccctaaaatagatcctcttaaattatgcctagaataattaaaatacttatgaaatccttcaaaaattaaaatgtgcaaagttaaaagtcaaataaggtttggaggaattttgtatatttcctaaaagcctagaatgtgtaaataaatttttcttgtaattttcagagcccaaattatttactatttacgaataaacaatgttaaaatgaatttttaaaaagaaaaacctttatatcccccctctcctcttattgtggccggttggttcccacttaattaacttttgacttattttctcctggcctatttagatttcttagcccttgccctcttttagctgagcacgccgcgccctaatttaggtacggtctccccctttaataaacactccgggcttgacgccatttggcttggnaacacaaaccactcttatccaatcgcgtcaccttaattncacaatattttgtaattggcgataaatacacgaatattatttccttttcgccactctttgtaccatttatcctgaggaattttggtaactcgtctcatctctcagcg

SEQ ID NO: 337 - DNA, 1853 bp, Oryza sativa
  unsure (1)..(1853): unsure at all n locations
caacacacctttttttgctctggggggggccaatttaaaaccccaacacccgcctttgagggtcgcgccttggggccttttcacactttttttccggggtcaccctgtttggggaaaccatatccccccttgaagaataacaccctcccccccccaacccccggccaatgtttaagtaagaggaaggaaaaagcgcccattcgcaacnggcttttcccgggggtgccaatttcataaacaagtgcacagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggtaattggattatcgccctgagataacatgttctatgctattaggttcaagtatgttcaccaaaaaggcaggggggcatgtgtttacacccaaatttggcacctatggacgaaataggaaaaaattgccaaggttggaaagtgccgggtttccttcacaggtccggtcagaccgcaggtatatgggcggtctgaccagctatagggccggtctgaccgcaggtatgtaggcggtcagaccgtcagggtccgagtccgagtctgttttcgtcggatctcgggtttccttgctcgggaaggcatgtttcgtgtttcctttggtttctatcccgagttggacatggagaagggcctgtagagggcaagaccaacccctatttaagggacaaggtccggttcattgtaaaacccctgaatacaatctacttgaatcgttattttactatgttttctattttaccctagtttagtccatctttgtcggtttgcgccgtaaaccgtccgccgccgctgcgagagtgcgacacctctttgtaggtttgtcctgaaaaccttccgttttgcccacgagacgggtagctatcctcatatcgatctaaatcggcctagaggctgattttgatctctaaatcggctccgctagccggtttagcttttccttttgcaaaacccatcttgatttggccctttggctagatcgtggtggttggcgactccatatcaccgcaaggcgtttaggtgttgcgatcgtgcttgtcgacttgtcaaaaaagttgccaacacataccacatagtttgcacggtttatatggagttggtatggttgatggctctgattgctttgatgtttgaccaaatctctttctacgagataatcttggtctttttgaatcactagtttgattatcaaatagttgaccggctaatcctttcttgtcttagctataagcatcttaaagtgagcttcggcttttggtctttttggaactagatgacttatctttgcaccttatgatcttcgccttttgcgaggatccccaataatacacttttcctttctttttgccacatccatggaataatttgggaggatcattacaattccgttctaggcatgatgtaccgaataggtcacaatgaccgtgaatttcaatgggctttgttcatcaactgcttcttggaaaatattaaactttgctctttttgccctgttaaatgactggggcaagcactttcccgtaatgccaattccaaaaaaggaaaaatttatttggaaaattgtacggcttaccaatttaaaaaggccgatgccattgggcataaattcccccggn

SEQ ID NO: 338 - DNA, 1280 bp, Oryza sativa
  unsure (1)..(1280): unsure at all n locations
tttctgagcgcgcattttgcaagctgacggggggagaacctaagaacacccgcaacgcggcttttagaggtccggccttttgggggctgtgggcaacagtttcttcccgcgtattcccggtttcggggaaaccgttatcccggcttgaattaccttataccgctgccaacacctattttcgagacaaacaaatcagtgaacnagatggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttcactttannccctatattttatgtaatttagtcgaaacagttcatcagttgtacaaacaattatgtaatggtcctatagaccactgatgttatgtgtttattaacataggtgtttatttaaataccttgtttcactaaatttatttgttgtcttaataacatgccttttgcatattatttcaagacacgctctactttctctataaattttgtattttgatttagcaaattctcttaattatgtccaacataattaatggaggatttaatgcatgttccacttcacactttaacttggaaattaatcacatgtcgatggagtcctatactttggtcatatcgaccataacttaggcagcgagtatctcgcccatcataaagtggtctatattttgagatgattacccgatggagccctagaaattggccgcactggtcataacttaggcagcgagcacctcgcccatctcacagaggtctacatctcacgatgattacccacatgtgttcttttccaagaatatgttttgagaaatgagattatttgaaatttggttgaacacaaggtagtggagttttaaacattggctgcggtatattcaccataatatatttgcctcgagaccgtattttaggcagcaagaataccttgcccactattaagagatctactccactgtttaattacttgaagatggtcctcgttgccaaccaaattcgcagatcctgctcaaggcgacgtggagtcaaaccactcn

SEQ ID NO: 339 - DNA, 1219 bp, Oryza sativa
  unsure (1)..(1219): unsure at all n locations
ggtggaatggaatcgacgtcgccttgtgatggatctggcttatagcctgctattgtacctactgttagtaataattacatggatttgtattgtacatatttttcatgtaattaattaaaattcatactcacatgcacctaacagcaacatagttgacgttcatcttgtcccgatgatatatggcatggagatcttcgaaatctagccatacgtaacattcgccgccgaaacaatctgccggtgatcgagctgttatattgcccaagcctttcttgctggcatccatgtagaaggtatgtaaccttctcatctcctatggtccttcgtaaagtgcccaatccggcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngantctctgnggtctctggttcgaacctgccttaatcgataccgttcgctttttnctttggaaggtgggcttttctaaactaactgtgggttcaaatcgggagagcttcttcaaacttgtgtgggccaaaccccggtaaaccaccgctggcctaacgggacttgggttggaccacccggaaaacaaatattcactgganaaccttgtgaaagttttcaaaccggttttggggggtaaaaatttgaggggccaa

SEQ ID NO: 340 - DNA, 723 bp, Oryza sativa
ccgcgatgcgaactgcgtacgagcccgaatccgaatccaaatgtgtagatctttatctcttgtcttctatggaccaaaagtgacgtggtgagatgaaagaaaacttggagaaggtcttggtttggtccccaatcaacttcttcaatcatctatgctttccttacgctcggtctcttttctttcgcccaagcaagcacctctgcgaacaaaaacacatgaaactcattgtgtagcaacgtttattcaaatatataacaagtaaatctaatatagaatatatgtacctttatttgattaatacataaggtagtcatggttatatccgagctagttatgtcctcatcatcctccccttcttgattggaatccgtcctcagtttcaccttgtcatggagcgtattgcacttatctttgtctatcacagcatcctgtgcggaacatttcttgatggccatatgattggatcctaaaatctttgtagtcaaaaaaccacaacactccccttcttgcaaaccaacctgtaactcatttatacaactagaggaactagatagaaaataacttatatgcatgcggtcctctagacaacacatttcatcatgaaaaggaggtatagtcaaattcgaacaaatatatactcgatgcacattatattctcctttactatcataattgcccattatatgaaaaatcacatcagaagggcatggcaattcaaatcta

SEQ ID NO: 341 - DNA, 728 bp, Oryza sativa
  unsure (1)..(728): unsure at all n locations
agcgtgnatagaactgcaatgccngacgacgacgagccaccaacttcttcacgctcttctatcctgatggagtgtcgagcggtacttggacgcgtggattgaggtagtggtggtggtaatctccgcggttggtacacgtcgtccaatccaatcgacctgcaacctaatcttgctgcaagtttccggcacctttgacgaactttctgcatttcaaaaaaaaaagaagtttgttaggcataactcaagtaatgcaaagtgctaaataaattttacctctaaaacattgcggagtgtgttctccgtgttctcaccacccctcggagcttggagggcatgccccatttcattcacactcctgaggagctctctcgacggaaagcgtgagaagatatatgttagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 342 - DNA, 1304 bp, Oryza sativa
  unsure (1)..(1304): unsure at all n locations
cccacccacatcctctccatactcacccgaatctctcccctccttcctccaatcaacctatcntttnttttccctagcctccgttcgtatctacagnnttattccnnnnnncnnccacaacacacttgacnnctgatgcctgcatgacanatcaaaatantataaactaggattcaatatgctcaaggatgatgccacttgccttgctcagagagagcggtcttccttacctttggcgacgaccgcgaaccacgcttcgggaacctccggaacgacagaagctacgcgaaacacacaagcaaagctacaagcctataaagaagcaataacaatacataaaaagaaagcacacggttctttaagttataacaaacattaggagacttgaatgggtcgattcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagagggaaaggcgacccccccgtacacggccacataacaccccacggcgtgctggctaccccacacgtgaacaatataaatctttcgaggccaaagggcccgcaccttgcgtaggtaccctacttaacggaaacctttccgagtttacccgcgagatctcaaaacggcggcaccctagagtcttccttaaaggctttacaggaatccggacacccacacccatggacgcggaaagcgtcacccatagggcactcctcccataaacggcttatgcacctttaacctccggcctaaccttctaaacagggcctcttatataaccgctacacaaccaaacctctttcggccactttcaacc

SEQ ID NO: 343 - DNA, 2258 bp, Oryza sativa
  unsure (1)..(2258): unsure at all n locations
gaaggagagggtttctgtagatactttattggcgcggtcgtgttctccgcgataacccggctctcgcggtggttttgtgtccgatacggagcgccgtttttttcccatggtatcggctacgcagagcgcaagttccgtgttgtttttttgggtggccgtatttgtccccctctttccagtattttgtagccccgtcagattccccgctacgggtattcctgattccaagggttgctaccagtgcatatattaggttctcccctgttggcccccagatcctatgttcccggattagtgcccacgagtcgtgctgaaggtggggtttgttcctcacaggccatgtttgtancgtgccgccttaccccagtcttggtttccctccagcgttagggtgtgacaacgcctccacactttccttaagggataaaagtcggacagggttcccgttacccggcatggtcagttccagataagccgccgggggtgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattgccgcgccagcatgagcaccatcccagacggtcagcttgccagaagtggcatccagcatgagcggcgtcatggctggagtggaagccgtcagttcgccaggaccatacgcagtgtgcgccgggtcgctgttaccgagcggctggttatgtgtgaaaacttcagtaattgccatgatagcctcttaaacgggggtgtttaacaaatcgtcagcggcatcagaagatgcgctacctgcttggagtgcaccgggtgctgtttccatcaaacgatccagcgccgtatcggtacgcatctgggcactttgcggtgcagcagccagaatgcgctgtgcgctctctaccgtcatacccggcgtttcggccagtgctcgcgcctgtgactcacgccctttagcctcgtcgcagttcaggatgcccatgatgcgactattctctgcagctactgctgcagtaacctgcgcactgacatctacaggggctgctacggaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 344 - DNA, 1168 bp, Oryza sativa
gacgcgccaatagatcccctgtagacgccacgagtgtggtaaaaatcattaagttaaggtggatacacatcttgtcatatgatcaaatggtttcgcgaaaaatcaataatcagacaacaaaatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtccgtctgttactctttatgagaaagcgttcccgctttcagagcaatgttcaaagaaagctcatgaccaatttctagccgaccttgcgagcattttaccgagtaacaccacaccgctcattgtcagtgatgctggctttaaagtgccatggtataaatccgttgagaagctgggttggtactggttaagtcgagttagaggaaaagtacaatatgcagacctaggagcggaaaactggaaacctatcagcaacttacatgatatgtcatttagtcactcaaagactttaggctataagaggctgactaaaagcaatccaattttatgccaaaatttattgtttaaatctcgctctaaaggccggaaaaataagggctcgaacacggactaatgtcaccaaccgtcacctaaaaatttacttaacggtcggcaaaggaagccatggggtttttaccaactaaacttacctggtgtgaaattcgaacaacccaaaccaacttggttatatttctatcccaagcgcgaagccaatatggaaaaaaactttccggaaacttgaaaaagacctcgccctacgggctatgggccctaccgcctaatagccgaaagagacaagtcttaaaggagggttggaaatacagaggtgcgttaatacgccccgtagtgctttaaaataaaaatgagggcggtggcg

SEQ ID NO: 345 - DNA, 1378 bp, Oryza sativa
  unsure (1)..(1378): unsure at all n locations
aacgacacaaangtccacggnataagtaagaacaaaggtgaagcagatctttgagcgtaaccaaacctcatcataatatccactaactattccgatacctccaccccccccnccccagacagcnaagtagaacgnctgatagnaaccnncnnnnnnnnnnnanngaannaaaaanaccnanaacaaccacaaacacnnncaaaaaaaaaaaaaaaaagccnncntctttttttttccccaaaanaaaaaaaaacaaggggaacaaaaaaatacgaaaaaagagaaacaaacaaaaaaaaaaaaaaaaaaacaaaaaaaacaaaaaaaaaaaaaaaacgaaaaaaaaccgaaagaaacaagaaaaaaaaaaaaaaaaaaaaaaaaaaaacacgacaaaaaacacaaaaaacaaacaaaaacaacaacgaaaacaaaaacaacaaaaaaacaacacaacaaaaaaaaaaaaaaaaaaaaaaaaaaaaaaaaaaaaaaaaaaaaaaaaaaaaagagaaaaaaaaaaaaaaaaaaaaaaaaaaaaaaaaaaaaaaaaaaaaaacaaagaaaaaaaaaaaaaaaaaaaaaaaaaaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 346 - DNA, 1197 bp, Oryza sativa
  unsure (1)..(1197): unsure at all n locations
ccatgaggtgcccgcaatatatcctttaggttggttttcagtgactgccgagtgcccccattggcccattcccaaacttcctgtgtattaaccagcaatcccaggtgttttccgggcagtttccagtcccagattaaaaccacgaggggtttccagtttttttcctaaagctttgaaggaacggaacaggcgccaagctttgggtatgaacccaatgattggtgccccacacgctgggcgttgaagcgcgtaggcttcaatgtcatcggtcgggtcatacgtttctttgtcgcggggtgaccatgcagccgcaccggcctggacaatgttgttaccagcgctgcggcccatatcgacttcaacaggctcgaacgcttccccggtcatggtgtatttaccgctgagcaccgccgaaacagcctgtttctcttcgacctgagcaatcgccagctcttcatccttcatgttctgaaggataatgcggcgacggcgatagaccgggtcagcgagattctgcggatcctcatccggcaggcggcggagagtcatcagtgggttaacttcgtgtttcggcttcacataacccggcgtgaattcagacgtgctgccgccacgggagcggatcactttgccggagacaatcggcgagacgtaaagcgccatattgaccaggccaggaatttgcgacaggtaaaccttctctgtactgaagggataggtttcgcggaaaaagatacgcaggaaaagcggatcgaatttgaatttcttctcattgaccgccagcagttgggcagtggtgtaaacggacatagatttttcccgtaaaaaaagccgcgcaagcggcttttatgaatgatgatggttgtagaaatgcggattaaacgatgctgattgcagtaccggcgaacgcgttacgtttaatgttgtcgtcggtgacggcagatggccagaggacatcttcaatacggaaagnnnnnnnnnnnnnnnnnnnnagttccgcgctgttctggtctgcggttacagccaggatgcccattgccgcgccagcatgagcaccatcccagacggtcagcttgccagaagtggcatccagcatgagcggcgtcatggctggagtggaagccgtcagttcgccaggaccatacgcagtgtgcgccgggtcgctgttaccgagaggatgtgtctacctnaaaggcc

SEQ ID NO: 347 - DNA, 1089 bp, Oryza sativa
  unsure (1)..(1089): unsure at all n locations
gcgtgtaatatgatacgactggatatatctatatatatatacacacacacacacacacacacacacacatatatatatatatatatatatatatatatatatatatatatatatatatatatatatatgtgtgtatatatatatatatatatatatatatatatatatagatatagagggggatatagagggggatatgggggggtatggggggggggtgtgggggggatgtgggggggagagggggggggagggggggggggggatgggggggtgggggggggggtgggggggggggtggggggggggaggggtggggaggggggggggagggggggggtaggggggggggggggggggggaggggggggggggggggggggaaaggggggggggggggggggggggagggggcgggggggggggggggggggggggggggaggggggggggggcgggggggagggggggggggcggggggggggggggaggagggggggggggaaggggggggggggggaggggggggggggggggggggagggggggggggggggggggggggggggggagggggggggggggaggggggggggggggggggggggggggggggggggggggggggggggggggggggggggggggggaaggggggggggggggggggggggggagggggggggggggggggggggggggggggggggggggggggggggggaggggggggggggggggggggggggggggggggggggggggggggggggggggggggggggggaggggggggggggggggggggggggggggggggggggggggggggggggggggggggggggggggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 348 - DNA, 1205 bp, Oryza sativa
  unsure (1)..(1205): unsure at all n locations
tcgtgccnttgagatcgctaacccagatgaggcgtatgaaccggataatataggaattggaatcattgcaggtctagcatatgcatctattgaattaaatcaaaaagcaaaatgcattcgtccaataatttttttaagggataatatatttaggtcgctatcaaaggaagatcctgattactcgagaaatatagagggtcaagtcataaggttgcattgggactgggcacaactcctaatgctgtcagctaaaagaatgaaagtagcatttaagctagatattgagaaagatcaacgagtttgggatagatgcacagcggatgatcttaaagggaggaatggttttaagcgatgtttgcaatttaccctttaccggcccagggatttactatcattgttgaatgaagcttttttttccgcattcagagagaatagagaaactatcataaacactgacctagaatatgcagccaagtcaatttccatggccagacttgaagatctctggaaagagtatcagaagatctttccttcaatacaggttataactagtgcatttcgtagcattgaacctgaattaacagtttatacgtgcttaaaaaaaatagaagcatctttcgaattaatcgaagaaaatggagatcctaaaataacgtctgaaatacagttgttaaaggcaagtggaattctccaaagtttgtatagtgtaggatttgttggtattcgtgataaaaacacctcatcctattcattttgccatgacgggcgaactccagataaaggttttgaaagtaatgaaaaattattaattcatccatgttactggctgggtttgaatctaaatcgtaatgcacttgctccagaggaagcagaggagataaatgacgaatatgatattaatattatttcagataattcagccattagaaataaaacaataggtcaaataactactcatctagatcagataccgataggaaatgaaggtgccactgatttgacaatggtgtttaaaacacttagaatagtattgcttccaactaacagcatgaagttccatcaatggnaacccagttaaagaacagatatattgcgacaatggttggcaactggattttggaacagtattgaaggctttaaacaagcaagttgtttgaggtaaaaatttgagaaataggccttggtattacactccatcatattag

SEQ ID NO: 349 - DNA, 2561 bp, Oryza sativa
  unsure (1)..(2561): unsure at all n locations
ccgcctctcctcctaatttatacncttgtcggtttgtctcctncccctccctcctctcggntctcnnacttcctcngaacannnnncacnttttaatttttntatccccccccccnnaaagaggtagaacgcgtgtttgtacgcgccacnnnnnnnnnnnnnnnnnnnnnnnnnnnnnnnnnnnnnnnnnnnnnnnctatgtgcattcatgaacgcaattttttagaaggccatcgatccagatggatgagaagcccttcagaatgaagtggtgcaatgtctcgccagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacatattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcagagttgaggacaagactgacgaggattacgatcagttggatgggcaaccccctttcacggtgacgattgaccctagcatcttcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaattttgaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaacatatttttaaaactatcattcatatattagagtttttcacaatttaatttactatctttcatatgctacttatatatgactattcgaatttttaaaaggtttaaatcatgcatgtggcatttacatatgttaattagagtttttagcatgtaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttcatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccgggtggggataagaaccgggtcccaaagataactgctatgccttaggagcctagcaattatatgggcactttccccgtgcccacattcctcttcagaaaaactcttcttggtgacttnccacctccctttaccattgaaggcgacgctcctacctaccgatagtaggctagtacaaatcgcacagtaaacaactctaacgatacgtccg

SEQ ID NO: 350 - DNA, 3806 bp, Oryza sativa
  unsure (1)..(3806): unsure at all n locations
cacgataagatctacatnnnnnnnnnnnnnnnnnnnnnnnnnnnnnnntatatatatatatatatatatatatatatatatatatatatatatatatatatatatatatatatatatatatatatatgttactttgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgtagcgaacaagcttgagggtcggcacatcataacggaagtggaagaagatggacatcctagtgccccggccgaagccgccaagaactatgtacgtcacaacggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacgatggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaatgggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaggggccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaactaattaggtcattgtatataagtagactatagaaaataatatactcccttttatcgttgnnnnnnnnnnnnnnnnnnnnnnnnnnnnnnnnnnnnnnnnnnnnnnnnnnnnnnnnnnnnnnnnnnnnnnnncccttcctctg

SEQ ID NO: 351 - DNA, 820 bp, Oryza sativa
  unsure (1)..(820): unsure at all n locations
ccgcgttggcccagnnnnnnnnnnnnnnnnnnnnnnnnnnnnnnnnnnnnnnnnnnnnnnnnnnnnnnnnnnnnnnnnnnnnnnnnnnnnnntagaagccccactctccttgtacgtacgacagcatgatcggcggcgccgccaggccaccgacaccgccggcggtcgtcgacaagacgatgtgcgccgcgtgcgacatcctgaagctcctaccgacaggcaccgtgctggccttccacgagctggcgccgtccttcaccaaccacggcggcgcgtgcggcgcggccagccggtacaccaccgcggcgctcatcgccgcctgcaccgcgtcctgcgtgctgctctccttcaccgacagcctcgtcagccatgtcgacggccgccgcctctactacggcgtggccaccctccggggattccgcccgttcaacttcgaggggacgcgcgaggagatggaggagaggttcggcgacctcccggggatgaaggtcagggcgctggacttcgtgcacgcgcacgtctcggcggtcgtgttcgtcgtcgtcgcgctcggcaacgccgacgtgcagggctgcctcttccccgacgccggcactggcttcacggagatgttcaggaacctgccaatgggattagggttgctggccagcatggtgttcatgatcttccctactaccaggaagagcatcggctacacggacatgatgccgcacaaggaagactacgggaaagaaggtaataatattcctggccagaccacgccgtcggtgtgatgaaagtaacatacatgatactccatttatactttataggaaggttn

SEQ ID NO: 352 - DNA, 653 bp, Oryza sativa
  unsure (1)..(653): unsure at all n locations
tttcaaaaagcagaatatatttttttcctgatagagcattatgtataattcactttctccggtatgacatgattttcacagaaagtgcaacatgagttgctaactcaatacgcaagtcagctcctggagaaggagcattctggatgccatgcattgcttcgtgatgacaaggtttcttggagaagctccacgtctctcaacagtttatcaggaacaaatgaagtctgctaacatagcatcttctgttttactccaggttgatgatctctctagaatgtacaggctcttttccagaataactcgtggtttagaacctgtttctcaaatatttaagcaggtattttgtttttcagaagagagtggtttatttcttaaatctattttgatgatgtaatggaatgttgcttctgtgtagcatgttactaatgagggcactgccttagtgaagcaagccgaagatgctgctagtaataagaaggtgcacagtctatatattaacttttgtttgtattaatgttgtcttagtacattcatcttattgtgtacttggggtnnnnnnnnnnnnnnnnnnnnnnnnnnnnnnnnnnnnnnnnnnnnnnnnnnnnnnnnnnnnnnnnnnnnnnnnnnnnnnnnnnnnagngnatcataccctg

SEQ ID NO: 353 - DNA, 1169 bp, Oryza sativa
  unsure (1)..(1169): unsure at all n locations
aggatattgtgttccaagattttacaccgcggtggaaatcttaacaatggtggtaaatggtagttttgtccaaaaaaacttggttacaataaaaccccccagaagcacatatgaattgaagaaagggatccagaatattggggtagcccgaaccggttgtaaacccaggtggagtactttataaaagggcggagtatctgaaattgtaagaaagcttattacaactgacacctttacaaagcaatttgctattaaaaggatttactagtaaactggtttttcatgcttttcaactgcaatattttctttggtgttattttttttcaaaagtaaatccatcgcaaacgttggaaattgtattgtggaccactttggcttaaccaaataacttatataattgtattctgcaggtacacagaataaaaaaaaggggtggtggttggatttccggaacagggtttaattnngcagnttccattacatatattatttgcactacgtattttctctttcatccctcctggcctggcgttattcaaacaaaatacacgagcatatataccatatatgcacgtgctcaaacatcatgcatgcatgcatgccggcacgtacacacatgcagacacacacttaattatcacacaatattagctatcttctcatcagccctgttcgatatctctttagtggagggttgaatgggaacaacctggttggcagagttcttctgcacgctgctgcccgcgccgtcgccgccgccgctgcagtcattggtggtggtggtcttgggacagtcgtcgttgttcttctgcttgctaccttccgcgtcgacgccgccggagccgccgttggtggtggtcttgggaggctcggccttgccatctttgtcggcgtcggcgccgccctcggtgccagtttgagcctccctggggtagccaacgcccttcctggtggaggggaagatcatgaacacgaagctggcgacgaagccgacgccgagcggcatgttgaccagagcctccctccacgtcgcgctctcctgggggaagaggcaggtctggatcccggcgtcgctgaacgcgagggcgaggaagacgaacaccctgagcgtggcgtgcaggaagtcgggtnccgagctcgggttaggcgaatcaatcgtttcaaccccg

SEQ ID NO: 354 - DNA, 1170 bp, Oryza sativa
  unsure (1)..(1170): unsure at all n locations
atggcccttgattttgatctccnnnnnnnnnnnnnnnnnnnnnnnnnnnnnnnnnnnnnnnnnnnnnnnnnnnnnnnnnnnnnnnnnnnctcctggtcaaaaaagattatccaagtctaccaagcttgtgaacgtaagttaaaatccgtcccacgtaattggtactttattttatgccgattgacatcttgcttcgtgtttgtagagaatataccagcaattccaagctaagtctgaaaccctagaaagacttatcttgatactttggagtcggccaggaaagaatttaggccccttttaaaacaaaggaaaaacataggaattccaaaggacttataccatgtggaaaataatcctatgagaccctttgaaataaaggattgatttctaccaattccattgacattcctatggaatggactattgtaggaaattttagaggaaaattagcatgaggtcttacctcatgttttcttcttcccgggtcttgaattcttatgtttttcatgtgtaactatgaaatggtagttttgaaactttcttgtgttttcaaatctcataggaatccaatgaacatgacattctattcctacattttttctattcccatgttttgacaatcctgtatttcaaatgggcccttaaagaagttaaagaagccgccaaagctagagagcatcagctgaggaatgagatcggccagcttcaggatataaacttggaataccgtggattagtcaaaggtaagcaagcaatctcaaaaacttccagcttcaggatataaacttggaataccatggattagtcaaaggtaagcaagcaatctcaaaaacttctagcaaaccctgtctcctgaagttaaataggtccaaaagacaaaacggttatctactaaaaaccaaagggagtngtatttacaactactttgagcatgaacaggcttataacggcttgtgcatgaattatgacgttgcttataaaacatggacctttacactgtcatatattatctatatcacctgaatcattggtatgtgccatcgaagaattattatacctctaacaatcccgagtttgggcatactgtaaaaccatcgctagagcacccatgtattccaagaaaaaatttttcccccttcgcccccaaaaatcaacctttttaacgttgcg

SEQ ID NO: 355 - DNA, 14636 bp, Oryza sativa
  unsure (1)..(14636): unsure at all n locations
ncggactataagcgaacgctgaagnaagattttcttggaaagtccaaacaagtcctcagccttggagagcaaccaacccagaagatcgagccgttgggtgaccggtaaagaaatgacgatagaacaatttattcttgacaccggtctaactacggatcaattgctaggagtcgcaccaatcgaaaagccggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaactaattaggtcattgtatataagtagactatagaaaataatatactcccttttatcgttgtagaatggagattcaaagggcccgacggcggagggttttcgatactggattcatcgaccctcggaaagtaaacgtcgcaatgctcgaccaatatccaaaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgatcaacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatacatatatatatatgtatgcatatatatgtattgaaacatatatatgcatggtttaaccgggagtaccaatatccatgcaaaaaaaaaaaaggtcagctcgatctttagtcccggttggtgacaccaaccgggactaaagatcgatctttactcccagttatttcacccgggactaaagatagcgatctttagtcccggattggtactcccggtttggaaaccgggactaaagggggttacgaaccgggactacaaagggtttctccaccagtgtcctctgggtcgaaatccacgaagtaaacttcccagctatcgtcgtcgtcggcggcggcggtggcggcgccgttgctgggacggcgcggcttctcgtagttgaaggggacgaagccgcccttgccggtgtcttcgtcggcggggaaggctagcccgtagtacggccggcccttcctgtcgatgatgctgtcggtgaaggaaagcagcgcgcagatcgcgcagcagaaggcgatgaggccgccggagatgtagcggttgatggccaggcacctgccgtggttggtgaaggacggcgccagcgcctggaacgccagcgtggtgcccgtggggaggagcttcaccaggttggccgtcgtcgacagcgtcttgtcgacgtagtcgctgttgttcttcttgccaccgccatcggcatcggcatcggcgccgggcgcctgagccggcttcttcttcttgtcatcgtttgtcgggttagtggtggtcgacgacgcaccttttgagccctgggcgccgttcgtgcccatgaattttggccgtgcgcgctgctagagagaattgacagggatcgaggtgttggtgtgttgtgcagtcacaagaacgtgcgaccgcttcgtttctgcatggttgcatgtatatggtacaccccgcatttataggcagccacccaccggggggcagtgaaccagatgccaaaagcgggaaaggccaaagtgacatcgtgcgcatatatgtgcctaattggcccctggcaaacattctacttcaagtagcttgtctacagggtaatggcatcgatggtaagcatatatccgccacacgatatattgatcatcttttcatcatatgctttgcttgcttaattagccctagaaattgcatacctgctttagttcgaccttggatctcattgtacaggaacataccacgcgagctccataaagtgtgcttgcacatatctggcatatattatgaatatataataataacagctagccacgtacgcatgtgtttagtacaatatatcatctctggaaaaggtggatttgctatttccgtcaaaatctcacatctataaatcaaaagaattactccatccgttctaaaatataagcatttatgactaacacgatcttcgagatactattttgaccaacaatatctataaaagtaaaatatttcaaataagaagagttgcatattacgatattttgtttaataagaaatctagtaacatcaattttacatggttgatctttttttattttttttctattaatagtcaaagttaaaaatgtttgacttgtcattatgctaaaaatgcatatattttaggacggagagagtagtatatatattcttgcgagcaattttatagtacttgaggaggtaccactttttctattgtaatttggtaccttttggtatctaggtactaggaggtaccaaattttaccctaaatttttggtagcttatggtacctccacagggaatgtaaaattactatggttcgtaaaatccatctatgatatggtattttacacagtaatcgtgatctctatcaaaactacagacactaagaagggaatctctcccttgtgcccgaaacacatggtaattaaatagtgaaaaacactcggtaattgtcactaccacatatcctcacatctattatctatgatgggcttaagtgcgccgctacatatcacgtgtctataacgagtgacattcaagccattagggattagcactgatctataacgactccagttatatggagttgttacatatgtcatctaccaactttgtaacagtttaagttgaggagccgttacaaacgagcccctcatgattgtaatggctttccattatgagccattagaaatggttgcacctcatctgtaatagctcctgtaggagccgttacagatgtatctcctatccgtaatggttccacacattaggagtagttctagatgacttttaggccggtctagctaaccccaacttaaataaaagaaaaacctggccagcccctcccttgcctcacttctccttttcccctccctccatccccatctcagtcaccgacaccaccccccctccccccagcactctcctcccgaacgacagcagccagtcatcgtgttggcgggcctctccttcctctcctcttcctattttgaaacaggcctaccgtactactacctcatgaactctctctctctctctctctctctccacattgaaaggaagcaagtaaaggcaatggtgatgaccggcaacgactgcagctccccgtagctcaggatggtggatctaccagcgaaagatcctaacgacggtggtgggctagcctcggtaccatcagagttgacggtggtaggcctcgggaccgcaagatctggcagtagcaggcagctttggtgagcctcagcaagtggaggactcggcggcgatgatgaaggggagggtgacgacgacgtcgaccacaccgccacagggatccagcgctggtgagtctccttcatcatcaccaccaagtccataccagtgctggtgaagcgcctcccccagttgctcgaccaccgtggcggctcgggcgtggtaactcagacgacgacgatgtaagttcaagtgcaattggattagttttggtgactaatgccaaatccaattatatgatactattatcttttatatataaacatttattttgcatagtctcaattaatatgaaaaataaaaatgatgagaggtacgtgttaaattcctcgtgttctaaattatctctctaatggttcccaaatagggtgaggaactctaaatattttatattggattgtcatccatcaccaaaaaggaaatgatcatattttatattggattgtcatccaacaccaaaacggaaatgatcaaaagatctatggtcaataatgtgtaaatgttgttctggtgatttatgacaaaccaggttactgtgacttacttttttccatgagttggcaaataggttgttctcggatgtcatatgagttgggatagaaatgtatccattgatggttgactttaatctcaataaggatgaaacacatcgaaatcaagctatactctctttacacatgctttcttttcttgtataggataaactcccatggattcatcaaaaattatgcatacacctatttcactcgaaatattttgtatgcatatattttgggggaagtatatcttatattttattatgcatgtgtgtgatccaagttaatcaattttatttaattgagatctttacatttgtgtatatgtgtgagtatatgacatttgtggtgttgttgattttcatcaatttattcatatcattttatatgcgatcggttggtcaacaagtggaggttgactaccagatcattgggactaacagttttattgagttgaatgaaagaaatagataccaagaaatgaaaataatgttgatgctcaagtgagatcaagtcactgttggtatttcttaacgacgttactagaaatataattcccagcaatggcgcagaaatacttctggtatattatggttacagagttcatccgcaagcacacgaatataccattatagcatttcacccgagagtattccaagggtatcgtatttattttatcacgtggaaagatcatgtagagagaactcaactaataatttatatattacttgtgataatcatattctaagcaggggttatgataatccaagggtagagtgacacacaagcttttctacttatcctcataataaataatctaagctaggtggaaagaaaagagaaagagaatctattcctatacttctaatatacatagtatacatacattctagttaactgatatactagctaataccatttatccgatgccttcctggtacttcgagaagccacccctgactgtcgagttctttacgacagcccgtcatgaccatccaaccggggctaaatacagaggaataccctccccaggaaattaactaaggattatatataggcacggaggaatactcgtactgagctgtcaccatcagcggcccacctctcatccgcaatatataaccccaaataatgatatcccgtaatctagacaccacgtctaaattaccagatactactctaatatcatcgtcatgatatagaataattgcataagcaaacactatacctgcaccaaagcatatcccagataagctagcagtatattcagtataacatgaacataatataaagaaggtactcatatactcggaaaatatttcaataccagaaatgtatctagaagagtattctaatgaaagtacaaagcttacaaaagaggaaaggaaagctactagagccatacccgaactcttccgaaggcttccagactcctgattcctattctaattctattccaccagctagatactactaaactaaacttgagaggaatgagagagctcttgcttgaggtgtgtgagtgaagtgaggagaggagctccttaaataggctgccaatgacggttgtggtagttggaatggtcggaattgccctccaaccgttattggggagtgatccatgccgtccagccaaaacctggatccaacagcgtcaagggaggttcggcccaacctcccctgataatatctaacatatttatgtattgcaagcatcactagttctcctttattttgataatattgatggtcgaaactgatcgataatgaccatcaacagtcacgtatgtctcaagatgaagagctgaaacatgggaatcatgtgttgatccacatcaacagtgattgatatcgtcataagttgaaaggcatcaagtggctggaagaaatgaatgtgaccaaacatcataataaatgaatgtgactaaacagagtggtatgcgttgtccagctaagtccacaagaagaagcacaaggcaaaggtataatgaaactaagcatcctttttcaaatcctttaccggtctcggtgtttttaattaaaatctggattgagtataggaatgttgtactggtaagatgaatacaaatgtgtttgcttaagttctcaaaatgatttatctttggacaattgtttatgatggatttgatagccctataaccaacctttacatggaatccaagatcatcaaaatcaaactctggagtaaaaagttcttatatttttatcttagcaacatcacactatccgacctctatcggactgtctaatccatttgagtattcgtgggaggaacttggttctcagtctggcttgccatttaaaatcggagtttcctatgttgggatcaaagtatccgatctagttagttttatagacctgcgatagaatttttgactgttagaggcctaactccgaggtaggagtaagtcatgcctgattttccttcagggatttaaaaatcatttaataatttatttctagaatttatattaaaataaaaagaaatttacaagtgaagttaattcagaaaataacatttcctttaataaatcatgattgggaatatttttctcgtattatccatgccctaaaataattaatataattttctcagaattttcagagatcaacatcaaattttaatagcacaaagtccatttcagagaatatttaaattgaaaaaccaattaaaagtcctcatttccaggtgggccatcatttccgacccactcctcatcgcacgtgaccaatagtagtctggcccacccgctcctccttcttcccctctctctcgcagtcgcaggtcgctcaacatctctctttgtttctctttccccatggcccagtcttatttgctagcccaactcctaactcagcacgccccctccttttggggtcaccaacctgtcagcccatctcacccacacccgattcagcctttcctcccacctcccacgccgggcatgcttggcttgcctttcctcctctcaatgataggtaggaccgaggcccacctgtcaggctcatttcctaccactagccgaagtcgacgaccgctgtagctcccacgtacccacctgatccacgagcaccgctccttccctcactctcaaacaacgcaaatttggtcatcgccatattcacacccacatccccctctctcccgacaaaaataggcgctgacttgagcccacaccctgcccacatcgccacctacatctactgacggttaccgcagctcccaccttgttcatggcccctcaagcctataaaagggaccactagacatccccccccacacacacaccttcacgagctcgccgcaccaaatattgtgttccccatgctgcgtcctcgctccgtcgcttgttgccatcctctgtccaatgctcaccgccgccccatgccacttgtgtcaaaagctttgccatgtcgaggagtgtctcaaccgcctattcctcgaagccaaccgctgccccgaatggcttattcctcatggaggagagctctgtcacaccccaattttcttttggggtttaaaaatcattaaataaatcattcctagaatttatattaaaatttaaagcaatttacaagtgaaattaatgggccgtccacgcgtgctagtcatccgccatgcggttgcagcccctgcgcatctccatgcgcccagagagaaggccccgccaccaccacagtcgggtgagccttccgttgccgccagccgtcacagcccttccgccattgttgctcgtgctgacctccttgccactggctgctacagcatcccgttgccaccaaccgccagggcctcccccgtagacgtccgtgtaggcctcccactgctgatgctccaccgctccagcaactccggccaaattcagcgtggatgttccgtatccaccagtgggactagggcatcgggtctggctgcgcaggatccagatttggctattgatgccccactccctcctcaagcttggatgccttggccaccatccaaatcatctgatgggggccctctcaccgctcctcgccggatcaggacgagcagggcctggatctaggcggcatcacctcttcatccttccttgagagagaggggaaagccctgatgccgccatcctcatggtcggccgactttgccgacgtgccactcgagcagcggcaaggtgggaggaggaagaaggagaagcggcggcggtgtttttcggtcgcttcttgtgtcgctctagggaggaagcgacacgagcgaagggctccagggtggtgatggttctagatggtgcaatcggtcgaggaaacatgaataatgaaatgtagggaatgaaggggattctaaaggagagagttattttaccatggtgaagcaggggcgaaatgtggccgatcacagtggcggtggagaaaaaataggactgcatgctcctggatgccaattaggtgttcaacagaatgtccagtacttgtcgcagaatggtggagccgagctagtgtaagggaaggttgggcaactgtggcgatggtcttttggaagcttggggtgtaggtggatgaaggaaaagagagatgaggcagctaggtggtggtggttaggaaggtgaccatggatgctcgcttgagtttgagctcggtttgggccgagacacggagagtttgggaatttggtatttgtaggctacgaaggcttgcttgagaagatgtggaatggggaggcaacgagacggtgggttccacttgtcggtgacggataggaagcttctggattggattgatggtgaggtggcgtggttgtggtggtgaacaaggagtgttgggtgtccgcttcttggtgttcgatgcaatccattggcgccgaggagggggttggctactcgaccacagattcactgagcggcgggatggacggtgtggcgagatggcgattcttggtgttcgccgttgagtcggcttatccggtgctgtagcaaggtcaagcggggctgaacagtgacagaggcgctagacttctgtgcagaggaggagacggcgccagaaggaggtcgcgcgtggtgttttgggtcaacgatctcgcagcggcagtatggctgagcgggtccgcgcggtggcagtgatgcgggaccagcgacgagacacaatgctgaggcagggccggccgaggtgaggaggcgcggtgatttttctacggagcggagggtgctgctcagtgagatggatattcggtagtggcggcatgctgatctgttgtgttgatgtttggtcagtgatgtgctgtggcagcggggccggggatgagactcgatgacgaggcgagggagtcaaaggaagaacatcagcgagggggatatgggtggtgattggtgcagcacatggggaagggcgatgcagcttggcacgtcacacagtcgggttcgacctgtgttgacgcgaaaaacacacactggcctgggagatctgcttagctccagtacagtccaaaggttgataggatgcgggcgtgccagtcaatttgaccctgcaactgacaagatatacaaatagcagatcaatgagccgatcggctgacaagccaatggagtaattccagccgatatcgatagggttttgagctattggcaatatatccaatgtagataatgatataaaggcagttggctgatgatgatgcaatataacaataatataatccagtagaaaaaccaatcggctaacaatatgatatcatagaacaagtactgatccgatggttaaagcatacatcggctagaggtccgatatcataaaatccacgagattagataaatcaatgaaacctctgttgtcatcggctaaatccaacttatatgtatatgcaatccttataagccaatgcaacgtccaaaaaacttatcggctagtatcctgataaaacactagcatgaacctaaccgatttatattatcaacaatctagtaggtcgaacctaaccgatgcagcacaagattgtatatgataatctaatactcgatgagccaatagatctgtctaatgtgatggatagaacaaatctatttacaacagcattgtgattgtagagatatgtcggctaagacagaagatcagacctaaccgagacagttccaactaaaccgatgtgtctctaaacataatgcaattagagatagaattgagatatcaggtaggcaaatatatcaaccaaaccagagcgatccaagagatcgaagcgatgcagccttgaacaacaccaacgtagccaatagattcactagggccggcggaacgtaggacttaccccttcgccggagattgaactgaaccgatgcagccccgcgtcaggtgccaaattccgccggatgataagtaaaaacctcgggaaagagggtggcgatgcgccgagagtagtattgatcgagagatgatttacaatgacctcgggtgtacatatttatacccatgggtagatactagtccttataggacaagaaagaaatttttctaaagataaaaggaaaacataaagtccttataagacactaaacacactttcctaaagataaaaagaaactaacaaactattcctaattaatagataacttggcatgccgcatcctccttgaactcggtcacttctggataagcttcatttgataaattaattttcttaaccgaatatagcaggaatccaactattgataatgtgataattctcctaggggcttaccaaattttggcgttaacaacttggtgcgaaagatggtggcacagcgcgatgctggctcgagctcggccgagaggagcggtgcggggtcggccgagagaaacggcgcagtggggcatagcgtggactggcccgttgcgtgcgacactgctggcgcgacgcggagctgcccggtcgcattgcgtggtgcaacatgctccgtgggatcaatgagttggacgaatggcgttgcacaagttcagtagtgtgcagcagccacgattcggggaggtgcatcgtgcggtgtccgcgtgcctacacgataagatctatagccttgtcttttaatccctttcttaatcaccaagcagtccgcatgggcctagggcactcggcccaccccatgcttcacggcccaaggccttgccgtgtgtacctgggtaccatgtaccgcacaacatgaaacaagtgaaatcaaagttgacggagcgtggggctcctcaccgggagaccgcgcgggcccccctttgccggttcggccaggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagaccctctccctactctttttccccagtcccctctacgagctcaggtcttctccagtctttttgtccgtcccctctcttggtaggcatggtcctccttttatatctcaaggggataccacatacaccatttctacctaccattcttttgggtggggacccatcctactttgaccaaaacttggctcgtacctttgcctgacaccgggataaccctgtcctccctcattaatgggcggagatttgcaatggctgttgtccgaatgaccctccgatgggatgggtcataccaacctccactccgccggaagcaggtgcaacgtggaagcacggttgtttgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccaacggaacggggcaaggcgtgtgtcagcccgcctgttgccccctaacccgcgatctgaccggtctgtgaccggtcacacactgtgaccgatcacggaccggatgagtgtgctgcactacattaaatgcggcgtggggcgctcgtccaacccgcaataaacgcggttaggtaagcgccgctgtgctcacctaacccacacacgtggcgccaaaccctcagggggtcggggcgccccagccctcggggacgaaacgggagcggcccgacccctcggggagatagagggaggggcggcctcatcaccctcgggcccgacccccccgagggggtcaggccacgtgggtgaccgcggctgccccaaacctctagtcaagatatccccggtcccatgtcaccgacaaaagtaaacagacaccagcctggtaaaaataataaataaatatctgctacttcatgttacagtaactcaatcaaaagcaaaagattagcaattaaatgggattggaattgtatactgtaaaaacaaacagtgggttctttcacagcacattgcttatttgcttgtagcatgatgaagattcgcactcaaataggataaacaccattttttgactgacgaacctttgatagcacattattcagttgaagcattatttaatgattgaaacccaacgtgatgtccatcatgataagttcataatctccattcctaacaacttgaagaatatcagagttgccagtaaaattaactaaattatttgttggaagctatcatataagagcccacgaaagcatgacatgttggcaataaaaagcatatcatgtgagcttgagaaagggagattgggagcccgatttgttgtttctgtcgtttgcacgctctagagtgcgaaggtgggaaaatagtgaggcctccagatatagggatggtggaaaaacagtgaggcgactgattcatgcaacaccgcgcgctcgctcatggcgcgaccagggaaggaccctcacgctcttgtattcatgcaacaacggtgtgactaaggaagctccatgagccctagcctctacatcacagtgccacagaacggcgagatggacaacaccaaaacagggacatcgctgattttgggtccggcgcgcggcggctgatgttgctgtcaccgtgatgcggtgccgagcggggaccgcggcggcaacagggagggaagcgggccgacttttcagtcatcgatgtaggttcaatggaagggatccttggtctactgctatcgtgaagctggcgcttccgcgcttcctccttcagggacaacaatggtagacacagttgtgggagaggggatagtgagggtgatatggtggtcgtcgatggcgagacggtaggagaagggatagctagggattggagcatgaggccatcgcaaggccgcagccgtggctcagagtggaggtgcatgttagggatatagtgggcgcggcgtgattgggggaagcgatttgctgaggatttagctcgcgtggaggaatttgcggtggcagggatcccatgtgtgggctgccattcctttgattcggnnnnnnnnnnnnnnnnnnnnnnnnnnnnnnnnnnnnnnnnnnnnnnnnnnnnnnnnnnnnnnncggaccatcaactct

SEQ ID NO: 356 - DNA, 10145 bp, Oryza sativa
  unsure (1)..(10145): unsure at all n locations
gaggcatgaaatgatactccnnnnnnnnnnnnnnnnnnnnnnnnnnnnnnnnnnnnnnnnnnnnnnnnnnnnnnnnnnnnnnnnnnncaaacttgtggcttggcaagttggagtagtcatccaaacaagtcctaagtacacctgattcagccatatgtttgatatagttgactttaaccattctctgataaaaaattttggaacaaataaaaatttaagtacctttagtgatagaataagttattacaaaataagtaatattatatattttttattgataagataaatgattgcattaaatattttttatgaccggagggagtagtaaactacggtagtaataataattagataaagtgaacaaaataaggagttcatttaatttcgtttgcttatcttaagctgaatttactagggccaaatcccaaatgcttgtcttcttctttgtcatggtcgtcgtccttctcctgcggccgcggcgcgaggggaggagaggaagcccagccgtgcaggcgccggccgtcgcggacgatgtcgctgtcgtggtagtcgtcgcggaagttctcgatgtcgtcgcacatgtcggagatggacgaccaaatcagctccttcttccactgctccgtccgcgggaagccgcagtggcgctcgccgtactcgtcgcagtactccaggtccaagaacaggtcgtgcgtctgccgcttcggcaagccggcggcctccttggcgcggttgtactcctcgacggcgcgcagcatctcccccggcgacggcagcgtcctccgcccggacagcacctgcgccacccacctcgcctgcacctcggcgaaccgcggcaggatcaccttgaccgggatgcccacgaaggagagcgacggcgcgagcgccggtgggaacacgtgctcgtacagcggcccgacgcggttgtcgtcgacggtgaccttcccctccgtagatgacggcgtcggcgacgacgaacgagccgtcgtcgaacaccacccggccgtcctcgcacaggtgttcgaccagtggttgcaggtgaaggttgtcgtacctggcgagcatcttggacatcgacggcgtcatggcctccttcgtcgacttggagctcaggtgcacctccttggcgacgcggaggagctccagggcgacttccttaccgctcaagttgcaaccaacgatgacgacgacctcgccggcgaaggagtccgggacgcggtacgagtggctatgcagctgcctcctcctccacttatccatgccgtcgatgcttggaagccttggctgggagtattgcccggtggccacgacgacggcgtcgaacacctcctccgtctccgcatcggcgttgtgcttgctcctcaccgtccaccgcaacgagccgtcgcgccgtggcggcgccatggcgacgcgcacgaccgtcgtgtcgagcctgacggcgtccataaggccgaacacgtcgcagaactcccggatatacctgaggagctcgccgtggacggggtaccgccgcgcgtcgccgccgccgccattggtggggcggaacgggaagtcggagaagccgcagacctccctcgggctgttgagacggagcgaggagtaaatgctgctgtgcacgccggccatgccgagcgggtcgcggccgtcggtcgccgcgtcgtacagccactgcccgccgacgtcggcgctctgctcgagcaccgtcacgtcgaggccctctcgccgcagctcgcgcgccgccgccagccccgccatcccggcgccgacgacgcacaccttcttggagctccaacccgatgatgatgatgatgacatcttgtccaaatcttgctccctgattgcattcaacgcggcgacagctctccaaatttaatcggttgccaaatctttttcccaccaagcaacaaaaatatctcaatctccttgatgctagagatgccatttggtgcctcttggactacttcaatacctgtttatcatttttattaagataaacacaaaacagctacaagaacgaaaggaattgacaacttacatcaagaatcaggctcccatcggatggcctattcagccaaaaaaaaagccaaattttaaattttcaaacttaattttgatattaattttgagatattttcaacgtaatttctttttcagcattgacttttaagtcaccaagaacacatctataaaaattttatatacaaatttatttttattccctaataagccccgttttgacttattagagaaaaagccaaacgatggggccgtcatcatcattggtgaacagttgagaagactatatacatgtaaaaaacaaggtataatggaaatctcaaatcatcccttagggtgtgttcgcccatccatgttcccaaccgaaatatgcgcggataacggaacggtcaattagcgcgtgattaattaagtattagctattttttcaaaaatagattaatttgattttttaagcaactttcgtatagaaatttttttgcaaaaaaacgcaccgtttagcaatttgaaaaacttgtgcacggaaaacgagggagatcggttgggaaaatagggtgccaaacacccataagagatatccctttttcatgtcacttaaaaagtcattaaaaaatttagtaggatagattaatatatgatatgtcacttcacaaatatacatattaaaattaaacttatacaagtaaaaccaaaaataacaaatttgactatgaatagaaagcgtaattcacagtcaaatttgttatttttgtttcaaattgtataagtcgaattttaactcgcatgtttacaaaaagatatatcatatattaatctatcttaataaattttttaataactttctgaacgccatacataaaatgagaggatgtcccctcaaaggacaaaaatccatttccagggtataataagaaatcttatacgatagaactattccttttacaaaacatgaaccaagggaactctaggagttatcagagtgaatcggcaacttttgtcctatcaacaaaaaaaaaaggaatttcgatcgtttaccaaaagaaaaaacaataccaataccaaaagaaaaacggggctaccaataccaaaggctggcccagcatgacttcgaacgtgtctatacaggatggtcccacagctaccaaccgtgggctcgggccgttcgtcggtcgcaccagaatgcaaaacctggtcgaacccaaccgccttcgtccggtccggacggatccgaacccaaagtcggcgggcgggatgcctcaaacccatccccgcctcgttggcgggaacggagccccgcccacttccctcttgctaaatacgcttcgtacgcgtggtcttcggtaggccaccggaactgtgaccctgacgctgggacccactgaggaaaggctcgccatggaccacgttcacgggagaatccctcgcgctcgtgctcccgagaatttcatttcgtgctgcattttttcacatgcatccctgacacgtcagtatttcgttccatagcctccgatcggctatgaaggcacttccacttttgccgctggtagtatttctttttgagacagacatatcttttgctgctgtcctcgaggattttgtagccaagcccgaaaacttttgggaaaattagtatcaataatgtgcttttttgcttaattaaaatttataatattttctctacgagttcacatagttatttttcagttaggactcaatagaagcaacgaggcttaattatgttgaattccactagagattacttttatttgcagtactagtagaatttagaatgaaataaatagctaatacttcagaaagtcacgtagtttgcattatgtcctggcaaaaaaaaaaatcaaaattttagaacgaatgtaagattaatatgcaatactgcaatagaaaaggggcaaaatgcaaactgccaaaaaattgcggatacaaggccactcgtataaattagctgcgctctcctcccttttcccccaaatcgctcggtccttcgaacccccaccgcctccgtcgacacattccgcgctcgaatcgaatctacgaaaccctagcccgccaccgccgccccaatggcgaagccggtgaagtacgacgaggaggaggaggaggtctcgtcctccggcgaggaggaggaggagcagtcggacggcgccgggtccggatctggcgaggaggaggatgaggaggaggaggaggcgcccgcggcggcggccggcgaggcggctggtggggaagaggaggaggtggatgaggaggagatcgaagccgtcaccaccggtgccggcgccgacgaggaagaggaggaaagcggtgcggccgccgccgcccccggggagggcgatgaggagtcgcagtccactgaggacgacgaggccgtcgtgggggaggacgacgacgcagatgaggtgagctgagggggctagggtttgggtggtcgaaccgggattcgggtggtgcccattagatttataatattttggtaatatattgagctgcttctgtaaattgtacgagtttggggggccatttcctatgcctgcattttttttctagctttgcctctattttgttgtcagtgaattaaggttgtgttaacagtgggagtttccttgcattatgtgctgcaatgtagctgtcatttaagtgtcattctgtgtatttctacgcaaaattattaggagcaataagtagggtttagtttctgaattgtcgagtcctgcctaacttttcccattacaggctgaaggaggtgcagtagtagggaaacgtgagaaagccaggctcaaggaaatgcagaaattgaagaagcagaaaatacaagaaatattggatacacagaatgctgcagttgatgctgacatggtttgctcctataagaatccgtcaatacaaatgcctttcagcacatgatatggcatatcatgtgcacataatttatttcaacctgctttgaatacctttgtgtatgttgccttttgccctgattaatatttttttaacagaacaataaagggaaaggacgattgaagtacctactgcagcaaactgaaatatttgcacattttgccaaagggaaccaatcaaaagagaagaaaccgcgtggaaggtaaaactggttttgtttgtgtagatagtactttactttgtgtgttcaaccatcctggaaattgcatagatctttgctgttgtttgtcgtgctgctggaactgggatataatttagaatgtgtactttgatgctggaatatgttaaaataattccatactgaaggactggtgtttcaaacgtacatggtaaacatttctgtttgatatgtttgtagatatcagtaattgttggtctcttcatctggttggtattacgaaattgtgaattaatgattttaagaatgcaacataatgtttattttaactatattattattacttcaatttgtgggattaaggaaattctgaatacatttgtttagccatacaattaaccttgcatagttatagttcttatgggcatttgggacacatcacctgctatttatgtgcagggtcataatatgtaattgattttaggaatcttgtgcctcttttttgatgttccatgatttgattgtctaacattggtaaactgtaggggacgccatgcctcaaagatgacagaagaggaggaagatgaagaataccttaaagaagaggaagatgcccttgctggttcagggggaacacgcttgctttcacagccttcatgtgagctcctttcccttcacaattatttgtaactgtatcataagagtatgctgccaccattctgttaatataagttgaataataaattgttaaaatgtaatatattttttgctctgcaggtataaaggggaagatgcgagactaccaactagctgggcttaattggctcatacggttgtacgagaatggtatcaatggtatattggctgatgaaatggtatgttagttgtgtactcctaagccaaagtcaataaaatgtccccaatatattattgaatgatactgtgcttatacttataaaatcatcattcagggtcttgggaaaactcttcaaactatttcgctgctgggctatctgcatgaattcaggggaataactggtccgcacatggttgttgcaccaaagtctactcttggcaactggataaaggaaattcaacggttttgccctattctacgtgctgtgaaattcttagggaatccagaagagagggttagtttacttagcctccgctctccaaccattcttatgaacaacttctgatgttgtactgaacattttgcattctgtttggtcagaaccatataagggagaacctattgcagccaggaaaatttgatgtgtgtgtcactagttttgaaatggcaatcaaagaaaaaactacactgaagcgtttcagctggcgttacattattattgatgaagcacatcgcataaaaaatgagaattctcttctgtccaagacaatgaggatttataatactaattatcgtctccttatcacaggcacaccactccaggtaggtctcccctggctgtgctctttttttggactgtagccatggtcaaagtaattatgttggtttacatcctcaagcatttttttgcttttattctgataattcgttgatgctatgattgatgtttgcagaataatctccatgagctttggtctctcctcaacttcttgttgcctgaaatatttagctctgctgaaacatttgatgaatggtttcaaatttctggtgaaaatgatcagcaggaggttgttcaacagcttcataaggtgagtaatataactcccatgctcaatggctcattatgctaataatttgggacaacctgcatagttcattcatgtaaattcttctatgaaggttcttcgcccatttcttcttcgaaggcttaaatctgatgttgaaaagggattaccccccaaaaaggaaactatccttaaggttggaatgtctcagatgcaaaagcagtactatcgtgccctgcttcagaaagatttggaggttattaatgctggtggtgaacgcaaaagattgcttaacatagccatgcagttgcgcaagtgctgcaaccatccatatttattccaaggagcagaacctggtccaccttacacaactggtgaacatctagttgagaatgctggtatgttcatgtcacaatttccattgtactgttgccaaaggtacagttcaatatttaaccttccctcctcacaatatctgtaggaaaaatggttctgttagataaattgctgcccaaactgaaggatcgtgattctagggtgctcattttctcacaggtgattatattccatcctcatgagattcaaatggcttttatactacgtgcattgattttatgatacttagctgtgtataacatgtacataattcatgtgtggatatgatctgagttctctattgttcctaagcatgttaacgtcacacataatttggtttcttcaaatcttgtgtttgactttgacatttatgtccattctacagatgaccaggcttttggatatattggaagattatcttatgtacagaggctatcagtattgccggatagatggaaatactggtggagaagatcgtgatgcatccattgaagctttcaacaaaccaggcagtgaaaagtttgtttttttgctttcaaccagggctggtggccttggcatcaaccttgctactgctgatgttgtggttctttatgatagtgattggtatgctgttatgtgcaaattgttttcttctgaacccatgaatatgtatgttgaatatttagtgttaatgtgttgatgtcttcaggaatccacaagctgatctgcaagctcaagaccgtgcacataggataggtcagaagaaagaagttcaagttttccgattttgcactgaggtttgtcaatcttttctttagaatattacgtaacaatcttttgtattgatatctaagataggatgacgaaaacttaatttcagtataccatcgaggagaaagtgattgagagggcatacaagaagcttgcattggatgctttggtcattcaacaaggccgactggcagagcagaagagtatgtttttgctgcttgtattttatgtttaagaaggcattcatgcagtagtaagatatggatttattttgttcttctttcagctgtcaataaggatgatctgttgcaaatggtaagatttggtgcggaaatggtattcagttccaaggacagcacaattacagatgaggatattgaccgtatcatagctaaaggagaggaaacaacagctgagcttgatgcaaaaatgaaaaagttcacagaggatgctattaaatttaaaatggatgacagtatgtacccttctcccgcagtctctttctttctatcactcaggtctaacttagtctttttatgcagctgcggaattgtatgattttgatgatgataaggtaacaatctcttactttatttctctgctgtcagtttggaagtttacttaattccatttacattcttgatttcttgaaggaggaaaacaagcttgattttaagaaactggtcagtgataactggatagagccacctagaagagaaaggaagagaaagtaagtctctatctctatgtgtgcatgcacacgtctggtgctcaaactgacctaattttgtttgttactctagctactctgagtctgaatactttaagcaagcacttcgccaaggtgcacctgcaaaacctagggaaccacgaattccaagaatgccgcacctgtaagttttctcttgcctctttcattttgtgaaaaaaaaatcatgattaccttgtttgctctctttagaactactgtcagctcatattgtttttgtttgtcagacatgatttccagttcttcaacaaccaaaggctcaatgaattgtatgaaaaggaagtccggtaccttatggtaatttcctagctaaaatgcttgtattgttttgctagatgttgagaaactagctcttggactccatgttgtgtctaatgtgccagtccgattaaatagcattgttcccgtactcagttaattgtttgccaattattattgataatcccaatgctaacttgagaaaaattattccagcaagcaaaccagaagaaagatactattgatggtgaagatgaaggtaccgctgattctcgctttctaagttataattgtgcataacatcatccagctcaatcatgctaatgtatataatacttgcacgatactcagatcagctggagcctttgactgcggaggagcaggaagagaaagagcagttgttagaagaggtaggtggcaatgctttctggatttccttacctgcctcttttgtccatacttgtctttaactctggttttgttttcggtttgcaaaatcatagggttttgcaacatggacgaggagagacttcaacacatttattcgtgcatgtgagaagtatggtcgaaatgatattaggagtattgccgctgaaatggaggggaagacagaggaggaagttcaacgatatgctaaagttttcaaggagagatacaaggaactgagtggtaagcaagtgtttcaattgagtatacatgattaataaattgttaattagtacataaatcttcaccaaacagctaatttcttatgtggtgaatggtgagttgagaactgaagattattggctgatcattattattgactgtccaaccagattatgatagaattatcaagaatattgaaaggggagaggccaggatatcacggaaggatgaaattatgagagccatcgggaagaagttagaccgctataagaatccatggttagagttgaaaatccagtatggacagaacaaagggaagttctataatgaggaatgcgaccgttttatggtatgctctatcataccatctcgctttctgcacacatttgttttcaaacgtgacatgtctaattagttgtcacatttcagctttgcatggtgcatnnnnnnnnnnnnnnnnnnnnnnnnnnnnnnnnnnnnnnnnnnnnnnnnnnnnnnnnnnnnnnnnnnnnnnnnngatcttcacccgtg

SEQ ID NO: 357 - DNA, 999 bp, Oryza sativa
  unsure (1)..(999): unsure at all n locations
cattccacctataagaatagtttcctttttggggggtaatccctttccaacatcagatttaagccttggaagaagaaaatggcgaaagacctttaatagaagaattaccatgaatgacctatgcaggtggtcccaaattataagcataatgagccattgagcatgggagttatattactcactttatgaagctgttgaccaacctcctgctgatcattttcaccagaaatttgaaaccattcatcaaatgtttcagcagagctaaatatttcaggcaacaagaagttgaggagagaccaaagctcatggagattattctgcaaacatcaatcatagcatcaccgaattatcagaataaaagcaaaaaaatgcttgaggatgtaaaccaacataattactttgaccatggctacagtccaaaaaaagagcacagccaggggagacctacctggagtggtgtgcctgtgataaggagacgataattagtattataaatcctcattgtcttggacagaagagaattctcattttttatgcgatgtgcttcatcaataataatgtaacgccagctgaaacgcttcagtgtagttttttctttgattgccatttcaaaactagtgacacacacatcaaattttcctggctgcaataggttctcccttatatggttctgaccaaacagaatgcaaaatgttcagtacaacatcagaagttgttcataagaatggttggagagcggaggctaagtaaactaaccctctcttctggattccctaagaatttcacagcacgtagaatagggcaaaaccgttgaatttcctttatccagttgccaagagtagactttggtgcaacaaccatgtgcggaccagttattcccctgaattcatgcagatagcccagcagcgaaatagtttgaagagttttcccaagaccctgaatgannnnnnnnnnnnnnnnnnnnnnnnnnnnnnnnnnagattagtcaatcaatgcgcg

SEQ ID NO: 358 - DNA, 809 bp, Oryza sativa
  unsure (1)..(809): unsure at all n locations
catggattttgtgtgacagccntttgcanannncnnnnnnnnnntnggnnaaaananncccctcttacacggnccancctttctatatcaattngtcacctgccttttttatttcacgatccaacaatgggaaacgcgatgtcaggccacaagggtaagcagatcctaaatcaacgctatatatatatatatatcatccagtacgtacaaccacacatctctactccttaaaaaattcaaattggtgttggtgatagtgaagccaaagcagatataggatctaacatacaaagcagacatgcgatccaacatacaaaccatcgacacgtttggagcgacaaaaataaaagaagacgtacacgcgatccggaacaaaaaaaaaaatcgtaaaaaacagaaacgccccgcaacctgcgccccctccttcgcgcgccttcatagccgccccgcaccctcccatcgcctctcctccgcgctgcccctccaccagcaggcggggcggtccatcgacgccccgcgccctcccctcgcctattctacgagccgcccctccaccagcagccatattcacaccgcgccggcgcccctttccttttcacccgcgccgccgccgcccctagcctacccaccgtgcctttacccctagccggagaggcgccgccccttcaccttcaccagaagccgtgcccacaccgcgccggagacccttggcttcccaccgtgccttcacccctagccggagaggccgccgcccttcaccttcacagaagccgtcccacaccgtgccggtaccctcggttttcacccgg

SEQ ID NO: 359 - DNA, 1245 bp, Oryza sativa
  unsure (1)..(1245): unsure at all n locations
acttctcggacattgantgtatgacggatggtgaaccacgatctaantctaatgactgttgattaaatattaggacctagactcggcgtcgttggagccntnnnnncnnnnnnnncnnccgggttgttgatcagnnnnnnnnnnnnnnnnnnnnnnnnnnnnnnnnnnnnnnnnnnnnnnnnnnnnnnnnnnnnnnnnnnnnnnnatgtttcagcagagacataccctcagcaatgacatgctgcacagaagtaacatttcaaggagattggaatatttcagcagtgcagcatgtggagcataatgagacaattcaatacctccttaaatattttcgatactggaagcagcccgtcagttatcctagagaagagcctaaacatccttgctagatcctcggtctacagtcagaaagcaaaaaatagtcagtaaattgattgccagcgatttcctcattttgcaacttcacaaaccagagttttttttttcagtgtaatgcaaccttttcatcacaaagcaacactttgcatccggagttctccttgttcagaatttcttctgcacgcctatctatcaactcgaagagtgcagcctgaaagcatttaggttgaagggtacaatttcagaagcacagaaagtcattgcatgttttacatgcatcattgaaaagctgccaagaaacatcaaacatataactgagacaaaccgcaaatagctttggttctgtagtagaatgcaagtaatttgcaacccggtctttctctttttgtaagcattcctcagcctattaagcacataactagtaagagggtatcgttaaacttagcagcaatgtaaatttcagaactccacaaataccttgagcatgtattcagggcaagaattctcaagaatccatgtttgtgccttcttagaatagtaatctgttgttccgttgagaaatgattgttcaaaatcatcactgtaataattcagttgactatccccaatttcaacatagatatcaagggcattcttcaggagtggacggtctattagattgccttccctctcatcatcaatctattaaataaaagaaattagtagtgatcaagttagctctgtagaatgcgcacgagattaagaagcggagggcaagctcaccatgccaatcataannnnnnnnnnnnnnnnnnnnnnnnnnnnnnnnnnnnnnnnnnnnnnnnnnnnnnnnnnnnnnagacggaggtgtcctaccntggccgt

SEQ ID NO: 360 - DNA, 726 bp, Oryza sativa
  unsure (1)..(726): unsure at all n locations
ncggatgactgcagttgtaacgngcnnnnnnnnnnnnnnnnnnnnnnnnnnnnnnnnnnnnnnnnnnnnnnnnnnnnnccagtgattagcagtagattagaggtattttccacttacttggaatggactctttgaataccaagtggatgtcgcagtggggtgatttggacaggaaggccgcctgccccatgtactgcagcaccaagcacgggtagatgagccccacgaacgcaacctgtcaacaagtgtacgtacgtacgtgtcaaacaaatgtcaagatatttaacctgctcttaaaatcaatctgcattatattaaacgagacgcagtactgcactatcagtgctctgacagcaagcataaacagacacatatacccttatggatgcagctgtgaagtggccaagatccccatacatgggtttggtccctgcacatacatacatatatatattattataaaatatgtagttgatgagtcgcagtgcaacgagcaaaataaggtttgtttgcctgtcatggagaggagaatttccccgagggagatccagccgtccttgccggtgtgctggaagaacctgacgaggtattaaggggagagggcgcgcagcacccttgggttccacaccacgatgttgtagacgccgagcgcccccaggaggaggagccagacgatgaccaccggcgcgaacaggaaacccccccctgtgcgtgccccagtgctgg

SEQ ID NO: 361 - DNA, 783 bp, Oryza sativa
  unsure (1)..(783): unsure at all n locations
gagcgccttgattnnnnnnnnnnnnnnnnnnnnnnnnnnnnnnnnnnnnnnnnnnnnnnnnnnnnnnnnnnnnnnnnnnnnnnnnnnnatgtcggctaagcagaagatcagacctaaccgagacagttccaactaaaccgatgtgtctctaaacataatgcaattagagatagaattgagatatcaggtaggcaaatatatcaaccaaaccagagcgatccaagagatcgaagcgatgcagccttgaacaacaccaacgtagccaatagattcactagggccggcggaacgtaggacttaccccttcgccggagattgaactgaaccgatgcagccccgcgtcaggtgccaaattccgccggatgataagtaaaaacctcgggaaagaaggtggcgatgcgccgagagtagtattgatcgagagatgatttacaatgacctcgggtgtacatatttatacccatgggtagatactagtccttataggacaagaaagaaatttttctaaagataaaaggaaaacataaagtccttataagacactaaacacactttcctaaagataaaaagaaactaacaaactattcctaattaatagataacttggcatgccgcatcctccttgaactcggtcacttctggataagcttcatttgataaattaattttctttaaccgaatatagcaggaattccactattgataatgtgataatttctcctagggcctaccaaattttgggcgtaacaaacttgtgcgaaagatggtgcacaacgcgatgtn

SEQ ID NO: 362 - DNA, 757 bp, Oryza sativa
  unsure (1)..(757): unsure at all n locations
cgggnnnnnnnnnnnnnnnnnnnnnnnnnnnnnnnnnnnnnnnnnnnnnnnnnnnnnnnnnnnnnnnnnnnnnnnnnnnnnnnnnaataatgaaatgtagggaatgaaggggattctaaaggagagagttattttaccatggtgaagcaggggcgaaatgtggccgatcacagtggcggtggagaaaaaataggactgcatgctcctggatgccaattaggtgttcaacagaatgtccagtacttgtcgcagaatggtggagccgagctagtgtaagggaaggttgggcaactgtggcgatggtcttttggaagcttggggtgtaggtggatgaaggaaaagagagatgaggcagctaggtggtggtggttaggaaggtgaccatggatgctcgcttgagtttgagctcggtttgggccgagacacggagagtttgggaatttggtatttgtaggctacgaaggcttgcttgagaagatgtggaatggggaggcaacgagacggtgggttccacttgtcggtgacggataggaagcttctggattggattgatggtgaagtggcgtggttgtggtggtgaaacaggagtgttgggtgtccgctttttggtgttcgatgcaatccattggcgccgaggagggggttggctactcgaccacaaaatcactgatcggccggatggacggtgttgcaagatggccattcttgggggtcgccctttaagccgcttattccgtgctgtaccaagggtaaagcg

SEQ ID NO: 363 - DNA, 1935 bp, Oryza sativa
  unsure (1)..(1935): unsure at all n locations
ccccggtaccgaaccaatttaaagggtggggacctcccaccgacgggcgcccttgcgccaaaacgattgtcaaccaccccggctttaggcggcggtttttatccctcaccagttaacaaccgtctctccctcccagtctaaaaagatccttcccgcatatggacacaaattccactagtatcgcttcccctcccctcacaatcgcgttcagctcctgcaacacctcgaggtcgccaccgccagcactcatagacatagagagatggaatacgggaagagacgtagatatggatagggtttggtcgagggtattttggtcattacaaaaattaattgtatttctttcttttttaaaaaatgaaaacttaacagtgttaaaaaacagggccaaacggagtgttcgttttaaaaatgtagggtcaaataagcaaactagaaaaagtagggtcatattggtagttacacttcaaaacagggtcaaataagcaattgtcccatactaaataccatattaacacagccttaacttttgtattcattcaaacggttgtatctatctattgatacattaataaatatattcgtcaaatgaattttttttcagtcgtatagagtatcatgaatatacttctgaaatgattgtaacaaaagttttgatggatagacttaagaggtgattcattacctaatgcatatgtaaaaagccaaactgcctttctaataaataatgtatcatggaggcctgttctcgaataaacacgatcactattacccaacgcccaaaaaatgttaaactctcaacaaaaccgtccaagaagagctgcaatgttttacaagctgatctagaaatcatcccaacacatcgaaaaactgtaatttgtacaagcagattgaggagtgagcaatcgagtaaacgagctaaccatgggcaatgagatcgacacctccgtcttggccttcttggcctcgaggctccagatgcactactcgaaaggtaggccatcacctcatcgtgaggcggcggagatggcatggacgccgggagatccaagctggccagcggcgggggatcccccccatctacgtgcgcctcctcctagtcctgcctcccctgcattgcgtgcactcggacaccgcagcgctgttgagttatgatccaaattcatttgcacttaataaagaccagcttctgccgaagtaaagcggaggcccgtcgccggaggcttgggccacccattgggttctgcggtacggattgtaatacctgttagggtttcacctcatatatatacctcttgtaagccgctgtgcggtgttgtaccctcaccccgatacagtgaagatattttgctggctggcgctagtggtttttttctttcctactttgagaggcttttttcacgttaaatcttgtgtcttctacgattaatctactattctttgtcgtttgtttgcccatcgttttctaacgagcgctgcctctgacttgccactgccgtgttgagcccagtgctgccaagcgccggccaccgcctacatgtgccttcctttccacggacaggctcggcggctcccacgacctgaatggaaggaaggagatgccattcgatatgtgatgtgcactatatatatacctggatgaaatatgcagagcactctttcttgtcctaataaagtacgcacgcaaggcgtgctattgtgctacgtgcttagcgtataagctgttgtaagtacagccagcacagatagtagggcaggctagggccgtgttccaatgcaatggtttctagcccaggtcaggttatttcccgtagagcacgctttacatactgctaggcggtgcgtcatcagctannnnnnnnnnnnnnnnnnnnnnnnnnnnnnnnnnnnnnnnnnnnnnnnnnnnnnnnnnnngaagtgaaagtcaatccctcg

SEQ ID NO: 364 - DNA, 1236 bp, Oryza sativa
  unsure (1)..(1236): unsure at all n locations
ngaaggataccccttattacaactagtagcagttgtgtcatcgtcacgtgacagtcataagacattaggtttgtgaacttcttctccttcgtgctgattattcgcttgatattcgtgaagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatataaagttctttttccacatcgccgcgtgaccatcttcgctctttatatgctggcttccaggcccctttccgaacactactttaagatctttaaccatagcaaacactgttttcccgctgcgatgtttaggtttcgtacggtggtcggccttatgttcgaagtgctcgcctttcttccgtaccgggtggtttgctgcaagaaatcgacgatgccccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttcctttttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgccaaccatcggcggggtgtctcagcatcccgtcctgttgacgctcttcagcgtgccatcgcaacattctagcattccccttgttcgggtaccgagctcgaatgtcgcaaaagagtaataagtctcatcac

SEQ ID NO: 365 - DNA, 958 bp, Oryza sativa
  unsure (1)..(958): unsure at all n locations
nggttctgctccttggaataaatatggatggttcaagcattggcgcaactgcatggctatgttaagcaatcttttgcgttcaccaccagcattaataacctccaaatctttctgaagcagggcacgatagtactgcttttgcatctgagacattccaaccttaaggatagtttcctttttggggggtaatcccttttcaacatcagatttaagccttcgaagaagaaatgggcgaagaaccttcatagaagaatttacatgaatgaactatgcaggttgtcccaaattattagcataatgagccattgagcatgggagttatattactcaccttatgaagctgttgaacaacctcctgctgatcattttcaccagaaatttgaaaccattcatcaaatgtttcagcagagctaaatatttcaggcaacaagaagttgaggagagaccaaagctcatggagattattctgcaaacatcaatcatagcatcaacgaattatcagaataaaagcaaaaaaatgcttgaggatgtaaaccaacataattactttgaccatggctacagtccaaaaaaagagcacagccaggggagacctacctggagtggtgtgcctgtgataaggagacgataattagtattataaatcctcattgtcttggacagaagagaattctcattttttatgcgatgtgcttcatcaataataatgtaacgccagctgaaacgcttcagtgtagttttttctttgattgccatttcaaaactagtgacacacacatcaaattttcctggctgcaataggttctcccttatatggttctgaccaaacagaatgcaaaatgttcagtacaacatcagaagttgttcatnnnnnnnnnnnnnnnnnnnnnnnnnnnnnnnnnnnnnnnnnnnnnnnnnnnnnnnnnnnnnnnnactgcagatgaatgtcaatgccagt

SEQ ID NO: 366 - DNA, 1221 bp, Oryza sativa
  unsure (1)..(1221): unsure at all n locations
cggctggattgacagncnnnnnnnnnnnnnnnnnnnnnnnnnnnnnnnnnnnnnnnnnnnnnnnnnnnnnnnnnnnnnnnnnnncattcaaccctccactaaagagtatatcgaacagggctgatgagaagatagctaatattgtgtgataattaagtgtgtgtctgcatgtgtgtacgtgccggcatgcatgcatgcatgatgtttgagcacgtgcatatatggtatatatgctcgtgtattttgtttgaataacgccaggccaggagggatgaaagagaaaatacgtagtgcaaataatatatgtaatggaaaccccnncccctctccggggatcgccttatttacttatcagggacatcctctcattttatgtatggcgttcacaaagcttttgaacactttcttaacactgactaacatatgatatatcctttttgtaaacatgccagtaaaattcgacttattccatttgaaacaaaaatcaccaattttactgtgaatacgctttctattcatagtcaaattgttatttttggttttacttgtataagtttaattttaatatgtatatttgtgaagtgacatatcatatattaacctatcctactaattcttttaatgactttttaagtgacatgaaaaagggatatctcttatgggtgtttggcaccctattttcccaaccgatctccctcgtttcccgtgcacaagtttttcaaattgctaaacggtgcgtttttttgcaaaaaaatttctatacgaaagttgcttaaaaaatcaaattaatctatttttgaaaaaatagctaatacttaattaatcacgcgctaattgaccgttccgttatccgcgcatatttcggttgggaacatggatgggcgaacacaccctaagggatgatttgagatttccattataccttgttttttacatgtatatagtcttctcaactgttcaccaatgatgatgacggccccatcgtttggctttttctctaataagtcaaaacggggcttattagggaataaaaataaatttgtatataaaatttttatagatgtgttcttggtgacttaaaagtcaatgctgaaaaagaaattacgttgaaaatatctcaaaattaatatcaaaattaagnnnnnnnnnnnnnnnnnnnnnnnnnnnnnnnnnnnnnnnnnnnnnnnnnnnnnnnnnnnngaagctgaagtcaaaactctc

SEQ ID NO: 367 - DNA, 784 bp, Oryza sativa
  unsure (1)..(784): unsure at all n locations
cgcgctttgatgacagccnnnnnnnnnnnnnnnnnnnnnnnnnnnnnnnnnnnnnnnnnnnnnnnnnnnnnnnnnnnnnnnnnnnnaatggaaggaaggagagggaatttgggatgtagaaggaagaatagagagagagtggaggaagtatgacaggtgggtctttcttttctttgatgcttgggatgccatgtccgattagattggacttaaataggactcaatgtggacttattccaagcagtagcggtagtagtgcaggccttgggccttggcccatgcagcagcaaatagcctagctaggtactcccaatagagcagcaagagctagcaaacagatcggcagcagcagctaaagtttagtcctatttggagagaatgtcaccaacttagaaaactagaaaagagatggatgctgaggatttaacactggttcgaacgatgacgaaaatacggtgttacattgtgggtgtgatctagcaattttaggaaccggtaaaccttagattccacaaataaagaaaaagtcgactcgaaacatgggatgaatcgaccaatgctttgagcaaccccatcaccccaaaacccatcggcattcaagaaaaaaaaatcgcaaaaaataagcatcagctctaatcgagccaatgctttgagcaccccatcaccccaagatccagcagcattcacaaaattaacatccaaggacaagatcattgaatcaggatcaagaagaaaatgatatttacacctgaaccacacaaattcatgaacgattaaaatcaag

SEQ ID NO: 368 - DNA, 771 bp, Oryza sativa
  unsure (1)..(771): unsure at all n locations
cggcttgatgacatccagttctcnacnnnnnnnnnnnnnnnnnnnnnnnnnnnnnnnnnnnnnnnnnnnnnnnnnnnnnnnnnaccatttctgcaggtagatttatatcaaaagatttgtaacttggccaaaatcctgttgtgaggacagtaacagctaaggctattccaggattcaactctgagtgtgtgcttatgaactcttcaaatttagcctggtgatctcttgccacagtgagatcagtaaccatgccctccattttggaagtgaactgccctccacattgttgctttagcttggtaaggatgcttctctcatgttcatcattagcactcttgtcaaaaagcaatctccttgcaagcttctttctgcaaatttagccccagaggttaacaactgcatgaatccatgcgcaagaatttaaagacaaaaagaataagcatgcaagataataacagcttacctatagaactcagcaaacaagtccttgtcactaatgtaggcaagtaaccttacaacctggtaatcacccattcaagattaggacttactaatgacactaatagatcaaacataacaaattgatggttgtaccttctcaagggtatcttcaattgcttcatcactaagcttttcactaccgcctttctttaagatattgtcacagaaggtagctagtaattcagcacttgaactgccagaaacacctttgttgcaaaaaacttcaaaaggcttcttaagtggctgcataaaccggatacagaacatgan

SEQ ID NO: 369 - DNA, 780 bp, Oryza sativa
  unsure (1)..(780): unsure at all n locations
cagagcaatgggnnnnnnnnnnnnnnnnnnnnnnnnnnnnnnnnnnnnnnnnnnnnnnnnnnnnnnnnnnnnnnnnnnnnnnnntagcagaataaaccgaaaaccccctttggcaataattcatcatcgcactaagaacctaaacgtgcagcggcgaaatcgagcagccgggtcgcagaaaaaacacccaaaacaaaaaggatgggagattaagagcagcacacgtacgacggattcgatgtgatcgtccagggcctgcttgtagcgatcgtagagcacctgcgagtagtcgttcggcggcttctgcgtgcacatgttgtaaaccgtcctgccacggatcagccgtaccagatcagatcaaatcagattggaaccaacaacgaacgaacaaaaaaacccccgcgaatccgagagaacccaagcggagaagacgagcgagcagattggggaacgtacgtgtagaggtgcatgtactcgtcggggacgaagtgcacgacgttggagccatcgaggatgcacttgagcttggcgacgccggcgagcacgtcgcgccacccgtcctcgaggtccaccaccggaatgcgcggcgacatattcattacgcctacgccgccgccgtcgncaccgtcgacgngcgcgaggcttgtggacgaaagaggcgtggggcgagggttttggtggggtttggggtttcttcgattcgatcaatcgatctcgcgggggagacggcggaaataaataggggaggaaacgggggtcgtgtggggcccttctggtttn

SEQ ID NO: 370 - DNA, 1155 bp, Oryza sativa
  unsure (1)..(1155): unsure at all n locations
agaggtttggtnnnnnnnnnnnnnnnnnnnnnnnnnnnnnnnnnnnnnnnnnnnnnnnnnnnnnnnnnnnnnnnnnnnnnnnttgctacctatgaagtatgccaaaaaccaaataatttggcatgacaaattatttggatataaaacaaatggatgacagtttttgagtaatgccaagtatttggtatggttaagtttagtattgaaccaaacatgcccttacattgtgcaaaagatgtggttgggtcatgtccatcaaaaaatacactaaaccaagtaagacacgaggagaaaaaacgcgcaaacaatggtaattgggaggaatatatatcgaaacaaggtgagttaagacatggaatttgtaacaagtcgttttacatgaagaaatctcgaacttaggatgatatatttagggtgatttttgcaatcttccctaaattaaataagcacgtatttctccatatattgggcctgtttagttcgcgaaaagaaaatttttgggtgtcacatcagacgtttgaccggatgtcggaaggggttttcggacacgaataaaaaaaactaatttcataactcacctggaaaccgcgagacgaatcttttgagcctaattaatccgtcattagcacatgtgggttactgtagcatttatggctaatcatggactaattagactcaaaagattcgtctcgcgatttccctctaactgtgcaattagttttttgatttatctatacttaattctccatgtatgtgtcaaaagattcaatgcgatgtttttaggaaaaagtttttgggaactaaacagggccataatacgaagaatgaaagtaataatctgataaaataataaataatcagtagaattaattacgggtacagggtcactggaggagctactacaggcatgtgctgctgctggcgtaccagagctgcggcgtggtgtacggcgacctgagcacgtcgccgctgtacgtgtacaagagcaccttcattcatcgggtcgctccggcggttccaggacgaggagatcgtgttcggcgtcttcttcctagagatctgacgcttacccttattccgctcctcaagtacgtcttcatcgtgctcgcccgcgacgacaacggcgaaggcggcacgttcgcgctctacttcctt

SEQ ID NO: 371 - DNA, 1959 bp, Oryza sativa
  unsure (1)..(1959): unsure at all n locations
agaggtttggnnnnnnnnnnnnnnnnnnnnnnnnnnnnnnnnnnnnnnnnnnnnnnnnnnnnnnnnnnnnnnnnnnnnnnnnattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccacgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccatttttgcctttcattgcaacaactccagagtggtatccaactttttgtgcccctgctcgcaacctgggtacaatgaagttctgtggtcctccaacatcttgtccaatttatgcgcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcatcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggatcgcctgtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatatatatataggggtgggactttagtcccggttggtagcaccaaccggggctaaagatcaccgggatctttagccccggttggtgctaccaaccgggacaaatgtcccacccctatntntttttttgtcttcctcccctccagctgcccgggctngcttcaanttttttctttttgtgggggggccctgccccaatttcattgagtggtttcggtggtaaactccaattcggggtgccttagagtttgccactccttcccccaaggtttcttaatgactaccagagctgccccaagttttccccccttttttgccccaaaatttaatttctggtaacattgagaaaatcttttaaggtttgaaaaaatt

SEQ ID NO: 372 - DNA, 1239 bp, Oryza sativa
  unsure (1)..(1239): unsure at all n locations
tttttattgttttacctccaaaacaaagacagggtggcagttcgcgctatacgcccctggggcgccccccaagttcccctcatcccaaaccaggagtcgccgaaagaagctcacctcttattaccgccctgtctacgcccccaagaagccccccatcctcaccggggtgtgtgggttcctcgagacccaccgcaagtccggctccttcctcctggtctcggtcctctttggcgcctcccttgtcatgggggcgtgtgtcctccccccgccnatgtncgaagtttccattacatatgtgatttgcactatatattttcccgggatgaaaggtggcgagcacttttgtttgtccgaataaaggacgcacgcacggcgtgcgattgtgctacgtgcttctcgtatctgctcttgtacgtagagcccacacagattgttgggttggctagggctgcgttctatacccatggtttctaacttccgtcacttattttccgcgcgcacgcttttcaaactgctagacggtgcgttttttgcaaaataaattctatacgaaagttgctaaaaaaaaccatattaatccatttttgaaaataaatttagcaaatactaaattaattgcgtgctaatcgtactaaatactaaatggggtaattgcttatttgaccctattttgaaagctaactaccaatttgaccctattttttttcagtttgcttatttgaccccgcttttcaaaatcgaagaggaaagctgaccctattccgttaagacgagttaacaccgttaactaagtggtaaaatgacgaaaatacccctaatacatccatctatcctcttaccactcattcttatccactctctctctactctctctctctctcaccagagcactgccgacggcggagggagcggcggcagctcggcgacgaggcggccctccgtcggcggtggaggagcggcggcggcggctgctaaggagcacggctcggcggcgcgatgcggaggaccgccactggcggcagatgcggagggctgcgtacgagcggcggtggctcgatgacgaggcggccctccgctggtggcggaggagcggcgatgaggggcggcgagaggagcggcggctggacggcgcgatgcggagggccgccgctggcggcggatgcggaaggctgcggaggagcggcgacagctcggcgacgaggcggccctccgcttgcggtggctgcgaaagagcgacag

SEQ ID NO: 373 - DNA, 12902 bp, Oryza sativa
  unsure (1)..(12902): unsure at all n locations
agaagtgaccaatcgagtaacgaagctaccattggcaatgaagatcgacacntcngtcttggccttnttggcctcgaggctccagatgcactactcgaaagttaggccatcacctcatcgtgaggcgncgnagatggcatgnacgccggaagatccaagctggccagcggcgggggatcccccccatctacgtgcgcctcctcctagtcctgcctcccctgcattgcgtgcactcggacaccgcagcgctgttgagttatgatccaaattcatttgcacttaataaagaccagcttctgccgaagtaaagcggaggcccgtcgccggaggcttgggccacccattgggttctgcggtacggattgtaatacctgttagggtttcacctcatatatatacctcttgtaagccgctgtgcggtgttgtaccctcaccccgatacagtgaagatattttgctggctggcgctagtggtttttttctttcctactttgagaggcttttttcacgttaaatcttgtgtcttctacgattaatctactattctttgtcgtttgtttgcccatcgttttctaacgagcgctgcctctgacttgccactgccgtgttgagcccagtgctgccaagcgccggccaccgcctacatgtgccttcctttccacggacaggctcggcggctcccacgacctgaatggaaggaaggagagggaatttgggatgaagaaggaagaatagagagagagtggaggaagtatgacaggtgggtctttcttttctttgatgcttgggatgccatgtccgattagattggacttaaataggactcaatgtggacttattccaagcagtagcggtagtagtgcaggccttgggccttggcccatgcagcagcaaatagcctagctaggtactcccaatagagcagcaagagctagcaaacagatcggcagcagcagctaaagtttagtcctatttggagagaatgtcaccaacttagaaaactagaaaagagatggatgctgaggatttaacactggttcgaacgatgacgaaaatacggtgttacattgtgggtgtgatctagcaattttaggaaccggtaaaccttagattccacaaataaagaaaaagtcgactcgaaacatgggatgaatcgaccaatgctttgagcaaccccatcaccccaaaacccatcggcatccaagaaaaaaaaatcgcaaaaaataagcatcagctctaatcgagccaatgctttgagcaccccatcaccccaagatccagcagcatccacaaaatcaacatccaagaacaagatcatagaatcaggatcaagaagaaaattgatattcacacatgaaccacaaaaatccatgaacgataaaatccaagaacatggagaggaggacgtcgtagggaaggccaccgtagccaccgcccgccacccaccgtgggtgaagtcgagcttgtggaagccaacggcccatggcgagatggaggccaagggagggaggtaaggcgaagggcatggatgttgaagaggacgtcgagcgagccctgagctcgtggcggctgcatctggccacccctgagtcaccttgtgtggagattatgggtaccgcatacccacacggcatggttatccgactagttatagaggatagcttatatctatggaatatgtaatagatcatgacttgggtattacgtttccttttatattatggagcggcctaaagtcctcatttgataatattgtaaagtagatttaggaaaccgataccgtattggttaaggtttctatcttgtaatcctgcccccatcctatataaggtgggcaggaggccctctagggggcatgagcacatatgatcgtcagatctatactacacccggtggattcaaatccccaaacaggagtagggtattacctctcattgagagggcttgaacctgtctaaatcctttgtctccgcatccatccacttttaggtcccgtgtgctacccccttttattattgccgaattcatgtttcgacaccttgtgagggaagggcaccaccgattgcttggggctcatcaccatggagcaaccggagctcaatgttgatgggccaaccaccccccgcctccccgagctcatgacaacaagatttagccacctccgaagcacgtggatgtcggatctgattgcccctgagccagccgcctgcatggaattatgtttgtcccattttagtttttttttttttgctgaggtcgagtacatggaggttggaggccatggtgttggtggaggcgtttgcttgtggtggttgtgctgtccctattctacaaggatgtttgatcgaattcgggctccagggttataagcagacgacgaagacagtttgtttcaacagatatggagcgaccttgctcaacaagaagcggcgcggctaagggatggatgggtgtggaggggaggcggcaatttggggagggggaggtggggatggggaagagctgacaccaacaccctcgtcactgatgcgctcgctaacggtgtgcaactacgtgttgctacaggcggtggtggttgaggaccggagcccgatgacaaggagctggtgcaatccaagcacccatcacacttgcacccgcaccacctccatgttactgccattggcctgtacacctactcatcctcacactttcctttgccatctacttggtgttgttcctactccatctctctccctaatcggttgatttaggggcgtcagtcagactctggtgagatgttcggcaagcttgcgagatggggattccactagccaggatctagcagcctcaaatcaaatttcttgtcacctcttccttaacgtccttcatcgatccaacaagacaactctttcacgaccatctgagtaccgttgccactatggttatctggattttggattcatctttctatttgtttcttaatagctgcaaccatacatgatttgccatttgggtagagcatggaccacttgtgcaactctagttgacaggattgcattctaagctctttagattcaatggtgaactccgctgaaatcctttgccgagtctgataacgcttatatacaccaaaatctatggctcagcaagaaacctctgctttgagccgtttccgtggagatagccaaaagagattgccagcctgtcaagtggtacacacgttgaatgcggtccaaggatgtcaagtagtatgcatgttgaatgagatccaaggacgtagttgtcgtggcaatgccgtagctccaaatcgacctgctactctactattgtttggtttcattaggaatagattgcttccttagttcagtaaactgagccctccataaagttgcatggttcaatactttcaactaataagtacgacgatgtgttgtgtgtgtgttgggggggggggagggggggtgttaatgtaacctgccccctcaatctgtcatgtgtaataaaaatgttactccctacattctaaaatataggctcaatcacttttaacacaaagaccaattcaaaatttaccttgatgcatataagcaatgtgatcggagggggaaggggttaatggtgtaggatttaaagtgccagtaatatatgcatgcatgcacgtattatattatgagacacgataaaaagtatccgtgacttatatttttgagatggaatgagtatgagttctgaaaataattttaaaaaaataatacagtggcccagccaaatttcccttgacacgcacctaaattaggcgcacccagttatcacaccaaatctgtcagttgagagttaggacctctctggcaagtagacgtggcctaagtgactaaaaggcaatgtatttcttattaattgtctctcatgttcatgtacatgaagggtttagggaaagatagttaaatcatggagggttttttttggttaatgtgcatatacgtagggatatctgaaatttactaaaagaaaatatttcacgtgtacgatatacattatcgttaacttcaatgatcatcatcgagctgcttttcacgagtttgcactttgcatgacaaggcaccacatgttttgtcacagtcgtcacatgtctcatctctgcaaccaacttctctttagctcgaaaataaatcaatctcgtacgaaatatgacacatcattatttaaataaatcaatctcatatgagatgtgagacacatgctaatagacatatctaaattaatagtattaagatgtatcacatacaatatgagtttaatatattttgaaacgcaggagtacccataaatatgtatgcgtacaaacatggagcagcagtctctcgtgctgccaagtgacaagtgcaacaataatcgttcacatagggaaaacaaaaaagaaaggtagaagccccactctccttgtacgtacgacagcatgatcggcggcgccgccaggccaccgacaccgccggcggtcgtcgacaagacgatgtgcgccgcgtgcgacatcctgaagctcctaccgacaggcaccgtgctggccttccacgagctggcgccgtccttcaccaaccacggcggcgcgtgcggcgcggccagccggtacaccaccgcggcgctcatcgccgcctgcaccgcgtcctgcgtgctgctctccttcaccgacagcctcgtcagccatgtcgacggccgccgcctctactacggcgtggccaccctccggggattccgcccgttcaacttcgaggggacgcgcgaggagatggaggagaggttcggcgacctcccggggatgaaggtcagggcgctggacttcgtgcacgcgcacgtctcggcggtcgtgttcgtcgtcgtcgcgctcggcaacgccgacgtgcagggctgcctcttccccgacgccggcactggcttcacggagatgttcaggaacctgccaatgggattagggttgctggccagcatggtgttcatgatcttccctactaccaggaagagcatcggctacacggacatgatgccgcacaaggaagactacgggaaaggaggtaataatattcctggccagaccacgccgtcggtgtgatgaagtaaacataacatgatactccatttatactttataggaaggtataaatgactgtacagtgtaaatccgtagtggtgtgtagaagttggtatatatattggacatatatccaagcatggaactgtagaatgtactcatgtggggctttaagccctctttctttatatctaaactagcatatatgtggtgtaaaaaaatcatcggaaattacatatatctcgcgcgttgcagcggaatttgtaggtaattgtcaaggaaaacatatttggataagttacctacataagattagacagagtaatgaaaattgtggattttatttattaccatgcttgattgttcgtacatacatacatacatacatactatggactggagcaaacctcaacatacatacatacatacatacatacatacatacatacatacatacatacatatacacggtgcagtgcacgtacggcaaacgacagcggcgcacaggagacgatgcgccgtgcacgagacattggtgctgtgccgagtccttcacgtcacggcgttgcctcacataggcattgtgcgcggcatggcgcacgactgcacgagagaagcagggcagcagatcggcggctagcgttaggggcgaaagggattaagtcggagcgagtggcggctcggctcgatggcttttgccagtccagttcggtcggtttaggccaaagcaaagccgcctggagaaggggaggaagacgggtttgcctcatggccgagctgggtcggcttggtaggcttgatgggctaggccaggggaaatggaaaaagagaagaaaagagctgagcgactcaagttagactttttagaaaaaaaacaagaggattagggtttgggtctagatgagttgggctaggcccgcaagggacaacattagactttagcttacaagtttgaaaaattgattatcaaaatactttagtttacaaaggttttaaaaaaatacttattagtttcttttatttgtaaataaggattaatcctttaaaaggattttttaaaaaatatttgattttatttgtaaaagaattcattaaagggatattaattaataaaagggttttcaggaaagtaattagtatttgcctttaggtgaaaatattttcttgatattaattcataatcatggttgtttaataaatattattttaactccacaattgaatttagaatttgcatttaatttcttatttaatttattttggcagcatgaggtaattttgaaaatccaataaataccagcataagggaattttcaaaaaaaaatatttgtccaaattttggtttccacattttaaattcgaaattttcgggatgtttcatgctaatatctagtacaactctaaatcctaaactataaccgactacgtatatgtatctgacacaaatctaacagaaacattgctcatattcttgttcacataccaagcccttgtatttcccattagctttatgtgttgggcgtgcgctctccttgtcatgtttaacagagcagcttgaaactatttttttttcaggtagtggatatcaatccggcctatacatccctcaaggatgtaaattactagctcaatatcctttgtattataaccctttagcttgtcaatgaattgccgtttcgattgggggtagttcatactcgttagagaccaaactgtgggtttgttgttcatccggaacttttgctgaactgttgcaggcaatgaggatgccctgctccaatgccttcaacagcgcttcatcgctagttctatgtgttgaacacgtaataataaattttcatattgcaattcacgataaatgtatcttactccatctgaagagttccacgagctgcagattcagatagtggaattgttcttgataagatccctgcaaccagcatatatgcatttcaaaatggtcctgtctatgcagcataggtcaccaagtgtcccttagctcttcactcgctcaaaggacactagctctagccacgtagctgatatatgaaaagagaacagggtaaaagtcgtaatatacacaaactaaaataggacatatatatatatattcccttttctagtgtttgactatttttagatgctttgctgtacaaataactttttaggtcaattcttatagcgcattcttttccagaaatttggtgtaattcgcatttgtcattggctccgatgaacagcaactcaacaagctattgaacagttgacgttcaaccttacaatgataattatttcattgatgcgatatggaatgagaagtatacgatggcatgtaagaatctggtaaaaagaatataacagcaatatatgttattcttgttgagagattgatactactagagaggggccatgatatcacaagaggcttaaactgtacaagcatggcatcttttctaaacatgcagaagttatttttttaatcttaaagagaatataacttaaatggaaggtacgagagaaaaatatgtttttcttgctaatttaccagctgccagaccagtttttatgaatgaaagacataccaacaaaataaaattttgttttactttgttttgctttggaacttttaacagtctcttcggctgatcactgttgctgtcataatttcaaatgcaaattcttgaaaagttgttgtcatttttgctacagtacaagctcagctatctgttgctcttgttttctcttcactagctgaatgccgtgctttgctacggatgataaaaaagtatattagaatattgtctaaaataaattaacatgtgttttctcttaattgtgttaacaattcctttgctatagggaactctgaccctaatttgattttatatgtgggcatcatttagatttgtttgtttttctaataataagaagttcaagagcaaatttataaaattgacaatggaaatagatagggtgacagattcactaccagcaccattaatttcttttaaaggagtatagatgttctatgtgctcgtcttaacaaaccttactttttttacatgattacatcatttaatttgaattgaaattatgagtgcagtttaaagtgaatcaataaattaaattaacttcccaaaaagtaaattaataaatattattaactgaactttgaacatgcattgttcaaagttaccttcatctctatatatgaacatccattctacaaagtttgtcatcacttcatcttgagtatgccactaattgaagaatgttgtttctaaccgacgatctatagatgcttacatgctttgtaggagcgatttgaccaaagttaggaatacttttccattaaagattcccagaatttctctgggatacaatcgatctgccaattgcagcagccagccccccctcttgcctgtaagtatcacacccatgtgtagcattgttcctttcttttcactagcaagttacaagctgccacatagcagatctcttgatacccactttgcctggaatccctaccctctttcagatgctccttatccatacaaaatgctgactttctggccagtactgaaagaacaagagagaaagaaaaactcatattacaataggcgacttcggaacgcggcatcgcatacctctaacctctccatatctgatgaggtgtgaggaccttgctttttgtgagattctaattctagacatacgggataagagttcctgttgagaggccattgctgttcatgagagcctctgaatggaatcaaagcttctctcaacgttgacttggctgacgatgatatgattccttggggatgaccacaacacatacatttggtggctctggcctaatgtcagtgttgctgatcaattggtaatgttgtaaaccaagagggtgatgttgtctgaatttgaataaattgattttcagttgaacggtgaatccgggatgacaggagacaatatttgctgaatttccaagcacaggtatagattatccagagtgctgaatttccacagttcagtttcttaataaaacactttgcatacttccattggatactggacagcaaaagcaactatacaataggacaaagaaaaaaaaattcagaatgaattgatctgtacttagatcttagtaggaaagaaaaaacaactcatattctgatgttggcgttgatttgcattcctcatacctgtgacctgtgcattttacatcatcaagtttgttattctcacgcaaaggtctaagccgtacaatcttacgcagacattatccataccacacctaatggctgaaaggcaaaattctctttctcctcaaaatttttctccctaagcatggtacttcctagttcctatgccttgagaccttgaccctggtaattttgttgggatttgagagattatatatcagcaagcgctgctctcttgagtaataaagaaataatttgcattagttagtcagtccatgctatttataacagaacatttttcatatcattctcgttcttattcataaaggtgaaaaactagtaaaagcagatttatcagcaaattctagcaagttgctttgttctgattccttcacagttatttgatattttccttggattttctacagaattccatagtattttatatctaagactacaggcttgttcagattggtaccattttaaaccataccattatttagtaaaattgacaatcatgttgttgcatttagtttcttaccaaatattggtaatgtctatgaaattttggcaatattgtattaagactatcctatcaaaatttggcaacgttgcaatttaccaaaattttgacaataccaaattttggaaagattcattttggcattaatctgaacaccaccaccagcgtctctctctctctctctctctctcttctgacttagctttgtcaaatatgatagaatggaactactaaaagtaagaggagggtcaaggccttatcaacacctcccaaggaccatctcggcatcagtttgctgcatcaccattgtcatccatatattccatattccacactaaatccatcgatccgtggaccgtggtgtcgcgaggagcaagcttgcttggccatacattatccgaaccttcgtcttttccccgatcgaattgccgcaaaatctcatgtcgtgcacgcacattttccatggctatataagcaggcaggaggctcctcacctatgcacagctcaaagcaaagcaaagcacaacacaatcaaagcctcatacaagaagctagctagctagtactcaagctaaatacctagctagcagtagcaggcgaccagctgcatttttccagaggaaaaatctctcagtttagcttaattaattagctcttgggagaagaaggcaagaagaaaatggacagggtgaacaggctggcggcgcagcgggcggtggtgatcttcagcatgagctcgtgctgcatgtgccacaccgtgacgcgcctcttctgcgagctcggggtgaacccgacggtggtggagctggacgaggacccgagggggaaggagatggagaaggcgctggcgaggctcctcggccgcagccccgccgtgccggcggtgttcatcggcgggaggctcgtcggctccaccgacaaggtcatgtcgctgcacctcagcggcaaccttgtcccgctgcttcgcaatgcgggtgccctctgggtgtagcaccaacgacgcaactatacctaccagcgactggttcttgatttggactgataccgtggcgcagaataattttatacgggtactttggtttgtatcaggcaggtcaggtatatctaagggaaaataaatagtacgtgcaggccttttttgcactgcaatactagtaaatctatagagagtggggaattaagtgtgtcatgtcagccgcctgtaaggctcttttgagatgtaataatgacacatatccgtttaatggagtatacctcttttgtcgatcgttggtcttttcgtctgtgtgattttttaaaaagctatctaatccagggttttcactttcggtttgcatcgaaatttagggttttcactttcggtttgcatcgaaattctgaagttttggtgcaactgaaatttccaaaaattttgggaaattttcaactttttgtccgaaattatttgaaaattttaccaatttttgactgaatttgaatacattttgatcaaattcacaaaagtttgaaaaaaaattagggtgcaaattttgcttgccggaaggggggggggggcaaaattactaaaatttcaaaaaacttaaaccgaaattgaaatccctgatctactctagcacaaacacatatatgcttaattaggaaaaccatctccaaactggtaggacgattggttaattagggacttggggtatacctcttgggatgtggatcaagaacctataacacagcgtcttcaaactcgcattagttcactctacacgctgagtggacccacattcacataatcacatagcaactcgcttatattttcgtttttgtttcgtgtaaaatggttaatctagtgatattgtgtttggagtgaattggatatttaagcagtctcaaacctatgaagactctccatataggactattatcactaaatgaacacttggaccttacaggtctaaaccgaaataagaacactcatgagctgaaacagactaaacgggttggagtattatagaacaatatattttttggacagtggtttgggacaagaggagattgaaataggctaggtgtgttgcagcatggaggctagagagctcgagcaatggttgcacgagaagaaacgcactcagaaatctagggccacgtttgttagctgggctagatgattggcccattaacaataactcgaaagttttcatctgctaccgtcacaaccatccatcgcacaatcgtcccttcccaccacatcaccagtacatcgctgcaccaggtaacaccatggatgatatcctataccaagtagcgacccgtcgattcctgagactcccttccccctgtcaaaattcagcggcactattctgaaggccgtaaacacggaataattttgaacaagcaaaaaaaaaggcgaggaatgtgatctcctggtcaaaaacgattatctcctggtcaaaaaagattatccaagtctaccaagcttgtgaacgtaagttaaaatccgtcccacgtaattggtactttattttatgccgattgacatcttgcttcgtgtttgtagagaatataccagcaattccaagctaagtctgaaaccctagaaagacttatcttgatactttggagtcggccaggaaagaatttaggccccttttaaaacaaaggaaaaacataggaattccaaaggacttataccatgtggaaaataatcctatgagaccctttgaaataaaggattgatttctaccaattccattgacattcctatggaatggactattgtaggaaattttagaggaaaattagcatgaggtcttacctcatgttttcttcttcccgggtcttgaattcttatgtttttcatgtgtaactatgaaatggtagttttgaaactttcttgtgttttcaaatctcataggaatccaatgaacatgacattctattcctacattttttctattcccatgttttgacaatcctgtatttcaaatgggcccttaaagaagttaaagaagccgccaaagctagagagnnnnnnnnnnnnnnnnnnnnnnnnnnnnnnnnnnnnnnnnnnnnnnnnnnnnnnnnnnnnnnnnnnnnnnattcaatntccatgccatcg

SEQ ID NO: 374 - DNA, 28296 bp, Oryza sativa
  unsure (1)..(28296): unsure at all n locations
ccgggctttgagngtcgagtttcnnnnnnnnnnnnnnnnnnnnnnnnnnnnnnnnnncttgtggaaattctcgagcaagcggagctgaaaacgaagacgaaagattttgccaaaaatgcggagtagaatttattgattctcggatacgaagatatcaaatgggatacatcaaactcgcatgtcccgtgactcatgtgagtcattttttgactcaaagcagtctaaatactactccctttggtttttagtagataaccgttttttcttttggaccaagaaaaaggacttcattaaatcacatgggacaaattacagtcgttttcaatcaaccaagaaacagaattggactcaaacccagttcagaagcctgagtaatcgtcccttctagctttgtttgctaattcatggctaatcaaattttgttcccgctggatcttcgtaatggaagtcgtcctttctcctgatcaaagccatcttgcttctctgactagaaacgccagggttgagcagtcctcctccttatcagtgagtagatgcacaactgagatgtagtctgtttcaattgcaaccggcagcagtgtccattgcagtgctaaccgaaggccctccacacaggcggcaagtttagtctctaacgctgaagagcagtttgcaagtgacttgcacatcgtaaagagggtttcaccattgtagtcccgaagaattgcaccgatcccagcactaccatcggactcaaggaaggagccattgatgttcagttttgcccatcctgagggatgtcgtttccagcattctttttgttagtgatatgctctagaggcaatcatagagattattgtatcacatactatgtttacatatttttccgactttgttccttgaagtagataacttattattggttaatgaatatgtgattctttcatgagactctttatgttgtttgttactatttttaaaggatcctgatcaaataacatatgtggaacaaataagtttaaatgatcagcacatgtattaattgatgattatatctcatggatcatggtacagagatatcaaattaataatgtgaatacatgttggggaacatgttgttggatagacccaacatgagacactgtaagagccatatgtgttgtatcatcagtgatctcatttagtgttggtgttgaatcctaattagacctgagattatcatgattcccaacatgtgtagtagcttacttagggactgctaaacgctactccgtaattgagtagttataaaagtagtttacgggtatgctgtgaaacatgcagtaggatatgaataatcaagatgagatttgcccctcctatggagagatatctctgggcccctcgatgttatagattatggaagtgcatggccatgccaaaggtgattgaggagtcaatcacaggttatataatctatcacaggttcgagcgaatgattgagctattaaaggatggcacatatctagccttgagcttaatcgatatcgtgaggcgaaggggttcaaacaagtatacactagaggttcagccgatatgatctttatgtatgtccggtgggtcaatacgttctgctagggaccgctgttgacacgtggaccgaaaaggagttttcgggttatagctgagtgtacatgaacctacagggtcacacgcttaatgggccgaaataaggggattggatggagatccaatataagcttaattcggatagggatccgaataggagtcctacaggccttggaggcccgagttatggatcctatatattcgtgaggggtgtaatcggcggaggtattgcatcacgtgagaaaccctagccgtcactcccctccccgggcaaaaccttagccgcgcgcgggtgctagcacatctgcgcgtgtcgttccgtccctgtacgtgtggataccggtagaggcgccactgctttgcggtgctgatgggcgtgggagtacggcgaggagaacgcacgaggaggataatgacgagctggtgcgatcgactacttcctctgtatcgacgcgcgctactttgcgagagttccttcgacttcttagcgccttcttccgctacacagcgcgtcgagtggtaacgatctatgatctaatacttgcatggttcctagtttacgtgatagaaaattttgatttatgctatcgtagtctacgcgtatcccgacacttttggcttatcatccttttgcgtccggcaaattgtgtcgccctggatctgcttcgcctttaccaagtcactcctttggccattttttattatcagttggccattctttattatcagcaaggattggacgtagctttccaagaaccttttcgatgcaattatgggtgttggtcttttatcgtgcattatctcattatgaatgtaccaagcaatctcaaaaacttctagcaaaccctgtctcctgaagttaaataggtccaaaagacaaaactatctactaaaaaccaaaggaagtagtatttgagactactttgagttttaacaaatttataatggcttgtgaatgaattatgatgttacttttaaaaagtgcaaatttacactgccatagattatttatatcatttaattcattcatatgtaccattgaataataatcatatatagatcattctgatattcagcacaatctagaacaatccctagagcaccaatgtatcccaagaaaatatcgtactccctccgtcccaaaatataaacatttttagcatagtgacaagtcaaacattttcaactttgaccattaataacaaaaaaataaaaaagatcaatcatctaaaattgatgttactagatttatcattaaacaaactatcataatatgcaactctttttatttaaaacatcttatttttatagatattattggtcaaagtagcatatcaagaaccgtgtcagagtctaaaaatacttatattttgggatgaaggaagtagttgctattaaccgttcatcttttgtttctaagcatgtgtttggtttgggaatgagtttgattcatccttcttttttggatgggatagtcctagttttcaaaagatggcacacatgttagggagataaaaaaatagattggatttgtccatcaattttcaagagaccaccctagatgaggagaatatttccttttagagatcatccacctcacatattcccaaaccaaacactagaaaatgggtccgacccaacacgaccaattccatcccttaactaaacgcttgctaagggaagcatgagtggaaccttgagaaccccgctgtattgctcgggtcatgttgcatcacatatttcacattaaatagcactgtagctctgcttgcattcaggaaaaagacatgcatttattatagggccttatttgtgaaataagggatctaataacactttattgggggtcacggcttaatcaacattttatgccaaaaaaaaaagtaccgcaaacttgcaaaattacaagcacaaatagtacttaacaaagtagctcaacttgtacaataaaccacgatgtggggcgaagcaatgcaccattatcattagtgcttccagcatatctacgacatcatacacaataaatattacagcagagatggccatcttactgctttgtgacttgagagtagggcacggttggatcgctaactcatagtatccctccatttatctagattctagacaacatattgaaaatcaacaaaactatatgatatgcagaaaagtaacaaataaggcatcacctagtataagattacaacatttaggagaaccttgcgaagtcccagcagcaaatctttgtcctggcggactctgctgagtttttgacagaccaaccattgcctgaaaactcaaagcagccagtggtgttgtaccacaagacgacttttatcattttcccattcgtaaatgcagcaccgcagggcacagaagtcaggctccggcaagtatccgtccaccagcagaaaacccatcaagccaagtatctgtacacatttgggttgtctttatccctctccaagtaatcccttgtgataagatcctcaattcgcttctttattgccttgaagtcaggctgcaacggaaaagagaaaaaaacttgtgatggtgaagacatcaaaggagtttcgagcaaacaagtgctttacacatttcccggatgtcagattcattatatttaataattatagtatatttcagaataaggaaacaccaacaagacggtggtccaagtctaactgaacaaaacggtgctagcccatcaaggcaatcaacaaactctacatcaacaaagtacaattaatgagttgtaccaagaatttcgtaggaacaccatgaccttaaaagaacataatggattgagcccagcacttacataaatggagtgtgtttaaaatgctttcactaacaagtgcaagaactttcttgaagaaataactcgtaccttaaacatgcgtccaagctgctccacacattccatcacaagttgctgatgacccaatactttgcgactcttcataatacgcacaattgatgcatcaattgcgtatctgcgatccttatcaacatcttcaactactttcttcttctcatcaactggaggaagaggtatctaaaaacagcacaaacacaaagataatacattgaaccagagaaatcagaaaagtacaagcataattgattatgcaacatcagaagttcacgctttcatattataccactgaatatgggttcactttattgccgtcagaagatctcactgctgattttctttaccactctatacatattccttagtactccctccatccaaaattataaggcctatatttttttacatggtcttcaatgacatactttgaccattaatttataccatgttatgtttccaacaaatatgaatctagtgatataacatgcataatatgtagcatatatatgattagtatgattattagtaaaaaaaaattaccaagtttgattttccttaaaaagaggacgtcctataatttgggacggagggagtttttttttttcatttttctttaactttatccagaactgaggacgcaaaacccatcatccttagcatgcacccatattggctagcggccgcttactggcacctgccaatgatgcctttgccagcactgccacattctacatcttacattgccatagtttccattctcttttgttggtgtgcagcttgcttgtgtacaatttaatggctgagcatatggagactaattcaagcctgtgttggcttcttggttgggtagccaaccttgctgtctgatcggatgaggccacatgatcaaagataacaacaggtggtctcagcatcattgaattggttaaaagatgcaacggtgtgaccttggtaataaaatgaacccaaaaatttgaggggtataaaactaaaaatacaaacttccgaagctacataaccaatgttgccagaagtaaattatcaaacctataaaacaaataaattgaagatacctttaatcttcgcagcttgtcagtaaactttgagttgaactcgaagacatcatttggtgaaatagatctattatttggttctttgctaagaatcttgtattttgcacaagatagagaatggagcaatcgaacaacatcatcatctgagagatttaactgtgtcacaatctcagaatagctgagtctatcaactccattaaacagcagcagcaatgcagcctaccaacaaaagtgaaaggcatttcagaagtcataatacaagagggaagtggataatgtgatttcgaactacctgataagttgtaacaatgagctcaatagttttggcctcaaatttagcattaatattacaggttcccagtgaataaatccaggtaagtttcctgtgttttgttcttgtttggtaaaactccttgaaaacctctacacatttcacctaaaaataaaaaaataaaacaatcactgtgtgtagagcagaatgccaaccacaaattttatgcaaaataaggcaaactccggccttttaaaagcctcaaggcaaacttaccatttctgcaggtagatttatatcaaaagatttgtaacttggccaaaatcctgttgtgaggacagtaacagctaaggctattccaggattcaactctgagtgtgtgcttatgaactcttcaaatttagcctggtgatctcttgccacagtgagatcagtaaccatgccctccattttggaagtgaactgccctccacattgttgctttagcttggtaaggatgcttctctcatgttcatcattagcactcttgtcaaaaagcaatctccttgcaagcttctttctgcaaatttagccccagaggttaacaactgcatgaatccatgcgcaagaatttaaagacaaaaagaataagcatgcaagataataacagcttacctatagaactcagcaaacaagtccttgtcactaatgtaggcaagtaaccttacaacctggtaatcacccattcaagattaggacttactaatgacactaatagatcaaacataacaaattgatggttgtaccttctcaagggtatcttcaattgcttcatcactaagcttttcactaccgcctttctttaagatattgtcacagaaggtagctagtaattcagcacttgaactgccagaaacacctttgttgcaaaaaacttcaaaagcctccttaagtgcctgcataaacaggatacagaacatgatccaatattttgatatcattatgacaataatggtgtgagcatatcaaatagcaaaccttatggaagagagtgtgcccctgaaaacaatccgtaacataagctacatacttgtcatgaagctcaatgattttccggacaaaaacctaagataacaaacagtgagtaattgaaacaagtgtagagccacgaaagaatatataaaaagttattgaaacaaaacctgttcctgtaaaccaactatctccttcttctctggctgcagtataacaaagaaaaagcaaaattacttcaagtgcaaatccaaagtgtttggcggagtgcagagctatatgtacagatcagcagagtaaatatcactacatatgttaccagcaagagttgagtacaaagtctagctaattgattaaatatcctaaccaattgataccaccccaagtacacaataagatgaatgtactaagacaacattaatacaaacaaaagttaatatatagactgtgcaccttcttattactagcagcatcttcggcttgcttcactaaggcagtgccctcattagtaacatgctacacagaagcaacattccattacatcatcaaaatagatttaagaaataaaccactctcttctgaaaaacaaaatacctgcttaaatatttgagaaacaggttctaaaccacgagttattctggaaaagagcctgtacattctagagagatcatcaacctggagtaaaacagaagatgctatgttagcagacttcatttgttcctgataaactgttgagagacgtggagcttctccaagaaaccttgtcatcacgaagcaatgcatggcatccagaatgctccttctccaggagctgacttgcgtattgagttagcaactcatgttgcactttctgtgaaaatcatgtcataccggagaaagtgaattatacataatgctctatcaggaaaaaaatatattctgatttctgaacatacaattataaattgtatatggacatgtggtgtgtatgcacttagcaaacgtagattaaatatcaaaaagtatgctctaaaatgtggactgtggagtagaagcaacagcagacaattcactaacctccaacaacttctgttcactactggagtgcaaataatgagcaactcgctctttctcccttttcagacactcctctgcctatgaaacaaacaaccattagaaaaaatatatattatgcttacctacagatagggatgttcatgaaacattcttgagaatacctttaacatgtaatctggacaagagtcctcaagaatccaggtctgggcttttatagagtaatagtctgcagtatctttgagcaagaaatcttcaaaatcattttcgtagtagtccatgctagtcaagccaatctcaacaaatatatccagaacattctttaacagggccctatcaatttgttcaccctcacgttcttgatctatctgttcgagaaagtatgtctatcaccagccatacacaataaaaaaagatagcatcacaagatacaatgactcaccaaggatatcaccgcactttttacttttcctttgatctcttgatatacctgttacaataaataaaactgattaaattctagatatagtcatcaagcaaagaaatgcaagttgtattgcataaaaaacgagaatcatgagtaatcaagcaagtagtgttaccagatcccggaaacagctaagcccaacttcacttagttgtggtagggacctccttgaaataaagtaccgatcaagataatggaagaagcgtgatagccaccgaaccatcactttatggtttgaccaccgttttactagctctctcagcataaactcatcatgtttctctcttaatgaaggtaagacctacaaaatattgaaaccaaataaaggacttatcttccaaaagaagtgaacaatacaaaagaagatctgagataggcaacatgcaaatgatgaagagtaattaaacttcattgaatttgtagtgcatgataattagctagaactactaatgaactatatcataatggaagaggatcctctaactttgagttattgacaagtgggaccgctgagtagagggcgcacatgtcagtgaccacgttagagagaagtaagtcagaggatctcaatcctatcataataggatggaaaaagtctgttttcatctctcaacacttcacacgttttaatttcatccctcaactataaaaccatataaaagctgcccatcaactctcaaaaccaaacaaaacttatcccactgccctatcctatagtgattttgactcagcaggtggggccccactatctatttgggaaatggactggagaatggtgaatcttacacaatcagccatgacactctatgacaaatgggccccactatctatttgggtccaaactatcaccaaacatggtggaggggcaacttttacccggttttcagaattgtgggagtgggacatatttaaccctgttttgcaattgaggtacaaaactaaactgagtcaaaaattgagggacgagaaatagactttctccaaataggaagggaaacaggacagggagcaactaagctcaggacttcatatacagatcctcaatatggcggggaaccagggtcccgaccatagaatcgtatgcattgcaatatctagttatagaaaatgttgtatcaattatatgatcaaccatatatttgagatatacttaacttatcaacaacaaatagcaattagcatatttacatatttaatacaagtcgctgcacactaaatagcaatgaacacatacatcctagaaacatatgcatatctatatgccaggatgatactataaaggtcctgttgatgcaaagggaaaaggaaaccgatatttcaaatggaatggatgtagtatggacagatttcagcagcagcaactgttccagcatcactaaatcaagtaatcgatgcttagcaagcaagttatgacctcgaaaaacttacaccttgaaaaacaaagttaacatattagacaatagacgcggcacaattcagaacattgaaaagcattttttctggtgaattacatgaggacttgaggagcactttgctcagcattaaaatgatccaatgcaaaatgagtgagggagagtgtaatagatatgcatatggtcattatgtaaattctctcagatatgaaagatgtgacattaaaccataaacagttcaaatcacaatatcttcgaagtgtttatgacacatcatgcaatcaacaggtaacaaaatcaaagattagctttgaacaaaaatgaataaactgcattttgcaccaagtaaagcacggtaagcaccgtatttcactttgcatgaggtgtggcacacatttcgcaccagattacatcatcgaactaatatatatcccaagaaatgccataagccctaaatgaaactttgtcaaacatggtcaagattcatcaagtttcataaggcttcactcaaatttcatgaggttttcctccgatttcatgatgcaacctggtgcaaggtacatttactaaagaaattgatccttttgtggataataatttattgggaaagaagtaaaggtcaatacaagggactgagggaggataaagaaacaacagtaatatgcatccaggcatctagcattctacccacagtggttgctcaattgatcctacaatcacaattcatagttgaaaggaacatatgccttgcaaattcagtatttctcaaaacttctcatgtcgatttggcgcccaaacagaaagtgattacacaataaagtgtggttgcacagtacatgctgccatgatgaaaagggacaaaatcatgaaagaacaatcatttcaacataaagggattccaattcagaaaacaaaactcaatatgatgctattttgttgaacctttgaagctttcagtaaagcagggcatgagccttttcggtaaaaatgatgctagtctgctctgggtaacaacaaatccaaatgtgctgaagaaaatcatcccaaattgaataatcaatgctctctaagtaaatcgcgaagtttatataaatgcacaggcagtgaattggagtacttctgtagtgatgatgttagtagcctacttccagtaagatcaaatccaaatgcactgaataaaatcatgctaaattgagcaactcatgctctccaagcaaatcaaaaaaaattgtatagtggacacaggcagtacaaactaaagtacttttagcagacagcatctaagagcacagtgaccaaataataagcaaaacgcagtaagctatattcaaaaaaacatgaagtaatactgcagtacttagtgcggtcctccttagttaagaaagtacaattatctacctatcagaagaagccaacaaaaaatatctcgattgctccaaagtatcgacaatgatcaaaattagagcagcatctttcggcatcgaatctatcttctctatgtaaacagctataaactctcaatgcgtgtgctattagtccattggtacatacgacatgattggcataatttcaacgctatccctaacccatctgcgttagaaaattcaacacaggagcgcattaatcgagctagtcaatgaagggaggaacccaacagccgctcaccatggacgtgatgtactcctcgaaggactcgcggtacttctcgtagagctgctgcgagtagtcgtgcggcggcttctgcgtgcacatgttgtaaatcgtcctggagcacggagacgaaccctaaatcagatcagcgcgcggggaagaaaaaaatcgaataaatcgggagagaaatcgaggagggcgggcacacgcacgtgtagagcatcatgtagtcctcggagctgaactggggttcgggcttcccctcgaggatgttcttcagcttggtgatgcccttctgcatgaactcccacccctgctccagatcgatcgtcttccgctcgtgggtcgccatcgcggccggcgccgccgccgaatcgggggaagggcggcgcgagacccaccccgccgaggatccgccggggagccctagcttggggggggctcttcgctgtcgtgtacgtggggggaggggaacgaggtcggtgggttccctcccgccgcacgcgaggtggacggaggcgaagaggggaggaggaggggggatgacgaaatgggaaaagtggaggggcctttttcttttctttttcctttttttttttgctcccttttcgctgatagggtggggcgcggccgcgcggggtggaagttttgctgttggggcggtcgtgtgatcgtgtctcgtgtgggaaacacgccggggtaaaggaaccaggtcttttatatctgtaataattgattattctgaaattcaataattggtaaattagtggtgctattctatgaaaactggcccatttgtaaattggtaaaaaaattattattctcggaatatctgaaaagtttctttcgcatttacttaaaagttttaatcacctatctactctactcctctctaggcattaattgaccctttcagatataataatgtgagatgttgttataaataaagattttaattgaaataaatacaaggaataagtctacttcaccccccaagtattgaggttggtctacataacccccagaagtacgaaaccgggtattctgcccctctaaagtatcaaaaccagtttaaataacccctagagtggttttatatgtggttttgttgtgcacacgatggcatgtcaatggttctggccttgtaacatgctaagcattttattcacaagtgaaaacaggctgagaatgatgtaaattagtgttaatatatactccattcaacccataatatgaggcgcacaagcatttcaagattcaacttctataatatttgaccaataattagtataatatgaattaaattttatttgttgggaatattatcattggattggcatttgaatttacgttcatatgattataattttgttgctataataaaccttatagtatatgagaaattataagccaatcgtaccaattttgatcattttttatattataggataaagggagtaatatattttaggcttgccgatcaatgagtgaaaagcaatagttagatcaacttaggtttactagactaatctttgtgtcatgcaagccaataccgctgccacataatcatttacatggcaaaactaccaacaaaactactctagggggttatttgaaccggttttcatacttcaaggggtagaatattcggtttcgtactttaggggggttaagcagaccaaccccaaggggtgaagcagacttattcctaaatacaatgatgtaatcggatcttaaaaattatactctctttaaaagagcggaataactatatatcattcgacagaaatttggggatgaaatcttacatattttggaccattggatctgtgccaagatttatgcatcgacttcttttcctccaattccagtggactccccttcttccccggcgccagcgacacccgcaacttcagcagggagcatatcggttagggtttggagttaagggagggggaagaaggggtttctcggggcttaagagggaagaatgtggggcggtgggtggtgcacatggacaggcggccaagcgccggaaccgcgggattgacagcgggcggagggccggcgttggcggcgggggaaaacggattgcaaccttgggaaagagatggggggagggagaggaggccaactagggggagccttgcgggcgccgttgaccccttccggctagccagcaaggctaggcggcggggtagcggcgcggcgactgcacaggacgtggaggagcgctcacgctcacgcatgcgtgaaagcggtggtggcggtggatggattgagaagtggaggaaaagtatgtttgttatgttgcaagatttggggaggttttttctgtcaaaagacacctagacagtccctatagtatttgattggaaaaaatagagtgtgcactagttaaggaagaattatgcgtatccactattcagattttgcctacatgaatttgcgtgtgatgttggtaatggaccacagcccacaagcccttttataattcaactcagtgtttttcctttggaataagttcacattaactcccttaacaagtgacagaatctgattcgtatccctcaatcacaattctatatctcgatcccttaactattaaaaccggtgcaatttgactccctcgacggtttcactgatatggcgcacacgtggcaatgttgacctagtctccttcccacgtggtattgacgtggtgtttatatggcattaaaattaaaaaaatatatttggaacccatttatcattcacacaaaaaaaattgtggaacccacaaaaatgtggggcccacatgtcatcctatctctcctgcccttcttccccctctctctcccttatttctctctctttctctcccctttacttcactcaatctgctggaggcaggcgggggatcgagtgccgccgccggcggcggcgggcggtggacggtagccggcgggtgggcgggtgttggagcagcgacgcaggcaggcgggcgagggccacagcggcggtggcgggcgggagggcgggcgctggagtagcgacgatggcaggctggcgagggccaaacaactctccatggccacccgctgccgcaccgctgcaaccaccggtgtggacctcgacatccgtgctgttcgatgccgccgccgctccaggtccaggggtgcctatcgccgccgttggtcgaccgcctcgcccttccgttccccttggattcacttgccgcggcggcgccatatcaaaggtagaagaggaggcgacgcggctagagaaacaacgcctggacaccatgcttcgctgcctggatcctctccttgccaccaccgagtgaagtaaaggggagagagataagggagagaggaggaggaagaagggcaggagaaagaggatgacatgtgggccctacattttgtgggtcccacaattttttttgcgtgaatgacgaatgggtcccgcatatttttttaatcttattgccacattaatgccacgtcaatgccacgtaggacgaatactaggtcaacaccgccacgtgtgggccacgtcagctaaaacgccctccaaaaccgccaagggagtcaaattgcaccgtttttaatagttgaggtgtcaagatatctggcattatggttgagggatacgaatctgattattcggtcacttgttaagggagtcaaagcgaacttattccttttcctttcctttgttttatacttttgggtaaagtttattttatgtccctcaactatggtggagattcattcgcggccttcagccataaaaccaactacaaaatttcctcttactatcaaaactattgcaaatcgagtcccacgatggtttcatctgatctggcgtccacgtggtatgttaacttggttttcgtcatatgtggatgcttatgtggcagtagaagaaaaactttaaaaacttaatgagatccatatgttagtcagaaaaaaaataatatatacttcacacatgcatgcataaaagcgaatacaataagatgatatagctggctataaaagtttgcacatcagatttgtgcttaagtggagtagagagaagaaaagcgagatatatggtataataattaagttgtgtgagagaaagagatgggccatactttaatagtgttgtatatatctataactaactattgtatgtatggctatttaattagcattagattatgtgttatttttatagctagcagttggctatactattaaccttgaaagaaataacaatctagggtaacattgacaaatgcgacgatgtgtgttaatcttggcactcaaaatggtgcgaaaaaatacatatatatgcacatctagctgaggttaccggattcctatttatatgtgataaaaaaaccttatcttctaactactggtctcctcaaccttgtgccgttgtgcgcataccacgtatatattatctgtaacactcgccgtcaatccaaactatcaatgttgagattgctcttgaactcttcaaacgggcgcatagccagtggtttggtgaatccatctgctatttgatccttggaagaaatatatcctatctcaaataattttctagaaactcttctcgaacaaagtgataatacaagcatgaaacacatgatttgctgatagatacttaactccaatgttatcacaccacatgattcgcgaccttaggtgcatctataccaatttcacataacagagtcggcaaccacataatcttagctgtttcatcagctaacgccttgtattctgctgcagtgcttgacctggacacagttgcttgcttctttgcactccatgacactttagagcctagaaagatagcaaaacctctagttgaacgcctgtcatccaagcatcatgcccaagtccgcatcagaaaaaccattgaccaacaaagaattgacaaaccttgttaactgagaaagaaatacctggtcttgtcaaatttaagtactggagtgctccaacaatacttcagtattgcatcttttggcccaaatagattcatgagttgacaattttatcgcatctaagcaagggagtacttactggtttgcaatcgtgcattcctattcgttgttaaatatcatatgcacacttggcttgaatcaacattatttcatcatttaccttcacctctatactaagaacgtagtgcaagtctccaagtccttcaaggcaaactccttgtaagattctgcaacattaattttttttgaggtgaaagcggcaagagtattgccgaatatattagagagaggagagttttacataacgttcaaaagagcaatattacaggcataaagtgagcgcctcgggctattaagcatataggtaggtataagactaggacgacaagctaaatcagggcagttggaaaacgaaaacgctttcttgtatgtcttcattgatctgttgggcagctcgacttgaattcggttcctgatgtttgaagatttttgcattcctttgcagccatatgtgctaccgtgtcttgattaggatttcgactcggtgtcgtgattctattctactggttccctgtgctaaatccatcatccagtgtgccaaggaggtttggtttattgtcccctgtatgccctgtgttgccgctacaagttccaagttcttctagtgaaatcacattccctgaagaggtgttcagtgtcttcaaaagcgcttctacacagagggcaaatccaatcgcattcccaatgtcggattagaaggttttcagctgttagggctcttttgtgtagcaccagccatccaaaacaatctttgctttggtagtgcctgtgctttccagtttgctctgagaatggggtcttgttggcaagttatgaattggaacttgtaagaacttttgtgctaagtagatacctgtgctggttctcttccagattatagaatcttcattctgtattgatagttgaatgtttgatagaagattgccaagttgcaccagctcgtgtatggcttccccattgtcaatctgtctaagcgaaaacacccagtggttatcgtcaagttcggttgctagattcttgttttttcctgttgccaactgaaagaggtttggggcaatttctttggggcacattccttggagccaattatccttctagaaaagaattttttgcccatttccaatgacaatttgggtgcaggcttggaagagttgcaaatcttttgcattgcatggtaattccatgtcattccatggtctgttacaatcatgccatcttatccataaccatctcacttgaagggctgatgaaaatctttccaagtcaaggattcccaaccctcctagttccctcggcatgcagacgatctgccagtttacaaggcttttttccggctttacattctctgcaacattaatgaagttgcacttgctgtagatctagccactattatattgccaacataaataagcacaaaaattgtgatgtctcctttagtataaaagaataaggatgtatctgctccttgatggtttaaacccaagctcatgaaattttatacttaactaggctcgtggtgcttgtttcaagccatacagagccttgtctaacttacatatataagttttgagttaacaccaagcacttatacaaactcaaaaccacaactctctcgcatacacacacacgaaaatcatggatttggggagaaaccactgagtgtccgtctcgcacaggaacatggtagaacgactcatcttggatgcttcttgactcacccacacatttgcatcgaacccgttagctcgatcggacggctacacaattgctagtagatcggacaaccatggaaggcgtcattgcttaataaagaacgagaacgctctctgttaagatttcacaatttaatatggttataattgtaatctcacatatccttctccttattttctgttgtattccgtctaaggcatagttcatattcttattgcccacattgcaacttatcacgaatggctttggtatgattctgtaaaaaaaaaaaaggcaggccgtggatttcctccaaactcaatcgaagcagacgaacgatccaaactgcctccgcacattccagaaacagaagggccccacacgacccccgtttcctcccctatttatttccgccgtctcccccgcgagatcgattgatcgaatcgaagaaaccccaaaccccaccaaaaccctcgccccacgccttcttcgtccacaagcctcgcgcgcggcggcggtggcggcggcggcggcgtaggcgtgatgaatatgtcgccgcgcattccggtggtggacctccaggacgggtggcgcgacgtgctccccggcgtcgccaagctcaagtgcatcctcgatggctccaacgtcgtgcacttcgtccccgacgagtacatgcacctctacacgtacgttccccaatctgctcgctcgtcttctccgcttgggttctctcggattcgcgggggtttttttgttcgttcgttgttggttccaatctgatttgatctgatctggtacggctgatccgtggcaggacggtttacaacatgtgcacgcagaagccgccgaacgactactcgcaggtgctctacgatcgctacaagcaggccctggacgatcacatcgaatccgtcgtacgtgtgctgctcttaatctcccatcctttttgttttgggtgttttttctgcgacccggctgctcgatttcgccgctgcacgtttaggttcttagtgcgatgatgaattattgccgaagggggttttcggtttattctgatttatcagcgattttttgggcgaatttcgcaccaattaggggttgccgctggtccgtacagtttaacatgttgcacttgtaacccgtgatttggaccctcggttgaggacttgaggcattatgtggacgattcttatttcttaactgtctgttattgtttttaaactttttttatcgatccattgttattccgcttttttttttattgttgcttagttgtgcccgtgcgcaggggctgatcagtccctcctgcacccacaagacccatggatatccttaggaacacccccttcaattttttcaccataaattcaattttttcaccataaatgataaactaaaggtccctaaatggctggaggttaaagaaactgtgtaattaagcccccccaaatttttgttcctggatccgcccctgcccgtgcgatgcaaccaaaaaaaccccgatagtgaaaatctcttcatagtgcgtaaatggctgacggaaatcatggaaagtaaaattgaacgtgatcttgtaatggaaacataataggacttgtgtttgtgcagcctttgaaaaagccaagacgtttcaacgtagtagcaattacatagacggctgatggcattttgacgcttatttaatttggttcatttttttttctgctcctgtgttgcaacctgcatgttattggtgtcctcctgtgtatttcctgaatgagttcttggagatggatatgtatgccttatttatgataattgtttgcagtgaagcatgttaattagattgattctgtactttcagtgcgaggcacatttgttgggatcgatgattgcatcttaagaatgatagtatgagatcgttaatgtgcctttttcctaatttatatctttgagcttgaaggtgttgccctccttgaatgagaagcatggcgtgttccttctgagggaaatagtgcagaggtgggagaaacacaagctaatggtaaggtggctgaggaggttctttgactacctcgatcgttactatgttacacggaggtcccttgattcactcaaagatctgggctggagtagcttccgggatttggtgagcctcagttagttttcagagaatctttagacgagtataacttagaagcactacagttgcttattattactccatgatttgacaaatacctttgatgattcttctgttgtgataggttttcgataagctcaaaagtactgtggcaacaattatgattggcatggtgagcttgccctccgcttcttaatctcgtgcgcattctacagagctaacttgatcactactaatttcttttatttaatagattgatgatgagagggaaggcaatctaatagaccgtccactcctgaagaatgcccttgatatctatgttgaaattggggatagtcaactgaattattacagtgatgattttgaacaatcatttctcaacggaacaacagattactattctaagaaggcacaaacatggattcttgagaattcttgccctgaatacatgctcaaggtatttgtggagttctgaaatttacattgctgctaagtttaacgataccctcttactagttatgtgcttaataggctgaggaatgcttacaaaaagagaaagaccgggttgcaaattacttgcattctactacagaaccaaagctatttgcggtttgtctcagttatatgtttgatgtttcttggcagcttttcaatgatgcatgtaaaacatgcaatgactttctgtgcttctgaaattgtacccttcaacctaaatgctttcaggctgcactcttcgagttgatagataggcgtgcagaagaaattctgaacaaggagaactccggatgcaaagtgttgctttgtgatgaaaaggttgcattacactgaaaaaaaaaactctggtttgtgaagttgcaaaatgaggaaatcgctggcaatcaatttactgactattttttgctttctgactgtagaccgaggatctagcaaggatgtttaggctcttctctaggataactgacgggctgcttccagtatcgaaaatatttaaggaggtattgaattgtctcattatgctccacatgctgcactgctgaaatattccaatctccttgaaatgttacttctgtgcagcatgtcattgctgagggtatgtctctgctgaaacatgcaacagatgctgccaacagcagaaaggtgatgattctatgtctttgctctgttccttggcccagtggatttgctctgttccttcatattgtgctttgcaagtttccacatccttgggatgacattcttaatttatatttcatttgtttgtcaaatcagtctcctgtgggtgcataatggcatctaacatcttaattgtgctgactagcctgcaattctataatagcaagagaataagggcatgtttggtatagctccaactcctaaatttaactctagaaattgagtatggagtggagttgtggagctgcctaaacccaactccatctctttagtttattttgtgagagtactcctgcgagctctactctctttctgagtggagctgaaaccgtttggttgagctccagctctaggaaaggtggagctggagttggagctgtgccaaacataccctaattattgctaaatagatacatgcaatagataataatgtgttctaattattcttgaatctgattttcgaatggactatttgttcctagatctcaccctgctgtgaatctttactatgtggtcgatgtagtctgtccaacaaactggttacaataagacccacagaagcacatatggattcgagaaagggatccacgaatattgggtagcccgtagccgttgttaaaccaggtcgagtactttatgaaaagggcggagtatctgaaactgtaaggaagcttattacaactgacagctttacaagtcaattgctattagaaggatttactagttaactggttttcatgctttctactgcaatatttttttcgtgttatttttttcagaagtgaatgcatcgcaaacgttggaattgtattgtgtacaacttgtgctaatcagattacttatattattgtattctgcacgtatacaggatgagaagaagggggtggtggtgggattgccggagcaggtctgaattagacatacatttgcttttaactaaggttgtactactgcttttttagtcttaatgggttaccaccgattttaggattttgtgaggagtgtcatagagctccatgacaaatatatggcatatgtcaccaactgtttccagagcaactcagtatttcacaaggtttgctacttgccaagttaccgaccctaattttgtcttgcagcatttggttgctcaaaccttgtataatgctgattgacctactttatttacttgtctcaggcacttaaggaggcctttgaagttatttgcaacaaagatgttgttggttgcagtagtgctgaactgtttgcggcatactgtgatagtatcttaaaaagaggtggaagtgaaaagctaagtgatgaagctatagatgaaagtcttgagaaggtatatagttattgcaatactgtttgtacaaactagttacgaaatctcttgttcaacagtgtatttaatttgtatcaggttgtcaagcttctaacatatctcagcgacaaggacctctttgtagagtttcataggttcgtggttctctattttcttgatgacaattttattatgttcccaaagtaaataggaaactcacattttggaagcctttgttttttctggaataatctattacaggaagaaacttggaaggagattgctgtttgataagaatacaaatgacgaacatgagagaatcctactctccaagctgaagcaattcttcgggggacagtttacatcaaaaatggaggggatgctcaaagatattacattggcaaaagaacatcagtcaagttttgaggagtacgtaagcaacaatccagagtcaaatcctctgatagacttgaatgtgactgtcttgacaacaggatactggccaacatacaagaactcagatataaatcttccattggagatggtacgtctatggatttcctgtttaatttgcactaaatttttgatgaactatcacagattaactttataaccgtccgattcacagttgtttgagacattctcattttcctatttgagtttgtcttgtaactcatcaatggccacgaaatgcgacctgaatattgcagtgctaagccataatgccatctattgttctggaactccatgttttcaggttaaatgcgtggaggttttcaaggaatattatcggtccgacaagcaacacagaaagcttacctggatcttttccttgggaaactgcgtcgtcattggaaattttgatgctaaacctgttgagttcgttctcaacacttatcaggttatttcgaaatctttgtacaaagtgaatcgctcacacacttaatgcatggaacaaacttctcacttaattctctcttaccttttccctctttggtcaggctgcattgttgctgctattcaatgaagctgataaactgagttactctgatattgtgtcacaattaaaactgtctgatgatgatgccgtgcgtttgcttcattcgctttcttgtgcaaagtataagattctcaacaaagagcctagcaacagagtgatttctccagaggacgagtttgagttcaattccaaatttaccgataggatgcgaaggattaaggtgccatttctaactatttacccattcccccctggtttttcgagctaactaaacgtaattttttttttgtgtgcaggtaccacttcctcaaatcgatgagaagaaaaaggttgtcgatgatgtcaacaaggacaggaggttcgcaattgatgcatctcttgtgcgcatcatgaaaagccgcaaagttctgggccatcagcaacttgtagcggaatgcgtggagcagctcagccgcatgtttaaggtacacggcagaacacatacatgtcgattctgctaacctactttttgaacattctgccaatttgtgtaaagctttcagtcatctgtggtgagaagggagagaaaatccatgttttcttaagacttgtgttgtcagatattgacaatggggatttgttctcactcttgtgcagcctgacatcaagatcatcaagaggaggatcgaggatcttatcagcagggagtacttggagcgtgattcggagaatgcccagacctacaaatacttggcttgatgattggtcctgaggcgacttgctgactgtttgtctgtttactcaccctctggattcctagggcagtgccctgatgttgccaccagtagtctctgtttacttacatccacgcatcagggttgtacactcttttcctgctcaagtgaatgattagaggaaaaacagattaggagaagcagctatggctcggctgtgactgtgaaccacatttacatgtttagctttgacgccctttgctctaccttttgagtttctataatttttgttgattactttcttcttgccgatcattgtgttaaatcgcaactcatcatggagaaagaactttattgcagagtcactggcactttacctgcctagtgcctagcattagcatatgtggtttattaagctcgttattattaaatctaaatacatgtcgatgacacgccctgcattaattgttctgcaggcctaataaacgacctagtactgtataaaataaaataaaaaatgttgggggtaataagcagtttatatctaaactagacgtagtagatcatgccgacttcgataaggctgatgtgcgggatgttgagcacgaggccggggcctctgcaattcttgcggaggaaagcgtaggcgacgttgacggcgaacttcttgaacaccgacgagctcttcctcgccttgatgtacgagtggcccatgatgtaggcgacgccggcgtgcttggcctccaccagcgcgctcagctcctccttcaccctggggtccgtgtgctggttcgccacctcgaaccgcacgcgccgccggctcgcgaaccccggcgactccgcctcgtgcatcgtgtgcatcgagtggatgagcgactccggcttggcggccgcggcggcgcgcgccaccacgctctcctcctcgccgggctcccgcatgaggagccccgtcctggcaaggtcgctgggccgcgggaccacggccatgcggccctccacctccacggaggcgacgaccccatcgtcgctgatgctgcagcgctggtcgaagtcggcctccatctgcacgaactcggcgatccgcagcacgaggtcgttctcgaagtcggtgtcctcggcgagcacgtccttgtagccgtgccgaacgacgcagcggtacatgcggaactcccgcgggccgatgcggccgacgaggtggcgctcctcgtcgcggacgtgcggcaccggcacggccttgacgcagatgaagacgagcacctggtggaacgccggcaggttggtgacgaagtgcgagaagatggccggcacgccggtggccagctcggagtagatgatgccgatccccgggacgcgcacgatgcccaggctggggccgagcgcgtggatccacctgagcgacaccttgttctgcacgtcgaactggtgcttccgccgcgtgccgtagtgccacacgtacatgacggcgacgaacaccagcgacagcaccagcggcagccacccgccctggggcaccttcatcagcgccgccgacaggtacaccgcctcgacgacgccgaacgccaccaggaagagcgccgccaccaggcagctgtactgccagacgaagacgatgacgagcgccatgagcagcgtggtgaccagcatcacccccgcgcacgccatcccgtaggcgttgccgatgagggtggtgtcgcggagccccatggtgacggcgatgcacagcagcatcaggatccagttgatctccgggctgtagatctgcccgtggatccgccgcgacgtgtgcacgatcttcacgcgcgggaagcagcccagcgccgtgcactgccgcacgatggagaaggtcgccgatatcaccgcctggctgcccacgatcgccgccagcgtcgcgatcaccagcaccggccagaagatgcccgctgcaaaatgcgacatttcattcggatcgatgtcgtcgtatcacgattcatgtcacctcaccaccagtgattagcagtagattagaggagtactccacttacttggaatggactcgaagaatacgaagtggatgtcgcagtggggtgatttggacaggaaggccgcctgccccatgtactgcagcaccaagcacgggtagatgagccccacgaacgcaacctgtcaacaagtgtacgtacgtacgtgtcaaacaaatgtcaagatatttaacctgctcttaaaatcaatctgcattatattaaacgagacgcagtactgcactatcagtgctctgacagcaagcataaacagacacatatacccttatggatgcagctgtgaagtggccaagatccgcatacatggcttcggtccctgcacatacatacatatatatattattataaaatatgtagttgatgagtcgcagtgcagcgagcaaaataaggtttgtttgcctgtcatggagaggagaattcccccgagggagatccagccgtccttgccggtgtgctggaagaacctgacgaggtagtaaggggagagggcgcgcagcaccctggggttccacaccacgatgttgtagacgccgagcgccccgaggaggaggagccagacgatgaccaccggcgcgaacaggaacgccaccctgtgcgtgccccagtgctgcaccatgaacaggcacaccagcaccgtgcacgacaggatctccaccttcccgctcgtcagcgcggtcgagtgcacttgcagcccagagaaggacgacagcactgcccagccagcagccaggacaaaagatcgatcatcgatcacatcagcaacccaaaccacacaccaagtagtagtagtattacggtacgcgcgctcaccggacatgggcggcgtgaggacgccgtcgccgatgacgagggaggcgccgaagaggacggtgacgaggaggaaggtgcgggacttgcggtggttctcgaggaaccgacggagcgcggtgaggatgggggtctcctggggggcgtagccggggcggtagtaggaggtgagctcctcgtcggcggcctcctggtttggcatgaggctgaacttggcgtggcgcaccagcagcgagtagagcgcgaacgtgccgccctcgccgttgtcgtcggcggcgagcacgatgaagacgtacttgaggagcgggatgagggtcagcgtccagaacactagggagaagacgccgaacacgatctcctcgtcctggaaccgccggagcgacccgatgatgaaggtgctcttgtacacgtacagcggcgacgtgctcaggtcgccgtacaccacgccgcagctctggtacgccagcagcagcacatgcctgtagtagctcctccagtgaccctgtacccgtaattaattctactgattatttattattttatcagattattactttcattcttcgtattatggccctgtttagttcccaaaaactttttcctaaaaacatcgcattgaatcttttgacacatacatggagaattaagtatagataaatcaaaaaactaattgcacagttagagggaaatcgcgagacgaatcttttgagtctaattagtccatgattagccataaatgctacagtaacccacatgtgctaatgacggattaattaggctcaaaagattcgtctcgcggtttccaggtgagttatgaaattagttttttttattcgtgtccgaaaaccccttccgacatccggtcaaacgtctgatgtgacacccaaaaattttcttttcgcgaactaaacaggcccaatnnnnnnnnnnnnnnnnnnnnnnnnnnnnnnnnnnnnnnnnnnnnnnnnnnnnnnnnnnnnnnagacaggcgatcatcaccgc

SEQ ID NO: 375 - DNA, 6154 bp, Oryza sativa
  unsure (1)..(6154): unsure at all n locations
cgcggccagtagagcnnnnnnnnnnnnnnnnnnnnnnnnnnnnnnnnnnnnnnnnnnnnnnnnnnnnnnnnnnnnnnnnnnnaaatcaaaaaactaattgcacagtttgagtggaaatcgcgagacgaatcttttgagtctaattagtccatgattagccataaatgctacagtaacccacatgtgctaatgacggattaattaggctcaaaagattcgtctcgcggtttccaggtgagttatgaaattagttttttttattcgtgtccgaaaaccccttccgacatccggtcaaacgtctgatgtgacacccaaaaattttcttttcgcgaactaaacaggcccaatatatggagaaatacgtgcttatttaatttagggaagattgcaaaaatcaccctaaatatatcatcctaagttcgagatttcttcatgtaaaacgacttgttacaaattccatgtcttaactcaccttgtttcgatatatattcctcccaattaccattgtttgcgcgttttttctcctcgtgtcttacttggtttagtgtattttttgatggacatgacccaaccacatcttttgcacaatgtaagggcatgtttggttcaatactaaacttaaccataccaaatacttggcattactcaaaaactgtcatccatttgttttatatccaaataatttgtcatgccaaattatttggtttttggcatacttcataggtagcaaataaaacacataccaaaacattagcatccctttgtggtaacaaaccaaattcaaagcctagccaaaaacatttggtaacaatccaagcactttgcagaaaaataaataaataaaaaaaatgaggcaatgatcaaatcttgccatgccaaataaattggcaaggccaacaatggccaagaaccaaacatgtcctaagtttttttttttaatctggttcggctgaggagagacaaaatcggtaggaaaaaaaagctgtccattttccttccatcattggtcgcactaaagtgatacacattgcaaaattatttaactagcgtcagtattcttcatggattggtaatactgtatactactgatgccctctgtgctcacactgtctgactcggtcacaagctatttttaggacggtgttagtaactagtggtgtaaaataacaatgagctactcctactgcatgccactcttaatgtaaatgttctccttgcatgatccactcttggaaaaaaaaacaaacaaatcactctgttattgtcaaataattcagtcaagaataacattttagttgggatcgttcttcctgattaggtactagtaatatattcttccataagtatggtcagagataagatgcagggtacattaatcaacaccatttcctactacacctcagtaacataaaggaggaaataaagagaaaaggaaaaaaaagggtcagattccgttgatggaccagcaccgatgttggtttaggtaacagaaatgcaaaaaattgcaaacggtaggggtgcacatcatgtccgtatgcttacacaatatcacaaattcatcacaagaggcaaataaataaattatttggaaaatgcgatttcaatgcacgccagagcaaggggaaatgtatagctcaccgggttcccgtttgcggcacctgcaccggtgacatctgccggcgagagaccgctttcgcagtcggccaccggcattttattttattggaagatgaaaggagagggaggaagatggccgggatggagtcaccaattgcggacatgcgcactctctctcactgcgtgcttcttctccgattcgccgtcccctaaatctgttgttttatttgggttaatgagcactcgtcggtattcttggggttatgtggatgagtttgtattcatcgaggcaaatgtagaggggagagagagagagagggggagagcccccggtttataatgaggtgttaacagttgtggccatggagtcatgcaaagatgaagcattagaggagtagtagcgtatagtactctaattttgtagctgtgccgctttttaagatattttactttccttggaaaagtactggtacgtattaaaatttacactaaaaaatttgacaccacgaaataccaaatatctagaggtaccaaatttatattatcatcttcgggtacatttttaagaacagtaaaattactcatagtccatgctgtttgtactttttattcgggattgttattaatacttaatagtgtcaaagaccgttacaagtaataacaatgtgttgaggcgttgagcgaatccatttagtttttaacttaaaaatagcacttcctccgtttatgtaagtttggccaggctttaattttttctaagttaacaattcttataacaccaaatttcattaaatccaacagtcaatatattttgatggaatatttgttcggtgttgttcttttataaacttagtcttaagaagtttgacttaaaaaaagttaaactatattatagagtgcattatttatttagggaaaagtccgaattacacccctcaactattggatgagtatgaattatccccctaaacctaaaaaccagacatctttaacccacaactatcaatatggatgaaaaaccccctaacttgactcagtgcgaatttggatcatacgtggcggtccagtcagcttaaaaaatggtgggacccacctgccagctcttcctcttcttcctcgttgccactgcttaaaaaaagctatgtcgagggtgaggcggtgacaagcgacacgggaggagccagtgaaggaagctggggggcagggctggcgcatctcgccgcaccagtagaggggggcgactgacatcgacaccgggctcagatatgatgattttgatttgggggagtcggtcgagaatttgagagcaatggcggagaaagtgagccaggggagcacggtaggggaatgatggcgtcctccggggtcgccgtcaccatgaccaccgtgcccatgacggaggagcacatcgatgccttcactcaccaggtccggctctgcttggtccccctcaaggatgtggctgggccaccgctgacgtcgccctggcaccgaggcggaaggcgatgacgaccaccactggggagagcgcgtggcggtggcggccgtcaagaaggagtgcaactgggggcggtgggactcgagtggcggaggtggaggagctcgagcgacactagctggaggcgatggccggaaagggaatcggcggcgatgtacaggtcggtgatgttcatagggagctccacgcagcaggccggcatgagctttggcggcgagcacgcacaacagcagccgtgcccccccaccgccgttcttggctccccctccgccactccgagctggctccatcgtccccgcctgttgccgctgcttcgaggtgccttccccgtccctgcccgctaccactgtcctcagctccccttccgccactgagctgcctccctcgatgatgcccgccatcgccatccttgactcctcctcggccggttgctcggtgatagagagagggggagtcgagaagagaaagagaaagagaaagagagaggtgaggggaaagagagagaggatgagactaaaaggtgggacctatcgatttaaagaaaaagaattgctgactggattgccacgtaggacaaaaactgctccgagtttgagttagggggtaattcgtccggtattgatagttaagggtgaaagatatctggttttcgggtttagggggggggtaattcgtactcacccaatagttaggggtgtaattcagacttttcccatttatttatcggctccatgttgacaggctaggtttgatcaaatgatgtcaaatcatttcaacgtaccagaacactgcatataaggggcagatgactcggtatggcgagctgtggcgctcgccataccttgatctgctagtgagacccccccggggcgcgtcctccttcctaggacgccgcgccgcaccggcacgatcgagagagggagagtgagaacatggcgcgatcgagagagagagagagagagagagagagagaatgggcctaattagttggcctggttcatcctttatgtgcgaaggcttgacgagttcaaagtttgtcatgatttagcaagcctagcaaaaaagatggctgaacttgagagacacattgtatttccattggtatattgtctcattgagttagtattgcttttactggtggcgactagatcagttgagagggccttctaggtaatgaagattatcaagacggagctacgcaacaagatgtccgatggttggctcaatgacttgatggtgtgctacatcgattcaaaggacttgattttcaaaaaaaatcaaaaaaagtatttcagaaaaagaaaagtaggcaaatgcaattgcctaaatctcctagacctctaagcaattaaataaatgtttggtataccttcacattttattccaatcattgctctttatgttatcaatcttaagtatatagtatactaattaatctttgcaatttgttttgcagtttctatatgtctatctatcctcactagtctctagttcttatatgtgatgcattgctgacagctggaatcttagaggtattatttacaattttggcaaatggatgatgaatgtgaacctatggctagtgcttgttgccatgtttgagattgcgtcatgatcggataatgttgcgtcatataatatagtgcattaagattgtttttttttctttgtgctagtccatgggccacaccggcgacaccgtcacacctaattttttttcccgtcctccaccactgtgcatatataaagataagcagcattattaatttgaaggtgcctctaggaaaaaaacagaacaacaattttctacggcgagtgcccgagcggaacgccacaccacacaaagataagcatgcgagatttaggcacaatgctattcttagtgccacaatgcagcaccgacacctgccaagcctaaccgtgaatcccttcttaactcccgccatggcgctcctctccaactcgaggaggacacgcacgttgccaccacaggctacgcaaaattctctcccttcctcctccaccacctccactccgacgatcctcctcctgatcctgtgccggccggcgatggcgtaccggttgctggagctcacgctggtctccgcgagcgacctcaagaaggtcactctcttctcgcgcatgcatgtctacgccgtcgcctccatctccgggagcaacgtccccatgcccatgcacggcacccacgccgaccgcaacggcggcagcaaccccgcgtggaacaccgtgctccactttcccgtccccgcccgcttcgacacccgcggcctcgccctccacgtacagctccgcgcccggcgctccttcggcggccaccgcgacgtcggggacgtgttcgtgcccctcgacgacctcctcgccggcgcgcacgacggcggcgagccgaggccggctagctaccaggtgcgccgccccatgtccgcccgcgcgcacggcacgctctacttttgctacaggttcaccgacgtcaagcatcccgccctcgaagccattgaggccgcgaccgcgaccgcgacgagcagcgccaccaaacaagggcaagtacgtgcccatgtacgcgcaggactctgatgagaaggcgacggagaagagcgtgtcgtcgccggtcaccgcctacccgccgccgtcgaacgccgtggtagcgcacccgccggtcgtgccgtacggcgccccgtacggaggagggtacccaccgcatcagcagcagtacggttacgcgggtcagcccccgtacgcgtacaacgccggcccaccgccgccggcgacgtacagctacgtggcggcacaacagccggcggcgaggaaaggtggacgaatgggcatgggcctcggactcgggctcctcgacggcgcggtcggcgggatgatgctcggggaaatggtcggcgacatggaggctgacgccgcatacgacgccgggttcaacgacgcactggaatnnnnnnnnnnnnnnnnnnnnnnnnnnnnnnnnnnnnnnnnnnnnnnnnnnnnnnnnnatgngagctgcattcatgcccg

SEQ ID NO: 376 - DNA, 9335 bp, Oryza sativa
  unsure (1)..(9335): unsure at all n locations
cggagcgggagcccttttctttccacccgagcggcggcggccccttgcctccccaccgggcttttacccttagcgggagaggcgcngcccctccacctccaccaaaagccgtccccacaccgggcgggcgacccttgcctccccaccgggcctccacccttagccggagaggcgccgcccctccacctccaccagaagccgtccccacaccgcgccggctaccctcgtctctccacccgtgccgccctcgacatgcgccgcctcctcgccgccgtcgaacgccgacgcccctcgacgccctcgaccgccgctgcctcctcgccgccctcgaccgccgacgccccgcgccgccaggccgcagccacctccgccggtcacgatcgccgtcatctgaaggtatgtatcccctgacgatatggccgcaacatgttccagtaagaagctcaatccgtggtgtgattttgagccagctgttacgattaacctggctctaggacatctgctgataatatttattttctaaatcatctatgtgatgacgtcgaccattcctgtgcacctgtccaactcctgttttctactccttgatttccatgtatatacagcttgagatggtttgattttcttttttgatcaagctatctgaatcgtcttgttctcgaaacatccctataatgtggtttattttttttaccgtgtattaaaccaaatgttaggtgtaggcaatgagctcaagtgttcatttatcatcagttcatgtttcaagctttgtgaatcccttctttcatcacaaatacattaagtaataatttttgcaatcaagtagtaatatcccattttttatgactacgtggtttgtcatgtcatgctcataagtaagaatattaagtttctttgatttgtgattgttgaatgactatgtggtttgtcatgtcatgctcataagtaagaatattaagtttctttgatttgtgaatgttgaatgactatgattctgaacgtttacatcaaccgatgagaaaaaaacaaccatcagcagcactgagattctgccttatggtttgtactggattgaactctaataaatttggacttgtgcatttcagggttccaatggatgatgctaaattaattcttcaggtctatgatgctaaattggttagtccatgttttgcactgatattatcactgatctgtaattgttcttgcagaactcttaaggatcatctgaagattgaatttgaaagagcagtggactgatgtgctacttcattttattactttgcatgctctgagatcaacaatctctcatgatagatagcatattacgtaatgctggagacgtggatagagattagtacattcattacatatgatagatagcatatcccatttttgatgactatgtggtttgtcatgtcatgcacataagtaagaatattaggttgctttgatttgtgaatgttcaatgactatgattctgaaggtttaatcaaatggtacctttttttttctaaagggtttcagcaatccatattattatccatttactgttagtgccactaatcatggttgctgctctttcaaatatgatgctgtgcagcatggaaacaaaaattggtttctctttcatgttaacagaagctatgaaccatcctaatactaatttatcaatggctattatgcatctgttcaatagtgactcgatcagttatgtgatctacatcagtgagataaccgagatcaaattattatgtgcatgtgtgacaaaatatttgctgtttaattttccttccacccactatagcatacatcagtgatataattgaaatcaaattattaatgtgcatgtgtgacaaaaaaaagaagttattatctgcatgtgtttctcaaatttagatagcaggcctaatcttttatcgagctaggagaagccctgagtgccctggttaggaacaacctggagctatggttgatgaatcatgagtaaagagttttcggttctgtcagaatgaaaaatgcctgaccatagctctgaagatgagtacatcttttgcaagtcttgatctgtgcacctcttcagctgactgccagcatgaaaaaaatatgattatgattaggctttttgcaaaacttggatttgtgcacctttttaattagggatggatggcaatatgccaatatgattgctgtatagtagcttgaggctttgaggttgatgaagggtacagtgcttcttcctgactttttttttgtttcaaaatagctttctcggtgcctttttgtttgcttatgaatttatagcatttgtgtagagttaatgattttatatgtcattataaatcagttctttcatgacccaaataaaaatctaactctaaagctacaattttattatcgttttttgtgaacctaaatatacaattacccacagatttgtatcaggagaaacaatctcattatccttaaaattatctaggtattcaatatgaattttatatgtgagcatgatcatatgttcagattgatttcgtttaagtttacatactgatattaatttgatgatctactaagttcgaatgccttagaagaaaataattatgccttttatttattcttctgacacagtccaagtctgtttggagaaggaaacaggctaggaaaaaaagtgtgatcatggtccgctgcaagaaaagaggtgcatttcgtactatacttcttttctctattggatcatttagtgtgaaaatccaacatttttttggctctaagtgaacagatgtttttttaaagggctcgggtcatgaaaattgaactgtaattatacaatggttattgttattactgttgcaaccggacgccatttgatgttatgcttggacggatgaacacattcagatttattattacttggagacaagatgccaaatatatgttctggtcatccatgggaaccgtttgggagggttgtgtttgcacacgcttttgcttgtacataaagatttatgttctagaaaccagtggaaatcatttttggtcggcaattgactgtcgtaagctgaatcatttttggcaatgggaatgagatcaatttgcacacatttaattataggtatttgctgtgtagcatgcattggtttgtacttgtgcattaatcttgaagttcactggtctacgagggaaacttcgttggagggcggcaactgtcatggttcatggatgcatacgaggtgaccctcctaatccagtggattggccaccattattggttaatattgattttgattcctgatttccttgcagcacaacgccacctggtggctgacaagccggcaagtacgagtatgtcgattagttgtgcatctttattccatgccgctatcatatttctgtgcattctaggaaccattgaccagtggcactctgccaggaaagtggctaataatgtatcttgttgctacttatccagatctacatataatctctttggtagtaattttggactaatccctgctgcatcctcggtttattgaattgcattttaggaaaagcaacaatgggaatctggagcacaagtcatcaatggcgatctgcagaagataaatcaaacctgtgatctgaatgaagctcatagtttttcccaactccttagtactactacttgctagctgattctgattagatataattgttgatggtttcgaattaatttctaaacaatatgatattttgaacttttccttaaaaatatttgaaatatgacattcatcaaattaaagctcaattggactatatctgtgaaaattaatttgactaacatttcttatgaaatttcagactttggtgcgtcttatagtcacaatgtagcaagacttgttcagtctggattgtaaactctggaaaatggtttggggtggttacctgctgttaattcattctataattaaaattttaattatcttcaatttcctttttatgagtcttatatctataactctttccatgcttgcttgccaaaacatataatgccttttgtttgttcatgttactaacatccaaaatttgtaattattttgcgtgctatattaagttttctattccaagaaatttacactcattgattatttaacatcatttgacccatagtgattttaaatttatgtataatttttcccgttgcaacgcacgggcacccaactagtaggagtactacatatataacttaatatcaacttggtatatatttgtaattaaactcatattttggaagttttaaatcatgaaaaatgttataatcaagattccaaaccaagcacaaattggtagttaacatttaacaaagggaaaaggaagaacaaaaatagtagaataattttgacgattgttttccctcaaaatttgctctcaaatctatcctaaaccggattaaattgtatttacaaatgtcataaaccaacttggattggaagttccagtctctaattcgaaaattccaatatgataagaaagtccaaattcctcaattctcaagctctctgtttaattaaaatattttggatgaaaggtcctatttttcatcgggaaagtatcatacatttcgtccttatccaaaactccaagctatctcctccaccacacattcccttccttattttttttcttttcctcttactctctatagtctcaaagacactgcattgccaccattgccgggtgtagtggcagagacagaaattaacaaatcatagagttgggtagggctcaactaatgaagttttttttttcaaaaaattacatggtgaattaagagaatttaagcatgattatgaaggcaagcctacggctcaagcccaagcttccctaggcttgcctctacttctgccgggtgttatgagagaggccaaagctattgttgtcggtggctacacgtattgcagtggtaggcggtgttgatggcagtgttggacttggcaaccgatagggaccggatgcggacactgctggtcctagctaaggttgcctgcctcgtgccactactcatctatgtcattccctagacatcacctcctgctgccgcatcagccacttagtagtttcggcggttggagtatgagaagaagacggtagtggttttattttgttagagttttagcgatgttgcagtctattgtttatcttattgcactttattgtatcaaggtgtttcattttgttttgaatcgatgttgcatctactgattcttcgtgttgtagtcagtatgtttaaaatgttgatttagttgaaacactttcgttcaagtgatgaaacattttttcccgattgataaaatatatgaaacatttttcatcgagtaatgcaacatgtgaaacattttgcaacaatatagtgtaacaccttctggtgttttaatgaatattggacgtctgatttgtagcgctctccagagttcagttctggtatgaaacccagtgttttaaatcgccggctaagacatttagcaattggtcttctcaaatagctaatagcgggctaaatggggctagagcatctaaattatacatgagagcaaatagctagatcctcaaacaactatatccagagatagcggaatggctctatgtcggtgtgttgtggtggaggcaaagtagcttgccaggggtggtttcttggttattttggttgtctcgtttatggtttgatcataggaagttggagcttctctttgggcttgacaatgatgagttgtgtttgagcttcaattatgctgccgcaagtgtatagttagttctttgtgtggttttctttgccagttttacccaattacctgtgcatttatgaggtttttgttcctggtttaccctaaaacatgagtcccatcatcttttaaggtttatcctaaaaatgacgactggattgttttggccattggatatgtttgtgtttcctaatcgcttctgcttcagaaaggagatacaaaaagagagtgagaagcatgggctgggctgcgccttgtcaaacttcaccaccccaagcctctcaaagcctagctacgccatctactgcttcataccattgctagctaccactgttgtcgccacacagtgtagccaccaccaccatgggctgcgctaatgcttacctcttctctgctttcttgtctgctcgctgttgctgtttttgctggccaataacagggaaaggggtaaggaagggagagaagaagaaaaggaaaattaggggattttgtggaattataggattggtaccaatgtggtactcaagtttatgacaaactacttgttgtgataaatggactagtttgctctatttattttctttcattttccttaacttatgcattaatgctaccattctagttatatatgcaagtttcaagttgatattaatgtaaatgatgctcttattgttttatgattctatattctcaatttggttatgtaattcaagtgccataggtaaccatgatggcgccatttggttatttattcagaatccttgagtaagcattggtgatcttgcccatttcttgtggtagtttgttatatgaaagagaaaaataatgtttttaggtcattccttatcagtagttgtcatggttacgaataaggcataccctctattctactagtcatggaatatacggatatggcataccttcgtatgtatgataaagctccgtatgcgataaggacatcgacaagagattatggaaataatcctcatgggcaagtgcatgacagagtactactcggaaaggattctgatatatcatatcgtgcagtgtctggggtctctgagttctacttggagaccaagagaattcacaatataaatacataccccctgagggtccaaggcatcgaatcataacaccaataacccgtcaccatagaagtaatccagaagacttgaagcctgctcgccagtagatcttgtcgagaatctcttgacaaggatcttgcttgtaatcttgtaatcagttgttctctattgtactatgtggtttccatatcaatctcataaaaccggattagagctattaccttacaagggatctgaactagtataatccttgtctctttgtttgcttgacgtcaaatcgtgtagatcctcgtatcaacataccccaatactctcatcatccgttctacaggtatcccccgtcgatagtggagtgccaggtaggggaacttggtgcacaaggttctaccgagatgatttcaagcttccccgacgtctgcatcagcactagcttcggcccaggagatccaacccagacgtcgctagtgtggactcaagttggatccatcgtctttccggtctacgctgcaaaaccaatctcgtatgccctagtgtttgtcgagattgagaatggtgcagcaaagaaaacgagaaacgacatcacttcagccgcacctcccgtctcgacagaaaagagggcgccgactacgacaacactcaggaagaagcctcaagcggccaaatctcgttctttttctgcgaaacaggctctgacggactacaaggtggtacaacacatgaaggctaaactcgaagcttgcaaataacgagatattcaacgcgtctcaccaaccagattcacctggtgtagtccaatcaataagtcaagaaaacatgacctttcaaactgcaaggttttccttgacgccactatacctccacacccccagatccaacaacgacaagttcaatctcaacatgttgcagaggaacaaagcgtggaaggatctccagatcgcttcgtgggatccgtcggcattgacccccacaaacccttagttctacatagcatggaggatcaagaatcttcagcatctaatactacacgtgatgtgaacgttatcgaaggagacgctccaagcaatgcaaacccatgtgatccacctcatcgcgaggctacagatcctgtccgtactcatgcataacatctcaccgcaatcgacttgctattgagagagtcctttcgatccggttctgtaccctgaagcagatcactggttggaagaatacgatctacaatatccaacctcaacagtgcctttacagcaacagctggaccagcaactcagggaccctcttgtcttccggcacaaggagaagaggtgcatgccgatgggaacgtcgatgctaccgaaatcctttgcgagcacccgagtcgagattaggccggaacctttggaacgcctcaccaagacgacaaagtcagcagaccctatcgccccgagatgatcgcgaccttcgcgaccacttgaacgggtgtaggcgggaacgataggagcaggatgacgtctgccatcaccagcgacgttctccacatcgacaacgcaataacaacggtaaccgaggaggctgtgacaataacgccaaagccaccatgatgaaaacagcttgtcaaagagaagaaaaagcaacgccatgattttttgcttctgcaacgagcgcctgatgcagagcattgacattgtttggaggttctcagagctggctatcccatttattggaaatgcagacatgctaataacaagctgcaaagctggacaacagcaagcacactatggtatgttcccacttccgaagccgaaatccggtggcatgccggccatcaccttctgcaccgtcggcctggccagcagcgcctcccaccacgccttcacgtgcgggtacgcgtcgaccacgccggcgtactccgtcgccatgaagtagcgcatgttggagaagtggctgaggtccgcgaggctgatgcggtcgccggcgaggtacctggagcccgacagcctcgcctcgtacaccccgagcaccttctccagcttccggacgctctcgtccacgacgccctggtcgcggtcgcggccctcgaacttgttgatgatgcagtgccacaggatgggcctcacggcggcctcgtgctggtgggctttcacgtccagccacacgtccaccattgccgactcctccaggctttcaccttatccgagtcccaggaactctggtttgtacttgcgaaagatgtacctagcgattgctcgcgattctgacaagaaaaatacaaacgattttagtttcttcttttgggcatagtgtgttatatagtatgtgtatccgtgatcttgaataaagaattaagnnnnnnnnnnnnnnnntcatacctgtttcctgtgtgcaactgttatcagctcacattgccacactacatacgagccgatannnnnnnnnnnnnnnnnnnnnnnnnnnnnnnnnnnnnnnnnnnnnnnnnnnnnnnnnnnnnnnnnnnggaatccatntcaatgccatg

SEQ ID NO: 377 - DNA, 707 bp, Oryza sativa
ccgttgagactgatgacacgtctactatagggcgaattccagctcggtaccctatccgattacgaagtcttgagttttcccgactgaacttttccggtctgcctgccattcaactgcgtaatctggctcgttatgctggcatggcgtcggtaaaatatatcgctcgaatgccacagcagagaaagcttgctgtacttactgcattcgttaaagcacaggaaataacggcattagacgatgccgttgatgtgcttgatatgctaattctggacattatccgcgaagcaaagaaaaccgggcaaaaaaaaagactcaggacactgaaagatcttgatcaggccgcattgttactggcgcgggcatgtgcattgttgctggatgataatacagatgtcccagatctcaggcaggttatcttcaagtgcgtacccaaaaacagactggcagaatctgtaagcaaggttaatgaacttgctcgtccacagaacaataatttccatgacgaaatggttgagcagtacggtcgggttaaacgttttcttccggcggtgttgcgggacctgcatttccgtgcggacccgcaagtggacatgtcctggctggattcatattctgcaaaactgattggtcgaaaaacgccatcttgatatgcgcctgacatataaaaccgtcctgtgaacccttgtatacaagccgagtacggatcc

SEQ ID NO: 378 - DNA, 772 bp, Oryza sativa
  unsure (1)..(772): unsure at all n locations
aaggctgaancctnactgtatagagacactatagaatactcaagctngacttgtattcttgttttcgtcgattgaattctatttgcttctctgaattattccaatcaaaactaatacttgttgttctctgaataactgttcaattaatagtagagattcagtaattctttattcaagatcacggatacacatactatataacacactatgcccaaaagaagaaactaaaatcggttgtatttttcttgtcagaatcgcgagcaatcgctaggtacatctttcgcaagtacaaaccagagttcctgggactcggagaacgtggaagcctggaagagtcggcaatggtggacgtgtggctggacgtggaagcccaccagcacgaagccggcgtgaggcccatcctgtggcactagatcatcaacaagttcgaaggccgcgaccgcgacccaggcgtcgaggacgagagcgtcccgaaactggataataggctcgggagagtccaagcgaagctgtctggcttccaggtccctccccgggaaccgatctgcctcgcgggcctcaaacacttctgcaacatgcgcttctncaatgcatccgaatatccccagcngggtcgtccttacctccaccctatatattgtgtgaagcgctttctgccctcccctctgtcgctttaggattagccctccttcccccgatctgccctctcgtggtgcgacaacgctacgagccctctctttgtagctttaatttcccttagacgtcgcggtat

SEQ ID NO: 379 - DNA, 736 bp, Oryza sativa
  unsure (1)..(736): unsure at all n locations
ctggccagttgaacnnnnnnnnnnnnnnnnnnnnnnnnnnnnnnnnnnnnnnnnnnnnnnnnnnnnnnnnnnnnnnnnnatatttatgcttgtattgctgcattttgtttctcagggcaaatactttgtcaccaaatgcaagacaagctaggatagcatcacttgaaagcatggtgacaatatcttcaaatactctcgttgctatggcttctcaactctcagaagctgaagaaagagagcgtgcattctctgggcgtggtcggtggaatcagttgcgttcaatggcagaggcaaagagtttactgcagtatatatttaacgttgctgcagatgcaaggttggtatttattcttttggcttcattatttaatagtatggtagcatccatccttgtaggacttctcaatttgcagaacctggaaacaaattatttttactaaagagctaaaaatctcactttttctttctaaatagttgaaaatctgtaagtgttattttgctaagaatatggcactgattcgaataaaaaagtgtggtactgatttgaaaataggaataacaaaaaaaaaattctgaactcaagggcaacttttattctttctgaaagcatgacaaccatgtgaatggaagaacaatgcaaagcggtttttttgtaactttgaaaaaatgatcattttgacaaaagtatggaactaacctcaacttgtgaattatcaatgccaagtaagggagaaag

SEQ ID NO: 380 - DNA, 791 bp, Oryza sativa
  unsure (1)..(791): unsure at all n locations
ngtgatccacctcgatttgtagctctagactgaaaatggcttgttccacggtttttgaaaataccatcaatggcgtagtgtgcaatttttaaaaagtattggcgtgtaatgcaacaattggaggaagccaccatgggaagacaagagcatgtcaatcatagaggtgcacaatgtgatgcctgctgagactgaacaaccaatcgaagacgcggaccccatgcttgttgacctgcctgcagttgaaacaactctgccccttcctgaagccaaagtaacatatggcacaaggaggccctgttatgggtggatcgaagagtacgaaagtgaatccgataacgaggaacagcctgccagattgatttgtaagaggaagcgtccgagtagatgggatgttaaacccatcaactggtgagttctcgacatctgatatcagctgagcatacagtattgtaattcaagaggttatgaactaatttggacaagctccttagttgcctaatataacctcttattgcagttacaacttacaatttacaagcatgtcagtaaggtttataagcatctttagccacgtctgcagctagcatctgatcttaagtcctaactaggctgttaagatcctggattgtgattagatagttgtgacgagtgatgcatgataatttcggacaggcaaaatcacgtagcaatgtgctgctgaaataannnnnnnnnnnnnnnnnnnnnnnnnnnnnnnnnnnnnnnnnnnnnnnnnnnnnnnnnnnnnnnnnnngacgtgtcattcaagcgcg

SEQ ID NO: 381 - DNA, 800 bp, Oryza sativa
  unsure (1)..(800): unsure at all n locations
ctgcggnttgatggnnnnnnnnnnnnnnnnnnnnnnnnnnnnnnnnnnnnnnnnnnnnnnnnnnnngtgactagcttacatgacacacttcatgaaaaactatatcgataactgaggtatataatgacctgtagggactatcagcataggatcaaggcgactcatagaatattagacatcaacatctaccatacccaagcaggtgttgcataggaagaccgcttaaactccgagggctcccaaaaagctgaacgagggactagaggatgggaaataaccatgacaccaccacacatgtgtctctctacgcattgcgaccactttcatcattaacataatactctaaagatgacagatcgccctgagctcacagaaaccatactggagatgtattgccaacacacaactgcctgaatgtgtctgcttaatgccgctcatgcgaagtccttttacatacttaaagaagaagaacgatggccacaagcaaagaatcttgagaatactttcctttgtcatgcatatgactgacaatacatggcataagaggcttgaacaagaaagggtagtcacataccatggtcctgaagatcgttacgactgagaatagcaaagacggctgtgcgtggttcatcncattaccattgccgaagtgcattcaagaagaacattccgcaggccatggcaggacaaaatgactaattgaaatggctataaacgcagcgctgccatcagtgaggtactcgccattgtgacacaagaataggacaagtacggttgcagatagtccaccatatggaaaa

SEQ ID NO: 382 - DNA, 23133 bp, Oryza sativa
  unsure (1)..(23133): unsure at all n locations
ccgcggtgatgatcnnnnnnnnnnnnnnnnnnnnnnnnnnnnnnnnnnnnnnnnnntattacagcagatcgtgaaaggtggatgctctgcaagggcagcacggcgggttacgtcatggatctgccagccacgagggtgtcaaacgacccggaggatgtgctggccctggtgactaagctggcggtgctgcgggacggcgtggcggagcgcgcccacgagatgctgcgcgaggcgctgctcgctgtcgctgccccgaccccgaccacccccaccaccccggcgcccgcgggcttctgaattcgagatctaccacctctccatgaaatgcatctccatgaagaataaactgatctcacagtcgtcacagatcgagatcgacctagcttcccttttattttgtattagtcgtcgtcgttccatcgtcgtccatgcattgatcgttgtatccgcagtttgaagtttgctttcgcttccatccatccatggagatttagtattttgtatccctgcatcttattatgtcctgttgctgtatcgtcatctgctcagcgtttcttcacctccatgtattggctgcagccaccggatgtaatcatctttattttgataaagaattatgcattagctacatgcttgtgttcttcttcttgttatatattggtgtttttttttggaatacgcaatgagcacattttttctattaagaggaataaaagttatttacaataaaatacaaaacagcaggggactgagacaggataaaagcacaaaatcaaagttatatattgttgttaaatttctctcgtaccataacagagtgacaccccgctagccacatagtaattagtagcacccgcaagaaataagaaaaagctcttctggttgttttcctcttcatggaataaacagttcaagttgttctcacgagatgagcgcgaaagtgaaaacgacttattactttacaagctctattttaataataaagttagagacatcttacaccctacgtgctatctttatatataccaagattgtttcaaagctagaaatggaaaccattacaatataaaagtgcaaattaaattagccagagcctgacaatccacctatgtactacctcttcattcttcttgggttcaagaggataaggcctctcttctcattgccatgtctataccagtgtgaaagaagtcggctgactagaccaagtcggctagatgaactaggaacaggatttgttgtttgaacgttaaaaaagccgattagtccaattaatggatccattagcgactaattgctgcttaatttgattaatgggccaagccccacacatatggtgctggtttccacttcgtttgctagtgatagttacaaacctacaatcatggcatgatccacagtagaaactattttgttgcaattggctgagtattaccagcaacattaacatactagtaattggttgagtgctaaaagtataattggtttagtagtaacaatataatgtatgtttaaatggaagcaaaactgaaatatgaagcaaatatacatatttttctgtgaaggacaaatttcgaattattccgactaatcgtccgtattccgattaaccgttcagtgatatcctatcagtttgacacctattttccgtcttttaaaacactggtctctacccaatcatctccacttggacatgttgcattgaacgattcaattcaatgagtatttatctttgttcactctggatatttcaacccttcattatgttgaattgaatctcctatatacttaaatttgtactagaaaattaaaatgaaccaacaatgcatttaaatatgtgctttagaatgaaatgcaacgcgtttaataatattaaatctaaatcgatctacattctaaaatagagttattttaatagaattacgttctttttcagttcacctaaaaaagggaccactatttttttttacaaagctaaaacgacacaaatttacatgaccaagcaatggtgcttatgcaaggtaccttgcctcaaacatatgcccaatatgagcgaaaaaaaaaacaatcgtcttaacaaatattaatttactccatccgtcccaaaatataagcatttttagctatgaataaaatataagcatttttagctatgaatcgtccagattcatagctaaaaatgcttatattttgggacggagggagagtaactgcaaatattgtatccagctaaaaaaatattcaatcaaaccataaactagtatatatttttgcctgaaataaaatctggtaactatttccagtggacatatatacaagtagatatggccataaaatataattttcaagaaacattacaaaacttttggactgatctagctaactgtgcagtgctagcaaatatggaatcatctaataatggatagaaaagatagtacaaaagaaacacaaaaaacattcaatatataccagccagtagattcaagcgttcgcgcgataatgatctcgctccctattaaatgttatgatatgtaaagtgtatagatattctaaaagagtttttgacgaacaaatttgatagcaagtttagttacaatctttttagctataatggaaatattatcatgataacaaataattaaccataattatgtctagcatgtgaaatttattgtaaatcttctattagcatgttaaagaaaaaatataaaatttattgtggtagtaggattatttagttttaaatctaactcatttcatatcaaattttataaacatgcttgattttgatatgggttaagttttgaacatcctatttttaaaacaataagttttgaaccatttgagaacgttggtatttattagaattgtttgtattattctaatttaccaggagtatttatgccaatgttacactttttttttggaataatcatcggaggagagaatgttacactttttacatcaactccctttttatttttctttctttcatgaacaacggaactgtttaatggtcaccttctaggtcatttctttttaatctgatcaaagttacccatgatattttttttactcacggccccaggccttctcccaaggaagtctacatctactcctttttcattttctctttcatgaacagcgggattatttaatggtcaccttttggatcatttctttttaatctgatcaaaaagttacccatgatattgttttactcacagtcctaggccttctcctaaggaagtctacattttttcctttttctctctttcatgaacagcgggactgtttaatggtcaccttctgggtcatttctttttaatctgatcaaagttacccatttttttttactcacaatcctaggcctgctcccaagaaatctcctgattcttccggtcttcctattctctgtatatatccaaccgttctttttaaatccaacagttcatctagtctagcatacatggcttaatgtgagaaagaataaacattccccattcatttgatgagatgagatgagatatgttcgctcttatcaagaacatgcctccaaacagaaccataaatttatgctcactttttccaagtgataaactaaactgatccacatgatcattcttctcaatgacatgtcaccaaactacattgccccaaatcaaaatatttagcacaaatacatcatccttgagaaagaaaatgttttttttttgtttatatcgaggtccaggaaaaattgcacatatctccaaaacacacatcacaatttcctgtcaacttcataacatggattctctcacataactactgtgggttactttgcttatgtacttctgattcctgcaaacaaaatcagtattttaaaagctaagagtgatctcaagattagtgtctataattaaattttaacagtagtttcccatgagtaaattcttcaaacaaagccaacacactactgtgataaataaaatgaaaaaattgcttgcatgacaaatattagccttttaatacaacaaggcatgaccataaaattttacatgtacagtatgcacaaaagagggcaaatcaccacctaatagttctgtagactactgtacgtagtagcatatatactcaggaacgattcattggtacagaatgctgacaattgatacagaaaacaaattaaacccgagtcattgctcagaaaactagcaactatatatactctcctgctgatgaagtcacaagtgtcaatcatcagtactgacactgtggagaagtcatttttactcccggttggtaacccctttagtcccgggttttcaaccaggagtaggaatccgggactaaagataggcatctttagtccctgttgaaataaccgggactaaagatccatctttagtcacggttgatgttaccaaccgagactaaagagaggaatctttagtcctggttggtgacaccaaccgggactaaagatcctcggccccctgacattcatctgacagggggatgaaccgggactacaaatgatctttagtcccggttggatctttagtcccggttggtaacatagaatggctctggggttttcaaccgggactaaagatcatttgtagtcccggttctttttggaactgggactattgtggtattgggtcgacccagtaaagatcatttctccaccagtgtgaatacatgtatacaagtaaaattaattatatatgaccgcacattggcatactttgaccctaattaccaaggcgaatcatggacttcacacaaatatgctcatccaaaccgcaaaatttatatatagtgtacatttgttactcacaaatcacaatttgatatacttgggatatatatgtccatcacatgtcagaaaatattgccagcctatatgcccatgtaaccattcagatttatatactttggacacattcagtattttcagtaatacatacttcagagttcagatatgtcagaaaattgcaagtcgatatgtccatcatcacaattgagatttataaacttcaaacaaattcaagcacttcatataagtgagataaaatcttaatatacagcatgttccaaacaaagaagaaacaaattttcataacatcagcagtgattcactataagttcagaaaaccaaaaaagggatgaaatttgacctttgtgcaacagatcgacagagaaggaaccaaaaaaaaatgagtgcttactatcacctgctgtgcttggacctgttagtgatatgccctagaggtaatcatagagatgattgtatcacacatgtggaataaatatatttagatgatcagcacatgtattaattgatgatcatgtctcatggatcatggtatagagataccaaattaataatgtggacacatgttagtgaacatgttgttggatagacccaacatgagacactgtaagagccatatgtgttgtgtcatcagttatctcatttagtgttggtgttgaatccttagacctgagattatcatggttcccaacatgtgtagttagcttacttagggactgctaaacgctactccgtaattgggtagttataaaagtagttttcgggtatgctatgaaacatgtagtgggatacgaataatcaagatgggatttgcccctcctatggagagatatctctgggcccctcgatgttgtagattatggaagtgcatggccatgccaaaggtgattgaggagtcaatcacaagatatataatctatcaacaggttctagtgaatgattgagctattagaggatggcacatatctagccttgagcttaatcgatatcgtgaggcaaaggggtttatacaagtagacactagaggttcagtcgatatgatatttatgtatgcccggtgggtcaatacgttctgctaggggccgctgttgacgcgtgaaccgaaaaggcgttttcgggttacagccgagtatatatgaacctacagggtcgcacgcttaatgggccggaataaggggattggatggagatccaatatgagcttaattcggatagggatccgaataagagtcctacgggccttggagacccgagtgatggatcctatatatttgtgaggggtgtgaccggcggaggcattgcatcacgtgagaaaccctagccatcacttccctccccgagcaaaaccctagccgcgcgcgggtgctagcacatcggcatgggagtacggcgaggagaacgcacgaggaggagaaggtcgagccagtgcgatcgactacttcctctacatcgacgcgcgctacttcgcgagagttccttcgacttctcagcgtcttcttccgttgcgcagcgcgtcgagtggtaacgatttatgatctaatacttacatggttcctggtttacgcgatagaaaattttaatttatgctatcgtagcctacgcgtatcccaacaggaccaactgccacgagtgcatttgggtttgggtgaaggaaccggccgtacaggactccaggagcaatcctaattttcacaagagaaattaaggggatcaaatattattctggcttttggtaacttagcatatggattggagaattattggtgattcgttaattttattcagtcaccaagtatacgctccggtccactacacaatagcttgctagcttataccgcgcgtggttcctccctcccaatctcccatgcctgcaacagcgcaaaaccattactccccagaccaaaggaaatcaagaaacactgctctagagtctggacattgcctgctgctcgctgcaaaaaaagatcctcaggaaatcatgccatttctttcagatttcaattgtgagagaacataacattttctcttcttgatagctgctactcgctgaattgccagctacctcttgctgcatgtgacctgcctacatgcctgccgcagccagtgccaccacgcccgccatccgtgggccgcctcagggccgtgcagccctcctgctgccggccgccggccacatgctgcggcttggcactacaatcatgtacctattcaagtcatagttatgagcatgtctacttctattactgaataatcattatctcgatcgttaactgtgatgttgctgatcttcgttgaccgtaggagaaacctgcaatatgttaagcagccatgtctagagttactatcctaatacaagcctgcaaaatagtgttttagatagattgatccagcaaagctgggggtgaatcgatgaatgttgcttgcctgccttgactacaggttgcttaccttataatggagtaactgacatgttgttttctttactgaactgatctctaatttggtaataataatagcacagttcagtaagctaggtgaatgctgctgcttacatgcattattttggagcgacaaccatgttgtttagtttactgaactgagatctagcatggtaatattgtagtactaatacttgcttcagttccaattatctagatctactacttcaaagttcaaagacacagttatcctcctaccacgttgtgcgccgccaaataaccgaatggcccacccctcccaccccgtattactctagatcccattgcaatgtgtgggcgtagtactagtatttctaaaactcttgtaattttcttctaactgcaaaggggcgggcaccagaaacaatacaaactagcgttctttgtttgtaacctatatgcatgtcttcttcataagtcaagttcatgccttcatggtttcaggtaaataaaaattgatgcaaatgcagatatgatccacataggcaatggatgccaaaggtgcagtgttgaattgtacattattcattggaaagtttttattcatccagcattttttactaactcaatgcgatttgattaaaatatctcctaaaaatctgcctttatactcttcctcaattgtgcgaaagtctgctaggtcttattcctagaaaagtattatttttttctgaaaatttttgaattctcttttcagcttttctcccttagcacagcaatgctaataagaaataaaataatggagccttttagagattttggtttttagccaaaacaattgcagtgtatgtcttagatacttctttggtttaattcaatgtgtagagaagtccttctttgatgtatacaattcatgtaaatttctatgggctaacattgagatatctttgtcttcatcaactgcaggtactgtaaattttacaaattcaagatttgtactgtagtactgtacataatgcaattgtatgcatatgcaagtagaggatcagttgatctggagaaaaaatgattattcagtagtttatctcaccagtggatgaaggtaagtaattttataaagagtatagaaatacgtatactccctaatcttgtttacaaattgtacacattcaagactggtctatgtattgatgcaaataacattaactttgtttcctatgcaatttggtttatcatgttgacttgtattatttgagacacatgtgatgcttataagagatgttttgaaatattactgtacatttctggatgaaaaggattgatttcaaaatcactatggtaattaaatcattattggtaatcaaatccttatgtgttactacagttaaaaaaaactactaatacctaaaattgtgctatttacttgtgttgctattggtaaagatatgtgttgtcggtcgtatgccaaggtgttttggttataacatgatgttactagcatgtatgtggtaacatctaatatgtgttacagcgcaatggctgtaatacctattttatatatgttggaaaacttgttatgtgctactagaccatacactcctaacatgggaaataggatcagttatattttatgttactgctaaccatagtatacataacgcgtttttgaggatatagtagctcacagccctgacatgatgtaatgccactctcctcgtgatgcatatacacgtgatgtatggagattgtttatcaactcttgtccaacgttttcaacggaccactacattgatcgatgcagatctctacatagaaggccacacattttggttcagccatgaaagtgatttgtaatgcatatcctgtcttgctgcaataaagattgtcaatactatcatatagcaataatatcatataggaatcattgccatgttccttactagtatcaatcatgttgcatggcatttgatcttgctagcacaaaattaaaatgactagggttaacaaataggccctattaggatccgttttggttcagtcatcaagtcagcacgtgactcaaaattaaaagtgggaccaaccaaagggacaaaatggctagggttaagaagtaggccccattaggatcggttttggttcagtcttcaaacccacacatgcctaagaaggtgggacacaccaattgacatcagatcttatctatataacttttttttgagaattacacagtacaacgcagacactcacaacgaacacgcactcaccccctatgaacgcacgcacgcaaaccctacccctatgagcatctttgaagactgggccggcaaatccttgagattgacgaggtcaccacaggcgcctcgctgtacataactagcaaataattaagtatcgttggctcgtctataccaaataaggaggcgatcccctcagatataagaccagatagagttagagatattttaaaagatcatcaatctatgtcaatgaaaagggaataactcgccatatcttctcctccattgttctcaatagcagggctgtttcaagttagagaagggagctattgcagtccaaaattgcttaaattaaccaaagcccgacatctaatctcttattgaatatatgccatccacccacatactatctcgttaatctcctcgttcccaatgtgcaaggattcaagaggatgaggcatctcttcttgttgccatgacctaatccttacaaaccccactgctaccactcggcctcctctcgattcatctaaatgagatgtatggcaattatttatcagctccttgtccaacatttatgaagaacctctatattgatagatgcagatctccatgtggaaggttacacattaagtttagtcatgaaaatgatttgcaatatatgtgttgtcttgctaaaacgagattgtccatacatgatatagcaatcattgggttgctccttactgctatcaattgatttgcatgacatttgatctcgctgccataaaaatatcgtagaaagggactaaattattagggttaagacatagtccctattaggactaattttggtttgctcttcaaaccagagcatggctaaggaaagtgggagtcaccaatcgatgtcgcatcttctctatataacttctacataactaatagttgaatattgtgagctcatctataccaaatagggaggcgatcccctcggatattgggccagatagagttagagatatttttgaagatcatcaatctgtagcaacaaaaaagacagagctcaccatatgtttgcctctattgtttacatgcatgtggtccatcgattttgcttcctactatcatggatgtactattatggttgacaaataatgatattttaatatttaccaaacaccaaacttacacaatgtgtggcctatagtgcctttgtctttaaaattcatatatgaaaaatgaaagcatctacaccctcaaaaaggattgtgttggctatgtgttggatggtaacggcggatggtaaccctgaaaataaatcatatatagtgcctattgtgttggatgtgtttcctaaacccgcaaaaaggatgttaacgaagaagatcatctatcgcaacccgatcatcagtaatgcattcgaggagttggggcaaatacagtacaattaggttaaagaccgtactataaagaggggttggaagttagtagcttgaagtttcaaaagtgctagaatcaaggtgtggtgctagaatctaggtgtggtgcacactaggttgctagtctttcaaatcaagtgctaaaaacaagttagtaaaacctcgtggttgatcgtgtgcaagttttactacacccagaagctgtactagccggattgtctgagtgatgccgaataatccatgctagacttgtcttgaccgctaaaactacttaggcggataatcggctacggtgccaaattttcctaccaatgcatcatccaactacggtcatgtgttgacaagggactggccggactaaccggcagatcatgggttgtccactacccaattctctggcaatcagtagaaaatttgctagggcgacggacagtctgccaacccactcgaccgttgcgagtcaattttgtttgaactgtagtggactgtctgacattgtgcgaacaatgacctcccagataatccgaatgatattggattttccgttgcttgatagcccagcggctacttgcctagtgactattggaaaagtgcaagggaccgtacagttcggaccggtggcgggctgtttaccatgcttgatatctggctgcttttgtccaacagtcacaaacggctagtcagctagtttggggctataaatatctattgccttcaactccctaatatcgtttggaaccctgttgaggtgtgtaactgaagagagagtccaagagcaccattgagttaattgtgatcattttcttcactagtttggtgatagattgagtttagagtggcttagtgtgtaccaaataagggtcttagtataatactattccatgaaatatgaggtacacaaagacaaagttggttatcataggcatgttcaacagaaatggtaaatagtacttactacagatgaacaatggatgcacgtatctctattcaagccatcttcaaatcaattaattgagtacacattgcaatttataaaggtacaaggaaggcatttgaagttcgtttgcacaaagccacattttaaacaattaggagattaaaacataaaataataaccatgattctaacctatataaaagcactaggtaacatcgcaggccgcacacccatgcttacccaactgagcatgaggtattagttaaaccatcaggatctactattccctgatttggaaaacaaatataagcatgacaaacattactacgcatgcctatatatgaaaggggcaaagggcacaacatttcgaatagtttaaacattttgtagagatcttccccacaaaccacaatctctacatattccttgacttaaatatcaccatagtacccgaatagaaattgtgacaagatcattcatctagttcaccattgacatggttcaccgaactggtccacgggtacaaatggtcttgattggtacattaaatagacaatcaaaaatccaaaatgtattgtgtagaggtgggacctacacatcagtcgaagttgaaatcccgtgcttccatgcgaatctaacccaacatttgcataaattggtagaatggcatattagatgtgtggagattattggtatcccatacccacatggcatggttatccgactggttataggggataatttatatctatgaaatatgcaacggatcatgacttgggtattacatttccttgtatattatggaacggcctaaagtcctggtttgataatattgtaaagtagatttaagaaactgataccatattggttaaggtttctatcttgtaatcatgtcctccatcctatataaggtgggcaggaggccctctagggggcatgattcacaaccagatcgtcagatcaatacacatccggcggattcaaatcccaaacagaaatagggtattacctctcattgagagggcctgaacctgtctaaatcttttgtctctacatccgtccacttttacgtctcgtgcgctaccacttttatattgccgaaatcttatttcgacagttggcgcaccatgtaggggtgaccaatgtgggaacagtcgtccatcaataacaatgaagacaccagtcggcgacggcggaagcaagccggtggtgtagataacgaggcccatcaacgatggcggagtccgccaaccgtataggtgaaaacaccaatcggcggcgacagaggcaagccgatagtgaaaacgaagacgcccatcaacggtggtgtgaccaaccaaccgtataggcgaggacaccagtcagcggcgacggaggcgagccggcgatgatgatgaagatgcctatcaacggtggtgtgaccaatcaaccatatagatgaagacaccagtcggcagcagatgagacaactggtcggtgatgatgaagatgcccatcaacggtggtatgaccaaccaaccgtgtaggcaagaacaccagtcggctgcgacggaagcaagccggtggtgagatgctttgaagagcagctccgctagatgtttaaactgcatgggagtcggcgccagctcgtatcttagacaggcgtataaagacaatctcctcaccgttgagcttttgtggtcagtcaaccctgacgccacgctgagcccgttagccgagttgaaattgggcctaggccttggcttttgtcagtcgtcgaatgtcgaactcggccattaatatatgaaaaaatagagcacacgttaacttgtgattagtgaacggaaaataaaaataattaatataataggtaatagattagatcagaatgataaaacccgttgcaagctgacgcttttggtgtattgtgtccaagtataagttgggctagcatacggtttgatcgagggttgtcatggcgagatcggactcggccggcgatgatatacacaacagaaaatatcaacatgtaggcgtggcaatcttcccgtgtaagttgagaggcctatgcagagttgcagacttgtgcttggcggccggagttctcctgcttgcatgtgcctgtagacgcatgagctcgagcagcaatcggctgcttgtgtctgtctgtatgacagcatgcagcagcagttaaacatgcacatcccattggtagtcggccgagatgctttgtgttggccatggtcccgagtcggagaagatttttgagaagaccgtgtcgctgttcaagcaaagatgtacgacgccgacgaaattggttcctgcttgcatgtgtagatatatgtgtgggcccggcttagatgattactcaacgaaacaggcgaaacgacaaataatgacaacttgctgattgcttcaaatctagctgagcagggaaacaactcggcaactgatgcccgattgcagaacaatttaattggtggctagtctcttggtgggatctagtcggaaattttggcaacgatcgctccagcctcttgttgagaagaacatgccatatatttctaggtgtggtgaaaccatgtgtcttttagtgacttaagaacatctgttaaaacagtgtgcgtatggcgtgtgccaatactttggaaaattctttattcacagcatataggcttctttataactgttttgctatgtgaatttttaatgatgtagtcaactttagattgcacacatcatattttacaaagcggtcggtatatcactcggatcatgttattcggggggttcacaccgcatatgctatatattgatatcaaatgactataattatcaaaaaccactcagttggttggattatttattccttgactatatgcttggtttgttcaactaaccacataatcgggggctacacctattaggtgcatctagtcgatgcacctatgtttacatttaattattttttagccctccacagtcttctgatttggtgaaagtactcggcagactatggcaaagatgattaaagcactcagctttggagtaatctggttcgagagaaagattatcttttcgactgtgaaggtcttaggggttactgtagagattataggtaccccatacccacatggcatggttatccaactggttataggagataacttatatttataaaatatgtaacggatcatgacttgggtattgcgttttcttgtatattatgaaacggcctaaagtcctgatttgataatattataaagtagatttaaaaaaccgatatcgtaggctaagatttctatcttgtaatcccccctgctatataaggtaggcaagaggccctctagggggcatgattcaaaaccagatcgtcagattaatacacacccggtggattcaaatccccaaacaggagtggggtattacctctcattgagagggcctgaacatgtctaaatcttttatcctcgcatccatccacctttaggtctcgtgcgcttcccactttatatcgccgaaatcttgtttcgacaagatgaagcagatcatattatttgaagccgattgttctgtgtataacacaggcaacgcaatccagcacacagcaatgtgacattcacggaacaaataagtaactctagacagcaaaccattaactaatagaatgtgacatttacagctcacatagtctaacaaacttgtaccaaaatattttgataccatcacaccccaaaatgaactttgatcatccaaactttcaattcaaaaaccaaattgatatgcacagaggagtttcacacaatttgtatgtctgccctgacaaacttcaagtgatgcgagaacaaactattgtcagcagagatcactgtaatctgtaaaggtgtaatccatccaaacttcattcgaaaacaatggttcaggtatagttccctctctgtaagtagagacaggaatacagtttataggtgcaaagaagtgaagtaaaaacatgaacaattttggccgatttcagcccaagctttcagaaggattcgaactgaagtaaaactagcgatgaatctcttgtccaaacaaaacaaaactagtggagaatcgaatgaaaaccgttgatgatcaccaagcatcatccgtggctgctctggcgttggcgcgcatgcggtcgaacacctcgacggggacggagacggcgccggtgcgcgcgtgccacctcgcgccgtggcgcgccgccctggccgccacgttctcgacggccttgaggaactccttggcctgcgccggcgtcagcacctccttcaccgcggcctccacggcgcgccaccgcagcttgtcggcccgccgcgccgcgcgcgccatcttgcacatctcctcccccgccgtctccgccaccccgtccttggtcttctcgcacgccagcttcatcgcgtaggtggactggtactcggcgacctcgccgtccagcgcggcctctcgggcgtggaggcggcgcgcggcggcggaaagcgcgtggcgggcgtgcgcgggaagggtggggaagagcgccggtaggagggtgaggaggatgcaggaggggcggaggtcgccgccgagccaggagagcgcggccacggcgagcggcgggtcgtcggtgcgcgcgaggaggcaggggacgtcgcgggggcggacgggcgggccggtggcgaggcgggagtagcgggcgcggaggcgggcgaggtcggcggtgatgtccgcggtggcgatgttgtcgctgtcgctggagtcggaggagaggaggcggcggtgcaccgtcggttccaccgatccgggcgctgattgccaagaaccaagcagcgatgagccaagaatccaccggaatcaagaatccgcaaatcaagaatcgggaaggagcgattacagcaggggaggaagcaggggaggaaggagaggaagcccttgtccttgtccttgtccttttccttcttggcgatcttcccgccgccgctgcctcggcggaatctggagtcgtaggcgtagtagtagtcgtcggcgtcatcgccagcgagagggctaaggaacggcattgcgcgccgcgcgtggtactgctgcactgctggggagggaggagagagagagagatagagagggaggtgggcaagctttaatggtccaacgatttgggcttatgagaaggcccggcccaacttgattgcttttcatttttctgataaaacttcctccatatgtatcttgtttttttttctccattggcaccctagataattaattaggttgtctaaaaatcctctcatggccctagataattggttaccagcgcctagtcatccctacatgtatgggtcggtttgaaaatcctagttaaaatttcttaatgtcatggttaaatgcggctccaagttacaaattatttttaattatatttgtcttataaactccctccatccaaatatataactacttatttttcaaatttggtatcatttctccaactattttatcatattagttaactataactaactttgttttttcaataatttttcatctcaaccaactataacaagtcctcatttatttatttgtctaccttcttaatctatatctatatctgtatctatatactaactagcaaaagtgtccgtacattgcaccaggtgattacgaagtgtgtacagtgataaaaattgttatttagtttagacaactaatctgctaaaaaaaggcgacggatgaaaatttgtatcatgaagaaaaatatttatttgtatgtaggtaagtctaataaaatacaagtggaatttttatactcaatgtactttaaattgccaatatatatatatatatatatattagaaatacattggccgtgtttagtttgttgggtgtaaaaactttgacgtatacggatacacatttgaagtattaaacgtagactaataacaaaataaattacaggttccgcctttaaactacgagacgaatttataaaccctaattaatccgtcattagcaaatgtttaatgtagcatcacattgtcaaattatgacgtaattaggctcaaaagatttgtctcgcaatttacatgcaaactatgcaattggtttttttatccacatttaatgttccatacatacatgtgtccaagcatttgatatgacttttttgataatttttgttagaatctaaacacacccatagtataaacgcgctcataacacaagcattgaaatcaaaaaaaaattatagccccctataattttaggccactgaggagataaggcctagatccctaatagaaaaaaataaaagcggtgcctactaagcagttggagtagtagcaattactggtagcaaacaatggttatggaattctcaaaaaaaaaaaacaatggttatggcagtgcagcacgagcacgtctcctcccatgcgtcaatggtccatagaccatgtctatggactcatgagctcttgcatcgttcttatctatccactcatcgttcctatccgtttatcagagagaaagagggagagacagacagaatggaaacggaggggaggctataccggtcaagggggcgttcagcggatggcaggcggtggtgccgacagagtgcgacgggaagaggatcctggtccaagtcgatgtggaggccgtggagattccgtggccgacgatgtagccgagctgatgggagatggcatggagaggtagcagtcatcggcgatgaggactttggggacggcggcagcggcctgaagatccaaccatcgacatggtggatggaggtgccttgttgctcctggtggcgaggcggcggtagcccatagtgttgagattatagacatataatgatttaatctattccataaataaatcatgacattacatatgagaactagcatgaacgcatcattagatctacacatgtaaactacacagtataacatataacatgaacagatcaaatatgcacaacatattgaacacgtaccaaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgctttccaaaaaccttattgccgccttctcccggtgcaggacgtcaaagacagaggttccggagacctgctctcccgatcgctggtgcacgccggcgagcgggatggagtagtctacgagcgacggcacagtacagagtaggaggcaaaccctagattgattttgcgtgtgctgcgtgaagacggcaggtcggtttatatagagaagggtcgcttgatcagggcgcccgcacgatctctactgcgcgtaaccgaaccggataagtcgcgcgtaacttatccggactccatgccgtttgcacgcaccggatttttcggaacgtttccaaagcaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgaggcgaggcgagcgagcgcgcgcgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaaggcccattcattaattccaacaattcgagtgggctaaggcccattcattaattccaacaatcccccaccaaatctcaaaatcccactgagatttgccttttccaatgtactgtttatataccagcggttcgatggagaccaattaaggttgaacatccacctagaattccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagtcaacagaactcattaaggcatagccaatctgccttgcagctcacgagagtacatgcatcttcacttggagagggtatatatattgatactctcctctagtttactaatggtttgttcttctcaggatctaattcacgggatctccgatcacatagactgggttaccaccatagtataactcatatgggtctcaaacccatctccttcaatgcattgtctatcacatttcgtgatagtcccttcgtgaagggatctgccaggtttctcgctgtttggatgtaatccaacgttataactccagagtttcttaattttctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgttttagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagtcgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtaatctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactaggaattatttcagatggttggttcgaaccactatgtgtatccttcattgggaaaaagctctcaaagaagatagcatcacgagactctataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcatctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatgaatgtcatgaaatatcgttttccacccttcgtcaacaccccattcatttcacaaagatctgaatgtaggagttctagtggtgccaagtttctctcctcggcagccttgtgaggcttgcgaggttgctttgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacagacctacgcactcataacctttaccaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 383 - DNA, 867 bp, Oryza sativa
  unsure (1)..(867): unsure at all n locations
attttttttttcccccgccgccgccacggaaaaagagagatatttttccccccccccaaggaaaggattttcttgagcaaaacccaatggcaaagtcatcgtaattgtaataacttattcgcctcttgcgtttcgtgaaagtaccacctttatgctgctacaaggtacctacaaacagtccattagttctcaggaccacgtctaccattttattatcagacatcacgattggtgttcatttgtttcaggttgctacttgaaaccaaatatcgcagattgcttgttgttgatagcactggtaaattggtgagttgatctgcctttccttccttccgctttcgtttcagtagtatctagtcttaagtaaagtttcttttctcaaggttgggatgatcacaagggggactgttgtcagagctgccctcaaaataaagaagacagctgaagaaactgcttaaattagacagtgtagatgattctttataagtcatttctgggactgcagtcacttggaaatttagtccactgaaacattatttggtgaaatgaactacatcagccttacagatactgcgaattcgacagtcaattcttcttggaacatagatggatataggtattgtattgttgcagatatttggaatatagccgcaatctgtttggggccaccagatttggtcgcctctccttattaggtagcataacatggagaatgttattatttttatttttacttttatcattgacttgtattcaagaacatcagtgtattgannnnnnnnnnnnnnnnnnnnnnnnnnnnnnnnnnnnnnnnnnnnnnnnnnnnnnnnnnnnnnnnnnnnnnnnnnnaatgaaantcaaggctct

SEQ ID NO: 384 - DNA, 828 bp, Oryza sativa
  unsure (1)..(828): unsure at all n locations
naatgctcatcaatagaaacatgagctaccattttaanccaatgaccatgatggtgagatacnatatatatttcttgtcaagtacgaatgccacattaaatgggcctaatcccattgggccagtacgcttagggctaaccttgcgaccataactcaaggagcaaaataggctagtcctaacaaagtgggaagcaaattgctgagttgctgagtcgttacttgtatatgtcaaccaaccaataattctgtgtatttctactgctcacctagatcttgtgtattagctggtaggtgtcacctagttgtccatgtgcaccatgtgtttgactgtcaagtgcatggtgcacttggatgaatggctatggtagcatgtctactattcgaacatttttataaagtttcaatctaacttaccttctaacttcttatagacattaggtttctcgtctacaagactacatgaattaggcatactgcaacaacaactaccaatttgaataggatctcattttcctttttnnnnnnnnnnnnnnnnnnnnnnnntttctctaatccttaccgacaagaaattccatatctagtttcctacagataaaaattgcatagttcccaaccggtcagaagagtgatgtgttaacacattatctatcataatgttgttgcctaaatgttcaagaaatcctgaaccaaataaacatgatgctcacatcacagtgaacgatagtgccaggagaccttaaagcatcaatccacataacaggcanaacaacaaatccatgcaaacaaaatacccaatccacacattacctaaatngcctctttaaccan

SEQ ID NO: 385 - DNA, 1189 bp, Oryza sativa
  unsure (1)..(1189): unsure at all n locations
ngtcttcttcgccagaaatactggagcgggtgaagctcagggtgaatagcaagtccgttctgccctggcaaaaaaccccgttttttcacgaacggagcaagcacatccgagtgagggtaccatttcatcagaagctacttggagaaaggaagcatcaaggcgagctacatcaacaccaaggaccagctgcggatttgctcaccaaacccctgggaggatcaagttccttgagctttgctcccggatcgggatggctcaactctcccacaagacggcgcacaagacttagggggagaatgtaggaataagtcttggctggttggtcttggtcttgtggtgcctttttcctgtttttcagctttctaggacagcatctctactttcagtttggatgctctaggacagttaggacagcagtttgttgagatgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacaaccgcagccactgctgccaaacgcaccaccgcgcctcctcccaccgtgccacagcagccactgacgccgccgctgtgacgagctccgaggcctctgcctccacaccgacggcgttgccgctggtgcctcaggccgcagccgcggttgccattggcaccgccgccgttgcccatcaccagccgcgctgccggtcgccgccttccgcaagcctcgctccgccgtcgccgccgtcgctcggaccgctaccaccagggccggcggtgctgcagccgtcgctcgcccccggcggcgcgagcaccgccgcccgcgcgcatctcgccgtcgtggtggccgccgccggatgccgtgcgagtcgtcgccgtcgccgccgcctctgctgccgacgccgcgccgtcgccgacgcctcgtcacgccgacgtcgcgggggggggggggggttcttttagtagtaacacatcaaactctaaaagggtgggggaggggggagaggaaagcccctactctgattaggtttgccccccgtttcaccacacttggctacccggggggggggggggc

SEQ ID NO: 386 - DNA, 744 bp, Oryza sativa
  unsure (1)..(744): unsure at all n locations
atgatacgnnnnnnnnnnnnnnnnnnnnnnnnnnnnnnnnnnnnnnnnnnnnnnnnnnnnnnnnnnnnnnnnnnnnntgcgcctggatggacggtccagattagtccggatgatttggcctgtagcattggagcgggacaactcctcttttttatattatagtatatagatgatatatgtcgcctgtattgagcatcagggagagattagaacgagacattgggtaaatcatttccaatattagaatttatgattttaaacacaaattttgctccaactgtatctctaaacatctcctaaaaattaggcgttctcatcactgcgtctctcgctctcaaatcgatctgcgctttttccatttatctcagtgcttcttcccattgcgatcatgaaatgctacagccaggaacttccttgcgaagtcatccattgatgccgttgtactcatctccactgcaatcaatcataatagagttgcatatttcttaaaccccacaaccggttggcagctcccttcttctgaagagagccacgagtagcacactggggccgtaggactcgttgtcgctcaccagaccgttgttgtttccaccattgctatcgcatttgtcgaccatttcggacccaccggtgaggtaatcgacagacaacttgccaccaacgccgaggcccgtgtcgatgtgcctaaaaatccagtatatcgacttgcagtcggcatctaccaagntcatacanaggcaattn

SEQ ID NO: 387 - DNA, 784 bp, Oryza sativa
  unsure (1)..(784): unsure at all n locations
cgggcgggctaatgcgcccaaacatgatttcttcttggtttaaaaaggcgagctcctccccaagttcaggaggcctttaaacccttttaattagtcatcatcatcatgcattccatgaggaatgatctctataatttacatttgggaaggaaataaaatgaatcacatacaattgactttgcttttcatattcgtttcgaacttcatgaacatgcaccatgacttccaaatcttgctctagccatttttgcaatgatttctcagtcatctgcattacaaaaaaaagtattctcaaggatatttccaaataagcaactgatctttttctttaagtatggaaaataacttacatgagagccaggagaagtaccattcatgcctgatgtgtttggaagaaagcaaaaaaaaaaaaaaagaaaaagaaggaagagctgttagattgggagtattaattataatgcgaaaaatggtcgcaatgcggagagagatacctgagttgtcacgtcctgatgatttccgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagaaatcaggtcgatacagccgctttcatgaagtatgtcctgtaaactagtcccnnnnnnnnnnnnnnnnnnnnnnnnnnnnnnnnnnnnnnnnnnnnnnncaattccatggcgcgt

SEQ ID NO: 388 - DNA, 5762 bp, Oryza sativa
  unsure (1)..(5762): unsure at all n locations
cacggcttgaatgcagtgctaatcccnnnnnnnnnnnnnnnnnnnnnnnnnnnnnnnnnnnnnnnnnnnnnnnnnnnnnnnaagaataagtcttggctggttggtcttggtcttgtggtgcctttttcctgtttttcagctttctaggacagcatctctactttcagtttggatgctctaggacagttaggacagcagtttgttgagatgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacacagcagccccccggaggtgcgccatgtccgacgctcggtctcagcgttcggtcgcctcgagcactcggcgtcagcaggacgccgagctcgccgcaacagaagagcgcaggcgagcaacggctcagaccgctgcagcagcagcgagggcggccagactggcggcagcggagttggcagcaaccaaggcggaagcggaagcggaggccgcggaagatgcggcacgtgcggcggaggtagaggttgagaccttgcgcagcagcatcaacggctccatcgccggcgacatcaccgctgacagggagcttgaggagctggcaagaggaagggcacgggagcgagcagagcggtgggcagcagcccacctccacggcggcggcggcggcccaagggaccgcgcgcccgccgacgggaacccagacgggcgcgggcgtgccggcggcagcccggagcccgcacgcggccctcgcaggcggcacggctccctctcccctgaccggcgccatggtcaccacggcgtccagacggtggtcagggattttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggcgggcactggatgccctcatcgctgcagttccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcaaaaaatggtgcagtacggcgacgacacctacgacgaggagagagctgtcgagaagctcttccgctgcgtccctgagaagtacaggcagatcgctcgctcgattgaatctctgctggacctctccacgatgtcgatcgaggaggcgttaggtcgcctcaaggtcgtcgatggtgatgagccacggcctctctcggggcccatcaccatcggcgggaagctccatctcactcgggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacgggtggaggaggaagagccggctctgctcctagctcacgcaagcatcgagctacctccagcggcaccggccgcagcggctttcctccaccttgatgagccgaaggtactcgtctccctctgcgacggctccagcaacgacaaggctgatgggtggtacctcgacaccggcgccacccatcacatgaccggccgacgggagttcttcaccgagttcgactccagcgtccgaggcaccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgttgtcgccttcttgccaaggtaaccagagccactaatcgactttacatcctcagcgcgcaagtcgcacatccagtttgcctcgccgctcgtcggaacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacaaagcagcggcggctcccctttccccagcagacgagcttccgagccaaggagcggctcgggctcgtgcacggggacttgtgtggcccagtgacaccggccacaccaggaggacgacgttatttcctgctgctcgtcgacgacctctcccgctacatgtgggtgatggtcctcggcagcaagggagaggctgcggacgccatcaggcatgcgcaggctgcagcagaggcggagtgcggccgcaagctgcgcgtgctgcgcaccgacaacggcggcgaattcacggcggctgaattcgcgtcgtactgcgctgatgagggcattcagcgccactacaccgcgccgtacagcccacagcagaacggcgtcgtcgagcggcgcaaccagacggttgtggagatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcaccaaggagcttggccacatcggcaagctcgacgacaggagcaccccaggggtgttcatcggctacgcggagggctcgaaggcctaccgcatcctcgacccggagacacagcgtgtgcgcattacgcgcgatgttgtgttcgacgaagggcgagggtgggtatgggacaaggcggtggatgatggttcgactccgacgtacgacgacttcaccatcgagtacgtccacttcgagggagctgggggagtaggcagctcttcttcaccgagcgtgtctaccccagtccccgagcctccaccgactccaacaccaacacaccctcgggccacgacttcgactacgacgagctcttcgtcgacaccaccccagccggtgtccccacacgctccagcaccaacagccactcctccgggcacgtctactccgacgccagctcgtgttgagcgcagcccggtggagttcgttactccgctctcccacgacggggagcgcatcgacgcgtaccatgacggcgagcagctacggtaccgtacgatggaggatcttctcggcgaccagccggtgccgggactggtgcctcgcaacctggaggcgcagttgcaccttgcgtgcgacgacggtgagcctcggtcttttgcagaggccgagaaacacgcggcatggcgtgccgcgatgcagtcggagatggacgcggttcaagagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcaccgaggacgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcagaggtcgcggcgttcaaggaggagatgaaggccaccttccagatgagtgatctggggcctctctccttctacctggggatcgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacagcggaggaggtggatgctacacagtaccgacgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacatcgacaccagcaagagcacgagcgggattctcttcttcctcggcgagtgcctcgttagctggcagtcaatcaagcagcaggtggtggccctgtccagctgcgaggccgagtacatggcggcatccgccgcttcgacccaggcgctctggcttgctcgactgcttagtgatctcctcggcagagatactggagcggtggagctcagggtggatagcaagtccgctctggccctggcaaaaaaccccgtttttcacgaacggagcaagcacatccgagtgaggtaccatttcatcagaagctacttggaggaagggagcatcaaggcgagctacatcaacaccaaggaccagcttgcggatttgctcaccaaaccccttgggaggatcaagttccttgagctttgctcccggatcgggatggctcaactctcccacaagacggcgcacaagacttagggggagaatgtaggaataagtcttggctggttggtcttggtcttgtggtgcctttttcctgtttttcagctttctaggacagcatctctactttcagtttggatgctctaggacagttaggacagcagtttgttgagatgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctnnnnnnnnnnnnnnnnnnnnnnnnnnnnnnnnnnnnnnnnnnnnnnnnnnnnnnnnnnnnnnnnnnnatgcgtatccaantgctcatcg

SEQ ID NO: 389 - DNA, 15427 bp, Oryza sativa
  unsure (1)..(15427): unsure at all n locations
agtgtgttaagataaagagagggcgcgccaatataaagaaactcccgccggatggttgtatatcatacgtctcttgttgggggaaactttcaaagaattcttcaaggaacatgtgatggataggtaagaacaaagtgggatttttttctttgaaacaataatgtattttgcacacgtggttggggttttataaccccattctctttaaaaaaaggaaaaagtggttttaaaaaatcacaaataatatatggtcacggcaatccaagccaatgtgtcccaattagaaaaggggaaacctttttaatttgagaacctccaacaataaaaacctaatttantggggagagaaaaggcggcggcgctgctagggtttcgccccccgtgtcgccagcgcgtgggcaacgcggggggggggggggggtttcttttttagtagtaacacatcaaactctagaagggtgggcagtggattcaaatcatgctgtttagtttttcttttctgatttccattaaacattcatatttgaagtcagttcattacagaaattcagaacggcaagcatttcacagacaatttgaaaagaaacactacttttgattagcaaccactaccttttcttgatcttgactaccggcaaaagaagcatatgttgtgctttatgtgattacccagtgaataagcaaaaatttcaaagagagctagcttaacaaatactccctccgtattttaatgtatgacgtcgttgacttttcaaccaacatttgaccatttgttttattcaaaaattttgtacgaatatgaaaatatttatgtcctgcttaaagaacatttgatgacgaatcaagtcacaataaaataaatcataattacataattttttttgaataagacgaatggtcaaacgttggacaaaaagtcaacggtgtcatacattaaaatatggaggtagtacaatattgtgttaactacagatggacagatggtttacatattgtctgtttctgctctgtacaatatattttcttaaaccataatacaataattcatattcaatcctatctcatcaggaaatctgtaaggcaacttgatacaatgttaataccggtatatatagatcttggatgtgcacactgacaacacaaactagtcctaatgaaaaattcagacatctcaataactgactactgagaaagctaaaacaaatgcctgtgccaaagaatttaacattttttagcaagcaatgtttcttaaaatagtgaactaaaagtggctgctatatcactgttcacacctatgaatcaggaagattcagtggtatgtagatctgtatcacatagctatcgctgttaatatgattaaacatagataagaattaaagcagagaaagccatacttacactcattctccagcagataactccactggtatgctattccttcgctagcctcctttgaagaatcagaagtaaacactagcaacctgtggttctttgcaaccatatctgtgacacttggccagtcctttccattagttggcatttctgagatagggtaccaatatttcgtcaagtcagcagcagtaaacaatttgctcaatcccatcgttgaatggacgtaatcctcaatgaatattgttattatctctgtcggattctcagatagaaatgcttccacctctttcaatgtgtcaattgctggttgctaacataatatttcatttaaacattagttttagagtgtaaacagactgttagcaaagataacgatgaatagattccaaaaagcaaaacaataaccaactcatgtttactaaacttatccaatacaattgattacctcaaaggaaatcttattgaaaatgttgtccccaaatacaggagacgattggaataacaaagcaaccagtgcaggacttcttatctaaattgcacgcgcctttctttaatctttagcacaaatctattttaagaaacattcgatcttaaagcaactttggttagtaatgataaaggatagttttgtactgagacgaatttatccttgtccaacatttttagttgttagtccagcatagttccactgcctttagattttacatggcaagggcctttcaacttttagataagaagtgtgcaattacagatttacccacgctttggtagggtttgaagaagtaccaatgatgatcaggcagtaggccttgtaggggctaattaatgcgtgatgtcttctttctgacagagtatcggcattcaagactagattaagatagtgtttaggtatcagagctatctgacaagaaaacaggtagaagatgcacctcaattctacaacaagcatatactcaccagttttcaattgtgcagtttatagggctgggcaaaatttgagctgggcattcagaaaaatcttagcaaatccaactaactattgtttctccatatttccctctaaactaactacttttgctttaggatgcacaaagattttaaaataggtgtactgaactactgaagcaaggcccgcccgaattatatttgaatttggcttttcctaaatagatatgaaatggcacatatctagttctagtatgggcaatgaatagaacttacaaaagcagtgaagttgtagcattggccttgcaaggagtggcagagccagatatcatcattgaagtcatacatatccagcatcaatcccctcactccattctgcaaacacccaacatccaaagcaagaaatatactcatcctataacagttcacatatacaggagtaagtgaagaatctggtcagagatccagaagctaccctcaattggttagtgacagtgtcctcctggttgtagaacgtgaccctctcgactccggtgtgcgacggctcgcctatgatggagaaggagttgtgggtgaccagccatgagtagcggttgaagggcagtcccttcacctaaacaagcatggatgtaacaacagaacatgtgagatgagaaaaacttgttgcacaacaggagagaagctgcagaggaggagaagcgatgagaattagtacaatggaggtaggctggatcgccaggtctctgatgcaggacggccgggtcttgccggtggcggcgcaattgccgcagtagaggccggcgccgcagtcgcgcgccgacgagcacgaatccccaacctgcatacataaccaacgcatcaagaagtgctggaacagcagcagcggggcaggcagatcgaattgggcaaagaagtagtagctcgagcaacaaattgcgacaagaatcggatgaaagaagcggttaatcgggaggagtacctggcaggagcagggaagaagcagcagcagtgcgatgtggagcgcgaggagaaaggggaggcccgccattagagctcaccaaccactccctccctctccccggccgcccaagccacggcgctcggtgggtgggtgggtccggctcagccctcgtcggcgtctgcagcctcgcccgcctccgccgccgcggcgctcaattactgatgccggcgtcgcgtccagaggggtgaaggagggggtatttgttgcgggaggttctagggactcctactaaccatgttcatatgattatggaatattaagcatgtttgtgatgattgctaacttaatggccatttaataagttaagactctgtaaaggcttaaaaaagaaaaggaaaagggaaagggtaaagactgtgggaaggaaatgggatagctttcggggtaaaaaaacagtcagcgcactagtgtatttgggtcgtgtttttattcatgtcagtgaaggttttttttaaagtcacttgtaatcgtgtacgtgcaatgcacgtcatgaccaatatgaattaagtccagtgtaatacaattgtaagaatatattctatcaaaaaccaaatttacggtggtatattgtccaaagataggatggacattttaataagtcaatgtaagtgaacatgtggaatccacataggtaataaaacatacatctatagtgtaatatttaataaattataaatggaatcagttaagaaacaaataaataacaaatgtactctctgcattttaaatatatgatattgttggcttttggatatgacatttgaatatttgtctaattcaaaattttagcatgaatacgtaaagatataaatataagtcatgcttagaaggacttttaagcatgacttaactttacattgtttttttaataaaacaaatggtcaaatgtcatgtccaaaaatcaacaacattatatatttaaaaaggtggtggtaatttcatgcgtcaaggtgtgacatcattttttgatttttttttatctgccccattgagtactacaccattcagaaaaacttggtgtaaatacaaattgttgatgttgtgtacataatttctaactgtttcctatgtgaaaagcgcgcgcgggggggagggggggataaaactgaaggaaatgcaatttcttagaatttataaccgtctcctatgtggaaagggcgtaataaaactgaagggaataccttgctctggttttaaactgcttggattttttttatagctaatttatttgacatttgtaaacaggatcccattctctcactttatcccaaattttgcacagaacaaaatttagagctctgctagattgctacaaggtgcagaccacttcaacattggtaacacttgattaattacaacagctggagtattgcaatgatacaaaacaccaaatgagaaaagagcattaattttacataagccaatttgttgtacaaatcatcttcatcatgtattgcctttccaccaactgaatcatgcattcttcacttcgtggattactgcattggtatcctacatcatttgtgtcattgatctgagcaatggtcaatgaaatcaccatggaaagttgtttccatttcatttctttataatgagtttcctatgaaaacatggtcacagacttattgtgctgaaaacaacttttctcccttcctcacgttattgccttttgctcttgcaatctgtatttcttttagtctcaaacaatggaactcacaaatggatcatcttttatttcaaaaaattcatagaactatagcttgttatgacaggccgtcctagtaaactaatagtagttcaacttgtaactgcgcatatatctcacactgaagttaggatccaaattatagctagcagagcagaagaatgttgggctagctgtttatgggcaatcagctagcagagcagaagaatgttgggctagctgtttatgggcaatcaacacaatatgccgtatacatgttaactctcatatgttcccttctgacacgaaatgcatgaagttgaactgatcagttgaatgccattgattctgacaaccgtatcattagaagaaatatctacctagtagctacacaagaatgtatgcgcatatatataatgtaacaggaattctagtgataggaagtatatagcaaaacatgaatgtcagttcatcaaattgcataggtgagattcagtaatgcctcccaagccagatgacaggtacttttgctaagttacggttgatgggctgaggtatatagaaagacaaatatattctgcttacccagatcgccatagcccatggccttgcttagagcttgataatgtcatggcacttggaattagcaagatcatcaagtggagctcgttcctgtagagacattggtagttgagacttgagaataacctataaagagtatggatggacacataaatgtataaatatatattctgtaaatgataatagtatggttcagcattttcgtaaaaaaaatagtatggttctgcaacttgaaacaatgcatataatggtattcgagcaatgacaaacccctgaattcgtcagtccgcttacaattccagcaacatgacaatctgcaaggctagaaaaaaggggatccattattatttaaaacaacccatgacaacaaagtgctttacctttgccatacaaagtgcataattttgtggcttaatcaagttgaggcactaaataaaacagaagcccgccccagtcctcaacgcacaaaaacaatgtgaatgttagatcggagcaaacaaaactcaaagtaaagcaagcatgaagcaatggctgaaccaacatggaaggaagaatatatatgtggtctgagagtaccaaataacataatcaatgggtcacttgcagtttggccgacctggcttcaacaaaaaaaggaaaatcatggtacaggccaatgctcaaggaagaagattagggattagggacttgatgagggaccaaggcggagctccggcagagatccggcagagatccggcgaggatgcggcggagcggcggcagcggggaggaggaggcgcgagcgaagaggccggccgcgtcgatggggaggaagaaggacccggcggcggcggctccggagtggccgcggaggagcggtggcggcggcggctccggcgtggccgcggaggagcggggaggatctcctgccaggacgcggggaggaggaggagcgagcgaggaggagtcgaggagcgacgtcttcgcggcagcgggtggatgaggacggaggagcgatgtcttcggcgaatcggcgtgcaagccaaatcgtgcggtggaataagctgcgcctggatggacggtccagattagtccggatgatttggcctgtagcattggagcgggacaactcctcttttttatattatagtatatagatgatatatgtcgcctgtattgagcatcagggagagattagaacgagacattgggtaaatcatttccaatattagaatttatgattttaaacacaaattttgctccaactgtatctctaaacatctcctaaaaattaggcgttctcatcactgcgtctctcgctctcaaatcgatctgcgctttttccatttatctcagtgcttcttcccattgcgatcatgaaatgctacagccaggaacttccttgcgaagtcatccattgatgccgttgtactcatctccactgcaatcaatcataatagagttgcatatttcttaaaccccacaaccggttggcagctcccttcttctgaagagagccacgagtagcacactggggccgtaggactcgttgtcgctcaccagaccgttgttgtttccaccattgctatcgcatttgtcgaccatttcggacccaccggtgaggtaatcgacagacaacttgccaccaacgccgaggccgttgtcgatgtgcctaaaatccagttatatcgacttgcagtcgccatctaccaagttcatacaaaggcaaattatcctcaattttaaccaatctcttgaaggtatcaacatttttatatcttaaatcttgtttagggttctcatagaaaataatttgggtacaaaatatagagataatgttgatgatgctcttataaccacttctatttttttcgagactagcaaaatgcccatgcgttgcattgggtttttagataatggaatgaaacatcccggcctttactccgaagagctacaaccaattattataaaaagtaacacacttataaagtcttaattcaagataaaactatcaaaccaaccaaaattaaaagaaagacctaacatgacaaggaaaacattattccagcctattagaaaatctccatccatggttggcaaaaagttgtataaccgttgactcaagagtacgacatgcaacatttaggaaaactccatcttcctcacacttttatagttgagcccacagccgaagccaatatgttgccctgaaaattacctgcatataggaaacagatggtgatttgtcaaaaaccctatcatttctacataaccacagggcccaacataaagcagaggcaccaacaagtatcaactttctcttgtccttgtccacaccctgaagccaaccattaaacatatgaggcatgcttctaggaagatgtaatccaaaagaaaattgaacagctctccaaataaactttgcataatgacaatccataaacaagtgttggatcgtctcatttttcatgcaaaaacaacatgttaaacccccattccaattccgtcgtgcaagattatcctttcttaagacgactcccttgagcaaataccacataaagatcttgatcttaagcggcatcttaagcttccaaatgaacttatttctatcaatgtaaccattgctaattgaggctaagtacattgactttaccgaaaaatggccattttgatgataattccatctaaaacaatcagtagaatcatccaactggatatgagcaatggaagcacacaaattataccaaagtgttagattctgcccaactaaagctctcctaaaagaaacatttagcggaacagaacccataacactagcaatagaggcactcttccttctgacaatagcatataaagatggatacttatctttgaaggctatattacctagccatttatcatcccagaatcttatctgttaaccatcattcacaatccaagagcccatacttaagaagatgttttttaccttcataagccctgaccaaaaataagaatcaccttgtttcctatccacttgggttatagatttattatgaagatacttcctcttcaataaatcttgccaaacaccatcctcattaattaacttatataaccacttactcaatagacatttattttggatctctaaattatgaacacccaatccaccctggtctttgggttgacaaattatatcccatctagttagtctatattttttcttatggtcatccccttgccaaaagaaacatgatctataataatcaatcttatgaagaacccctttcggaatctcaaagaaagaaatcatgaacatagctaaacttgaaaggacagaattaatcaaaaccaatctacctccaacagacatatgtttacctttccaactactaagtttcctctctattctttgttcaataaccttccaatcattattactcaacttcctaaaatgcattggaattccaagatatttaacaggaaaagagtctagcttacaaccaaatatagaagaatattgatcaaggcactcttttgcctgcccaaaatagaatagctcacttttgtgaaaatttattttcaggccagatattttttcaaacacagataaaatcaatttcaagttctttgctggttgtaggtcatgttccaaaaaaattgatagaatcaagaagaaaataataattagtgtgtggaagcataaaaccaccaggttaattgaggtctttatagtcgaatcgaatctttccagtgcaaataagacgctaacatgatataattatttgctgctctaaatccactgacatggatactgaagtttgaaaccacaaaaaatatttactttttttgtcatgtattattatgagtcaattgcagtactttgttattttttggcactcgatattgataaacaatttttttcatactgtaaagagtagccataatccaagaaatatttttttgctagctatcagatcaacctcactgcactccaattgcataatcgctcactcaaataatcagaaggaaagaaaaaaatgtggtatatcgcagaataactttcactctaaataataaaagaaattataccatgaaggaaaaaaaagtgatgtgattaggtgtcctatgacgaatgagcaattgatgagggaaaaaatccagatgttaacacgattcattttgttggtgattatttgttttctttttaaaaaagaaagacacatgtgattattttttatattttaaaaaataatttattttatcggtaaataattcattttgttggtgactacatgtttacatttataaaattgcttttttttatccgattcctggttggcgtgagtccaaactttattcctgttccgttgctacagtgttgcgcagtactgtgctgggctgctgctgctcctccgctctgtgggctgcggctgctctctgggccggcctgctgttgctttggatgggctgactcgtcactaatccaatacggactgctttagatgggctgctcaacaaacaaggctttctcttttttttttctcctttatttgcgggcgtaagagatcgtggccacgctttcggattgtggattagcgacaaaatattgtgtggcccactctttaatgacggacgaaaagattaacaggaagcttttcttatttttttaatcttatactagcaaaaatgcccgtgcgttgcaacgggtaaaaaaaaaatccaattacaatatacacttttcatgcataaccatatcaatatatttgtatggatcgttgtaactaacataattagaaaattagaacatcttcatataatgacttaacctcgatgatggcaatcttaccaatacttgctttatctaaaataattggattattcatgtaacaacatgcatataatctagaatactctttcaatcttattcttgcaaccaataataggttaatcaaatcctacactctgggtcaagtctacacaaaatagtcaccgtgcacttttctctaaataacaattaaaaatatgtttattttttaatattatttccatataatatgttattaagaatagtatctatacttaacaaaaatagtccgataatcataattgcataccagagattagatgagatgaggaatcaaatgatgtgtaggagatagaaaaaaaatcgatggatcttatccgacccaagcatatatcaattttatctcgcattgagtcggacggtttttcggtttttcagagcggttctttatataaacagtggttttttttcttgtgttgagtcggatggttttctctgacttttttttagaaaagcggttttttttctcgcgttgagtcgaacggttttctcgaatcgtttttagaaacaacagttttggttttttctcacgttgagtctgattgttttttggatctgtttttttataaacggtgtttttttctggtagtttttttcagagcggcttgtttttttataaacggtgattttttcttgtgcggttttctcaaaccatttttagaaatggcgtatttctttctaaccgtttttaatatcttcttttttttttttgctttttcagacaaaggaaaccgtattttttcgagcgttatttggaaactgtttttttcttgcgcattttttatttttagcggacgatggaaacttctctcgttaagaagttagattagattctggttttgcggtcttcttttattctcgtgagtgatccggttttttccccctactcttttttttatcacgaacgaccagagcgatctgggagatttttttttctccgcgtcaattaatgagggtccgacattccttttttcttttctttttgcatttttctctccgcgttggacagatttggtttttctttgcacattttttttcgcccgatttttttatcggacaattttgattttttttcgcccggttttttctggatcagacggatttggtttttcttttctttgtttcgcactttttttcgtccggtttttttatcggataaatttgatttttttgtctagatttttttttgatcggacaattttggtttttttcgcccagttttttttagatcgggcatatttggtttttctcttctttttttcgcacgttttttcgtccggtttttttattggataaatttgggttttttcgaccggttttttttcggacgatggaagccattcttattttttaaagtagtagagattataataactaattaaaagattcatattttttctttcgtcaccaaattttcgttcgtttgcccgattttccactcgtccgtgcgatccctccctcctcgagtccgagtctgtcttaaaaaaaatcccgagctagatccccaaatcaatcagtcaaataaccaaaaagaacaagaaaataccaatatcgacctcataaatttgatccccacaataaacctaacacccatgtattatctccctcccaatccaatccatctgagcgacaataaaaaacaatagaaaatgaatcacaaatccacaaaatcacgaaatcacaaatccaacaacactaagttacgtcgggttgcaggcgacgtgtggcggcggaagtgcttggcgcggtcgtcgggcttctgaacgagcttgacgcaggccagcggcaggaactacatcagttgaaggccaacggtttttgagggcagcattggcggtgactcaccataggtcccgaggggaggcggtgcggctctggagcccttccgctggatctggaggagggagggagcctccgggcggccaccgctcctcccgccgcgcgtcgccgaagcaaccgcacggtgctgccgcggaggggagggcgctgtcatcgccgccgatgccacctcccgccgctgggctgcaccgtcttcacccgccgccgccacccgtcgcccgccgcctcccctcttgcgccgccgcctgccgccttggctccgccgctccgagagagaagaccgagagcaaaacgagagagatgatctatgtgttggaattaatgaatgggccttagcccactcgaattgttggaattaatgaatgggccttagcccactcgaagattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacacgcgcgcgctcgcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgctttgaaaaacgttccgaaaaatccggtgcgtgcaaacggcgtggagtccggataagttacgcgcgacttatctggttcggttacgcgcagtagagatcgtgcgggcgccctgatcaagcgacccttctctatataaaccgacctgccgtcttcacgcagcacacgcaaaatcaatctagggtttgcctcctactatgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctattcgttcgcgacggctcgccttcctcttcgctcgcgtgtttcgtgccttcgtagacacctgcgaaaagtttcgaccaagcagccggtcttttcgtcaccttggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatagtaaattcggtgctactgatgctagcaatgatctgtatatcatggagcagtttcatgactacaaaatggctgacaaccgttctgtagtcgaacaggctcatgagatacaagccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcggaaaagatcgtgcagctgaagaatgtgcagcatgtcccttctatcgacaggaatcttgttagtggctcccgtctgactagagacggatttaagttggtttttgagtctaataaagtagtcgtgtctaaacatggatattttattggtaaaggttatgagtgcgtaggtctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgccgaggagagaaacttggcaccactagaactcctacattcagatctttgtgaaatgaatggggtgttgacgaagggtggaaaacgatatttcatgacattcattgatgatgctactagattttgctatgcgacttgttgaaaacgaaaggcgaggctttagaagattttaaaatttataaggcagannnnnnnnnnnnnnnnnnnnnnnnnnnnnnnnnnngagtttnttaggacggtnaacagcctaaaacccctgggnggggnggggagtcggttacgcagactaatgagggggaggttgattagaagatgtatntatgaagaaacaaaataccatacattaactag

SEQ ID NO: 390 - DNA, 1042 bp, Oryza sativa
  unsure (1)..(1042): unsure at all n locations
gagttcgataacggattggtttaaacaantaatgtgatcgtcantatctatcgtacattggaaacagcatattaaagtcagcgctagacgtttgttngttcntgcacccancnnaccccccccatggggtgatttgctggtcactctccgtgcgaancnagctcggtacccaataaatatatgttgttaggcaaagaattttaaaatgtgcaagttttccaaaggcagcacaacttataaattattgcatattaatcatggcatctcaaatgttttaaaattttaggtgacataacagattcacgtgcatctttgcagatgagagcatttactcgaacaggagatattacaccaaaataagcaaaagcccaaaatctccaatacaaacgttataaaaataataactttactcaatttaaggaggattcatatcaaaatttatcgtgcctgccatctagacagaaatgtgatgctcaataggggtgtttatgtaccatcttaaatgatttgcattatcttccaacataacagattaatggacattaccgaacatgatgtagaattacaaatatgaaaataagaaccactgaaatgtatttatattgggggaaggcaatgatttgtgctaaaccatagttatttctgcaatggaatagctcgctgaggatcaggaccctaaccacgtcagaaaaaagaagggcagccttcctatcttttttaaaagaaatatgcatgctttaacactgccgcagcgacatcaattctaatggcattctaatccgacggtagcaaacctaatccgacgagaccaaaccctaaaatccgacgagaccaaaccctaaacgtgtgaaaagaaaaaaaaagagtaccaaaccctaatcgtcttgggaaaaggaaaaaaaagcaatccacctaaacctagatgctagattcgtgggaaaagaacagcaatcgnnnnnnnnnnnnnnnnnnnnnnnnnnnnnnnnnnnnnnnnnnnnnnnnnnnnnnnnnnnnnnnnnnnnnangtgtcattcaaggcgcg

SEQ ID NO: 391 - DNA, 6837 bp, Oryza sativa
  unsure (1)..(6837): unsure at all n locations
atgggttgggtgagtgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactttatgtgtaactagctgccctgacatagttttcgtcaaagttcatatcttacttagctatataattacgtgtaagtttttccctcatattatcatgtctatttataaaatattaaatatcaaagttttgcatctttatgcaggttttgcagaggaagactgaagaagctgcgatggctaccaaaaggctgaaagagttactagaggctcggaaatcatcaggacgtgacaactcaggtatctctctccgcattgcgaccatttttcgcattataattaatactcccaatctaacagctcttccttctttttctttttttttttttttgctttcttccaaacacatcaggcatgaatggtacttctcctggctctcatgtaagttattttccatacttaaagaaaaagatcagttgcttatttggaaatatccttgagaatacttttttttgtaatgcagatgactgagaaatcattgcaaaaatggctagagcaagatttggaagtcatggtgcatgttcatgaagttcgaaacgaatatgaaaagcaaagtcaattgtatgtgattcattttatttccttcccaaatgtaaattatagagatcattcctcatgtaatgcatgattatgatgactaatttaaatggttttaaaggcgtgctgcacttggtgaggagcttgccattttaaaacaagaagatgtcatgtctggtgcagctagtccgcccagagggaagaatggaaactctaggtaactgttatccccatagttctattttgtagttcaggtacctttaagctggacagtatctttaatccatatattatcacaaactgtttaagaaatataagagcaccgtttaatatgtccttgtctgtaatctggttgttatatttgggtccgtattttatatttctcatattttctcaaaatgtgcaatcagcacatccaaatatttatgcttgtattgctgcattttgtttctcagggcaaatactttgtcaccaaatgcaagacaagctaggatagcatcacttgaaagcatggtgacaatatcttcaaatactctcgttgctatggcttctcaactctcagaagctgaagaaagagagcgtgcattctctgggcgtggtcggtggaatcagttgcgttcaatggcagaggcaaagagtttactgcagtatatatttaacgttgctgcagatgcaaggttggtatttattcttttggcttcattatttaatagtatggtagcatccatccttgtaggacttctcaatttgcagaacctggaaacaaattatttttactaaagagctaaaaatctcactttttctttctaaatagttgaaaatctgtaagtgttattttgctaagaatatggcactgattcgaataaaagagtgtggtactgatttgaaaataggaataacaaaaaaaaaattctgaactcaaagggcaactttatttcttcctgaaagcatgacaacaatgtgaatggaagaacaatgcaaagccgtttttatgatactctgtaaaaatgatcatttgtacaaaagtatggaactaaccttcactgttgaaatatcagatgccaagtaagggagaaagagatggagatcaaggaaatgaaggagcaaatgacagagcttgtgaccatccttcgacacagcgaatcacgtagaagggaaacggaaaagcagcttaagcaaagagagcaggcagctgtaactgccactacatctccagtatggtttctatgagctcacagcaattacccctcagtagaaaaaaatgttgaatgatgaaaggattacctaaacatctaaaacaaatatctggtggtgaggagggtatttaacatctccattacccatgttcaaattctctcgtacgccctgcttgaaagggcgaaaagaagaaaacatatcatagggtatagtagatggaactgacaaaaaaacattgagtcacttgaatccctaactgatagtcacaagagtacaagatattcaacaaatatcgtgatagttcttaatggaaattttatgcatcttacagggaaacggaaatggttcagtgaagcactctgctgatgactccaacacaccattgtcaccagttgcggtgcctgcacagaagcagctgaagtactctgctggaattgtaaatagccccagcaaaggggttcctgcattcaacaaacaacatcttaaggtatctctacccccctgaaatactctttgttctatctccctctctcgtatttaaaattggtgacgtacaatgcagatggttcctatggcacagttgcctgttggcaagaaggtttcaatagcagggcaatcaggaaaactttggagatggaaaagaagccaccaccagtggctactgcagttcaagtggaagtggcaaaagccctggaaattgtccgagatgattcgacacagtgacgaaacgatgacaaggactcgacccagaccccagcttcttcctcatagacctcaaagagtgatgtgaaaaaggcttttcttttcttttttttcttcgtctccacatggactgacacggtttacacagctaactacctccacaagggtaacaatgcagctaaaagctccaggagatctccttcgtgcttcgattttacttagccacgggatcgaaaaaaaaaaagtatatgttcatagggtgactgtctttggatgtaaatttcttgtgcctatatagtgagtgtgaatgttagagatgaaaatttagcgagtgagcgagggagggagtggccgttcttcgcgaaagcactgactgagcacaatgcttcatgtttcagcactcatcaactggtgagatgtcatacttgttgtccttctgcatataaggaaaaatctgtcgaaggatggcgtcttgtaaagtcctttctggtgtgcttttgtgatcttgcatgggtatagttgcaagaatgatgatgaaagttgagattttgggtgcttgggcagtgcttattttcttgtccttttttcttttttgttgatacaacactaagattacattggtttggtttgtgttaggagtctattgatgtactacagcaacttgtgcccctatattttggccaattgtgtattctgtgctgttgatgctttgactaaatagagagcagtttgtgtcgacgtctatctaaagactctgaacttcgatggcaaacagccaacagcgactgttgcttagaatttcagcatctacagcaacgttttgtgtttttcattggtaacatgtgccaacctgttcaagtgtgcataactatttattaaaacatactagaaaccgctactttatgtttgatccgcattttcgctgcgaatagtgagctaacaatgttcatatgtttttgacaatagtataataaaacacagacacggggtcgattgagctaacgatgtaaaactaagctagtctgtttctgccaatcttagctattttcttgttgcagtcgactgatacagtcatttgtcggtaataacgtgaaaagatgccaatttctgaggaattattctaacacaaaattattgtgtcataatccgttgtagtctagctggttaggatactcggctctcacccgagagacccgggttcgagtcccggcaacggaatttatgcgttttggcccaacataaagaatcactgttgccttcacaagactcaaatccttgtctgatttcaaagaattgtccaagtttttgtttttctggttcagagttcagagggcaatttcagcatccatgtttgtcattcaagttccgaacccgcgtgctatctttgctcgggcgtttgggtgaaatagggctttcgtgctatcacacattcacactccatcaaaccaaatgcacagaaaaattataaagctttaagaaaacagaaaattgttctatggcataactatctcaagcttaagaaaacaatcattcttctcctgctgtattggtattatgctttacggtcaacagatcattctgtctaaggcacagctcaaagcatgtgccacggctaggttatgcaaacaacatccagccaggaaaaccaaataacattatgatttatgtccagatttatagttttaggaaatgtctcatccgtccaaaattccttatattttgaaacggaggtagtatgatttatgaaggcatcaatgaaaaatccacattagtacttgaatagattctgcatacatcaaccatcatgtctctgtctgcatacaccatcatgcaaattaattggcatgcaaccatgcataacctaaagtctctacattgcatcaatacttccactgttactgctgtgtacaatacaaaacttatgaaaaatcagcacatccagaatgcctcaaaaacaagggttaagcataccacctgtgcagccacattgccttgtcacctccttttcagataatctgttagaaacaacaagaggcgattagtggttacaataggaatgcgactgaagtttcatttggttcgttcacaatccatacaagcttacaaagggattggcaaaggttagttctcagctctaatttataaaattaaaccccacacaagtgggaagacaaaacaatggaacacgcacagtgaaagatcagtagtatttcttccacacaaactgcacatcacatctatctatgaaattttgaaacaactacttcctccgtttcatattataaaactttctagcattgcccacattcgtatatatgttaatgaatctagtcacatatgtgtgcctagattcattaacatctatataaatgtgggcaatgctagaaagtcttataacctgaaacggaggcagtaccttacaataccaacccataggaaaaaaaaatggaacacctacagttcaggtcttactgaatagtactagccagcattaaaagtgtgcagtgcttctaaagtgtcacagattgatcaccacaaacttatttcagcagcacattgctacgtgattttgcctgtccgaaattatcatgcatcactcgtcacaactatctaatcacaatccaggatcttaacagcctagttaggacttaagatcagatgctagctgcagacgtggctaaagatgcttataaaccttactgacatgcttgtaaattgtaagttgtaactgcaataagaggttatattaggcaactaaggagcttgtccaaattagttcataacctcttgaattacaatactgtatgctcagctgatatcagatgtcgagaactcaccagttgatgggtttaacatcccatctactcggacgcttcctcttacaaatcaatctggcaggctgttcctcgttatcggattcactttcgtactcttcgatccacccataacagggcctccttgtgccatatgttactttggcttcaggaaggggcagagttgcttcaactgcaggcaggtcaacaagcatggggtccgcgtcctcgacttgttgttcagtctcagcaggcatcacattgtgcacctctatgattgacatgctcttgtcttccaatggtgcctcctccaattgctgcattacacgccaataccttttaataattgcacactacgcattgattgtaattttcagaaaccgtggaacaagcaattttcagtctagagctacaaatcgagttgtatcagcacctaattcgaactggaagaacgtcatatcaaatcgtaatgattagttctcaaattatcaaataaggcacttcacactgagaactagatgtctttggcagcagtgggtgactgaaaaactaagggtgggtctggaaaatgaagagcctgaacgatctatgtttgcaagttgcaacagagaaaggggcatgttctgagaacaaaaaaatggcagcagcaggtgcagctatgaagcaattttttttttaaaaaaatacagatcaagctcatcgaggcccagaattcgaagtgaaattcatgatgttcaataactaggagacctcaaatcatctactaaaacttggtcactgtaataatgattgaatcaagggttaattggatccatgccactacaaatatgttgattcagaaaaataccactacaattcgtctagtcgtagccgtgccactgaaattttacaaatttggaacggtgccactgccttcacgttttacatccatctcttcttattttccattttcttccttcgttctcccgtcttcttcctgcactgacgagccgcgagtggcggtgggacctacgagcgacggcgggacctcggcggttcggtggtggcggtggcaaaaagggaaggggaaagggtaggagagaatctatccctctcaccagatctggatggagttgaggcgaggcgacaccaccggcgatggagctccgcgtggaccccatggcctcagccgattgcccttcttccctaccctcgtcgttccatctccaagctcaaatcccaaaaccctacccatggctacctcttccaccagctcctcctcgggccctgccgtggtggctgcggcggctgaggccatcgacgggccaatccttagtgttgtctcaaaacggctccacgcactgtggaagaagcacaaaaagatcctnnnnnnnnnnnnnnnnnnnnnnnnnnnnnnnnnnnnnnnnnnnnnnnnnnnnnnnnntttcacagctgacgttcaaatcaaggcgcgg

SEQ ID NO: 392 - DNA, 9126 bp, Oryza sativa
  unsure (1)..(9126): unsure at all n locations
cttttgttgaggatctacttgcgctcatctacttcggctacctcttcgacgtgaagctgcataccgagttcgccgccaccatgctccagcgtgcaaggagtgggactgctgcatcacctatgactatatccgcccttgccgcctcatgccctgctgcggtcccgcctcacaccctgtcgcttaccggtcccgccactcatcggtgcgggaagacgatgggagaaagaaggaaagaaaacggaaaaaaaaaggaagagatggatggaaaacgtgacagcgattgtacagttccaattttgtagaatttcggtagcacaactacaaatagataaattgtagtggctgtaggatcatagtggtcgtggcatttttctgaatcgacatatttataatggcatggatccaatcaacccttgaatcaaacagatacattgtgcccatgtcatagtattactgttaccatcaaaactactaaacaaaaccgatttagaacaaggtgtaaaaccacctatatattattggaaatttgggtgcaaagcactaattaggttggattccccttgccttttttttttcagaaattgcaacaggatataccggttttttagaacaggaatagttggataatgttaagaattgaagatgaacttgctggatataatgttactattggtagagcagaaaaataaagttttttgatgaatgtggattgttgcatatatgtattgatgagtacgcggacattgtaatgtattaaaaaagaagaaattctttggtagtcgtaagtagtagcaaatataaaaatagttgacagccagaagtggaaatagaggacatgaatgaataggatgatcatcaagagagagatgaatagtagaaggaagtaaagcagcagcagcacctgtggatgagggtgaggctgctgttggtgatcctcctgctcctgcttctcgaagagcgcctcctgcacgacgcggtacgagtcttcctccaggaacggccacccgtcgttccccccgtacacctgctcacaccacgacacacgaacagaaatcaccaagaatgctaagctagcttgtcgatcgatcaacagggcctagaagcaaggaaaggcgcgagctttaatttgttgcatctggacacctccaagaacacagcaaatgtggaattttgatcaccatttccgcggttcttggtcccaagaacaatcgaacaaaaaaagaaaagaggaaagaaaccccgggcctgtggtgacggagagatcaggagggaggagggattgagctgacgacctggaggagttccttgacgacggcacggacgtcggcggtggcgtagcccatgggggtgaagtggtcgatggcggcgtcgatccggcgctcccccttcttgggacgctgccggggcattgcaaagagcggaggaagacggcgcctaaaacggaaagtttcctcttcacccctccaaactccaaaactcgacaacccaaatagggtaaccgaaagagaacccccacctccggaactcatgcctctgctatcaaatgcagcgccatgcctcacttttgggtccgcctgcctcacaccattttttctgtcataaataatttcataatgaacaagggccttttcttttctttttggggcaatttttttctattttatgagtatgaacggggtggtagtcttaaatcattcatctcctatttgttccttcccttatcctagaggaggttgtggtcctccaacacacacacatctctaagctagcaccttatcggctggtgtaaaggatccttacgctttatgtttttatccatgcaacctatcggttgatgtaaaagatccttacgctttttgtttttatccgtaagtgcacggataatcgagttcttcccctagcacaaaagtggtttttgatctatccacgtaaacacacacaaccatcattggcgctggttggcgatccttaggccctttgtttttagtaagcaaacaaacgtatgcatacttccttctccatgatacgtcgaggagctctttgatgacaatgtgatctaacaccctagggattgtatctatatatatatatatataatttgcacatgtaatccttgtattgcatcatgttgccacttttgctttgcttgagtagtttagagcttgtttggttgctgccctgacaacaagttgcctggctggagacatgcctaagactaatttgtgagtgtttggttgctaccctaaggctccttccacctcgcctggcctgatgtaactcaggcgcggaattagcctgagccagacgaccaaaatcggtcgcctaggcttcagacgcagcagcgcgctacacattagcaccataatcccctcatccccgccgtgataacttcacacgaagctgccgaggccgccgccgttgccgtcgcacgaagccatcgcagccacacgaagacccctccggagtgctgcgtcatgcttcacatgcagatgctcttctatgatggatgcatggattttgcaattctattctgatggatgcgacatggatctggggatctctttgctcctgttcttctctcttttttctcttcttgatgatttccttgttgatcctggtgtctacgcaaagcagtgccgccgtcgtgcggaggcatcgtgtcgtcaggcaaggatttcttccgcccgtggttgagtaagcagatcgactttacaatctgggtgcaatctttgctttcttttttttcctttttcccttgtttgttcccccttgtttttagattattttttcctttctttgttttatgattgatttgtgtagggatctgttgcactagatgaatttggttgtaggtcagatgcaattaaatgcaaaaatttgtgtcggatattaatacttgacttagcggcataataatcaaacatctaattgaattttttttctcaggcacaagtgacaaccaaacaagcacaggctcaagctgcctgaccaggtagcctacattacaaacttgaatgccactcaggcttacaaatttctcaggcacggaggtgagggcaccaaccaaacaggctcttagtaatccacatttaaacacgacatacaaaatattaactctcaaaaatacacgataactcatgaattaacaatttaatttctaagtacataaaaagctgtcacgaccggaaataacccaacgggcgttccttacgtgcgtgtattattccttgtcccaggaggcaagttacaccaaaagttgatacaatacagagtttaacaagcggaagcgtaactagataatttattacatgggcggcgaaggcccagcacacaagagacaaacgaaaaacagcagaagactagggcgatgaccacaggcgcatgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagttataatataggggttaagttttgcagtaaacagtatttaaaagtcacttagttgcccaaagcgatttggtaaacacgatcctagagctatacaagattattaatcaaggccatgaacccacatgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctaggcttgcccataaccgagggcgcggctattcgaataggttatactctgatcagaggtgtacatctttacccacaagatatgtcttcctcacgtgtaaccacgtgccacataccaccacggcatacggacggaagacatgacatagtttccaacccatcctagccatagacaagagtaccgacccaaccccacctacggccagaacctccgggacaggtaggcaggactgagcccctagcagcaggacaccagccctgtgccatgacatctcgactaccgggccgcagctcgtgtagccttcatttgccctagagatgtccatcgacccccgacttcatccatctccatccgtgtacttttgtttataaccagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttgaggattttgaatagagggggaggtgtgagtccaattccacaataatccaaccattccatagtgtccaggtgatatgaatattcccaaagtctagagttgtaaaaccacctaatgttgcctaattaagcagcgaagcatctacttaaattcatactagtggtaccataaatagagtacccactagctggggttttgtttattctagggtgaacaaggtaataataccaatagcaataataataaggtcataacaaaggcaaataggcatggctaaataaaacaatgataacgcgggaatttaaataaagcgataatgcaataatttaaatcaaaataattttataaactgggattcaatatgttcaaggatgatgtgacttgccttgctcgctttcccacacgtcggcttcaacctccacgtagagcggatcttccgaagctgcagcgtctacacgactagcagaaaggaaaaaggcttttactctaataaactccatataacaagcaggaacaaagcacaaaaatgggttcttgacttcttaagggaaaattagagacttgaacggtccaattccgagttcaaatggccaagttatggccatttgaagtttatatgctctttaaatgaatatttacgaatttcttcatttaaattttaatttaaaaatggtttattgcgtcagccgaggggagagggcgcgcggaccgagtccacgggagtggggcccacgcggcagcctcacggtccacggtggaccgggtgcacccaggctcacaccggccggcgccgtgggccccaagcgtcagccgcacccgagggcgcgggcggctgacggccgggccccacgcggcagccgctcggcgcgcccgaaggcggccacgtcggcgcggccggcgggaggcggcgcgcccgcgcccctatggtcgtcggcggcggccataggcacggcggagcggcggccgagagagggaagggaaagggggaaacgaggtggcggtccacggctcaccctaggtcgacgcgacgacgaaaaaggcggccggagaggaggaaggcgtcggcgcggctcgggtcgacggggacggtggcgcttcggcggtcggcgagctcgacgagggggtggacggggacggcgacggtgcggcgaagccggaggaggcgacgccggggcgggaaacggtcccggcgagcggagagagccggccgaaggtcgtcagcgacggaggagagagagggcgacggcgcgagctcgattccggcgaggagacggtgcggcaaggggcggaaacgggcgagggaggcgcggggagggtttaaataggattggaagggggagagggcggccgggagaggaaggaaaccggccgggaggtccggccgccatcaatggcgccggcgagatttgcgggagcaaatccggccgtttgaatgcgagagagagagggaaaaatggggggaaagggagaggggatcacggggagtatttcccctcactttattgcacgcggggacggcggggtgcggcggattcggcggttgcggcggcgctaggcgcgggcgaggcggcgggagcggcaggaggaaggagatgacgggtgggccccacccatcagcgagggtggcgggcgggcccgcccgtcagcggcgcgcgcgcggggaggggccgagtgggccgcgggggaagaggagagagggggaggagagtgggccgagccggcccaagagagggagggagggtttttagggtttttctttttataaaacctttttcaacttggtttatttcttaataattattatttgtgctctgaaaattccactaaaatttatttacacattttaggcctttaggaaatataaaaaaatcccctaagccttatttgacttttactttgcacattttaattgttggaggctttcacacggattttaattattctaggcataatttacaggatatattttaaggtcattttgggacgtgacaaaagcaaggttataattcgacagcacataaccaggaactgaaatagtttgatccccaaatctattgaaatacatgacccaggatacacatcgacctcgctcaccgtcacgccatgccactagccgaccacaacttttttttaacgacccacaaccagacagtgcgaagttcatgtagatagagcaggaaaaaattacaagattacaatcctgaagtgtcgtatccaggaaaacaaagaaaaaatccaccaggaaaaaattacaagattacaatcctgaagtgtcgtaaccagaaaaacaaagaaaaaatccaccatccgctcaccgatagctccaacacacagtctgtcaaggggtgatcctctctagcaggaggccatgagacccccccccccctttgtgagttcggccgggggaccgggtgcaagagctgaagagcgcgttcttgtgtgagggagtatgtcagtggaaatcaagttttcaaggtggatggtgaaggaaacgagagaaagggattatccaggttcgggccgctatggagcgtaataccctactcctgtgtgtgcattgatttccgaatggttacagagaactcggatcctgggagaactagctagggcttcgctggccttttcctagaatccgatctatcaagagtcatccccttgctcgtagggcaaggtcctccttttattgatgaaggggataccacatgcactgctcctacgctctcctcctgagagaggggcccacatgctggtagcgaaaggcattccgtgccttggatcggaagcgattcatgcggctgctttcaggtggcccccaccgaaatcctccgtctgacataggggacatcccccgtcattccacaataacttcttgatgacttcgtgggctcacgcgcgtggggagtaccgacctgcacgcctattctctacagatgatgggacggggcataccagcccccacgccgcctgacacaaggtggggcgtgggtgcgctgctgactatcccatccatccatcgccgggtcgcagaccggtcaagaaacggtcgcctggcgcacttctatcggcgggcggtgtgcaacctgccacgtcgcattaaatgtgaggggggagggcgcttggagcgccgcccataaatgcggctggcaggcggtgccctcgcccgctcaagcctccatgtggccgccacgtggtagccgagcaagggcctcgggggtgactcagtcccttgggcccgaggggtacgacgaggtaccccgagccccccaggaatgcgcagccgctttttggctactcattggccgagtgcccgatcccccggggaggggggaggggtccgggccacccgggcgcgtagcgaagggaaaggcttccttccccttagtccaggtacccccaggcccatatcaccgacacagtattagtagaaggctagcaccgaaccagccgccgctaggccaacaaagggactgcaaccaggaggcccaaaacccaaccctaccaactaacactgaactgtactgtatccatgattgagggagagagggtgagagagaagatggaaccgttctccctctaggacctccgacatggccaacttgtataatctagggcgtcgacacaagaggactgagatctaggggtttcgtctaggagtctcctagatgatgtccttagggagaggagcgacggaaacaccgctaccgtgacggaaacacgtcgaggtctgaaaggagaatcgagactgggttttcacccggcaaaccccttagaggcaatggggcatcacgtcaatgccctcatgagggaaagcgacgctcaaaacaccgtcgttgccagcccggccaagaccgggcttggcgtctcttggcatgatgcccaggcaggcgtgccctgggcctctccttcttttttctgtgcgacacatcgttgatgcctacgataacatacataacgacatggtaagtaaagatgaaaaacttatctcaaaaaagaagaagaaacaagtaaagatgaaaactgatcgagtaatgttccattcgatcttccttggaaaactagtaattgtttgggtgtttatggaaaaaaatgcaaaaggactattaaaaataattttgtcctaagagaaagctcttagaaggattggattaatagtgtagtcagctgctggctccaataatatctatatcattttacagttaataaaaaaccaactaatacaatagatcagctactccctccgttttttaatagatgaggcnngnntgnnnattannattttnagggcccgctcttcaaactggtaaatgggggggttccgggaaacaattttctttatgagaggtggctccaaagttcatattgatctactgttcacgttggggatgattacaactcagtttattctactttagattcacgtgggtttggcgcaaaaaaacgcttatctttatttttagaaaaaaagaaaacaccatgttcgcccccaaaacctagaacccgcactcactttgtggtggaggcctttcctcggcggttgcgtcattcaaattcgtgcgctggctgtcggctccaggcttaaggacttcaggccacaccggtagggagggcatacggtgggccgcgcctcgggggaagggtcaaggcccgccggtgtctttgggggaagggcaaccggccgaccgcccaggtttagctccaatatggggccttaaaccacccgacggggggtttgtgtgtatttggggtcaccggggtggaattgccgtgactcctgggttgttattgggcgaaataatggttg

SEQ ID NO: 393 - DNA, 49263 bp, Oryza sativa
  unsure (1)..(49263): unsure at all n locations
acgcgggcctttgatttgcanattgtagttaccnnnnnnnnnnnnnnnnnnnnnnnnnnnnnnnnnnnttgactttttcttacatatttgaccattcgtcttattcaaaaattttatgcaaatgtataagatataaatcacacttaaagtactatgagtgataaaacaactcataacaaaataaattataattacgtaaattttttgaataagacgaatggtcaaacatgtacgaaaaagtcaacggcgtcatctattaaaaaacggaggtagtattatattaacttcacatcattaatcaaacaataggtccattatgttccggcaggcacatatttcgatcagaccaatgtaacaagttttatatatcacaaattaaatgtagcttaaccggttagattttttacgtggaatcaactcaccagggtttaagttttaaattttagactcacaatactaattttatatttgtggtagacgtagtattcgtatccatggtgactttgttaaaaattaattcgttggcagtaaagacttttccacatcactatacaatagagcagaaaacccagcgaggccataatccgttgtagtctagctggttagatactcggctctcacccgagagacccgggtttgagtcccggcaacggaaattccttttttttttttgaaattttcattagctttgacgttatatctttacttttgaagcatacaaacgaaagacatggaaaagggtcctaattcaaaccgaatgtacgttttcaggttctatctatgcaaagcacagatcaactaaatcccacatttgacatttcctgttgcatagagcttatgtactctaatactacctccctttttcccttttttaatagataacgccgttaactttttatcacacgttggaccattcgtcttattcgaaacatttacgtaactataatttattttgttgtgagagtattctaagcatgatttatatcttatacatttgtataaaatttttgaataagacgaatggttaaatgtataaaaaaaattaacgttgttatctattaaaagagtaaagtccatcaccggtccctaaacttataccgttgtgtcatcccggtccctaaactcacaaatcgaccgttcaggtcctcaaacttgttcgactgtatcatcccggtctctaaacatgcagatcactcgtttaggtcctacaacttgttcagttgtgtcaccccggtctctaaacaggatggtctaaaaactttatatcaaaaaataattcataactttttcatgttaactctaatgaagacaaactttatatcaaaattgtagccctcgacgcgacctacaactttgtagttgaaaagtttttgaattaaaactgtttagggtcccaaaatattgttgcatacttatagatttcgtaagttgaattttacaattacattttgggacaacaaatggcttaaaataaaaagaattcaactacaaagttgtagatcgcgtcgcgggctataagtttgatataaagtttatcttcattagagttcacatgaaaaagttatgaattatttttaaatataaagtatttagaccgtcctatttgacccagatgatattcaaatccaagtttagggactggggtgacacagctgaacaagttggaagacctaaacaagtgatctgcaagtttagggactgggatgacacagtcgaacaagtttgaggacctgaacggtcaatttacaagtttagggaccgggatcacacaacgatataagtttagggaccggtgatagactttactcctattaaaatatgtaggagtatactatgttttcaatgtctacagtcaacagtacagatcattctgtccaataacccaaattggctgctttgtgtcaatacttgtacaactactgttttgagcaaagtcagaagcaacttcagactgccttaaaagcaagggccatatcttatgccttgcacaccacattgattcttcttttccaggcactctgttaaaaacaataagagatgatgattagcagctggaataccaaaaccacaacagcacacacaggtaccaggtaaaaagagaagcaaaataatgaacacacttggaactttgtatgtaccttttcatcaacagattgcagaccacatccatgaaaaattatcccagcttccgcttacaggacaagctttcttgacttggaacatgcatctcctcttcagtgtcggattcgctcacatactctataagccacccgtagcatggtcgtcttgtgccacagattactgtagctggatcgtcgaccagcatgggatccacctcctcaactaagggttcagcctcagcaggtacctcgtacacctctacgattgacaggttactttccaatggtgcctcatgttagtactaatcttgttgcatatgattcttttattgttaattagttttgtctagagtgatcacgtcatgtgttagacgtgtttgcatatggctggaaacttgatgtgttcaggttgaggctggccaatgcataaatgggtcaagtggctagctagttagaacatgcatatgttgcatgccttaatgaatgggctagttagttacttagtagataagtacatacatgtgttgcatggattagaggagaagtgcatgcggtagagtctgggtcaagtaaatcacgcgtacgtggcgtgagactcaggcaaattggttgctctgaagtatgtgcgcttgtgaggcttataaagccatgtaatcattagttgattaagtgagtgaacaacagagaaaggaaaaggcatttgttgctgaaaggcttctgttcttgtgtccattccatatacgtgtgtgtgttgcaatgcagaaaggaaaaggcgtgcgtcgtcgctggtgttcgtcaccaagtaatctcgtgtgaagtttgatccttggctgattccaacacctcatgcattgctccatccaattgctgcattacacacgaattccaattaataattacacaatatgcatctgcctagttgactggacagataggaaccgaaaacactgaacacgcgattttcagtttagagctgcaaatcaaattgtttcagcacacaattcaaaccagaaggacgtcatatcgaatcgtagggtgtgtttgtttctttgccaaactcaaccataccaaaatatcaaacatgcacgtaatgtttagttcttcaaattatcaaataaggtaggtcacattgataattttgatggcttcggcagcagtgggtgaacctgaaaaaccaatgataggtctggaaaatgtagactcgacagccatccatgttcagaacagagaaatagacatgtactgagacgaaacaaagtcagctacgaagtagtctaaaaaatacaaatcattttcaggaattactgtacattttcagacacaatcaattcacctaatatggaagagccctacaccctttaaatgtgaattctttagtcgcgaatccctctctactatgttattcactataaaacatgcaggttgacaatatccctgatctgtactagcccatggacagacgaggaaagatgttgcgtcactagtcatggtgaactgataaaaggggaggcacattcttctattctagcataagcaagctatctaggacagattattcacaagtatccactatgtaattttaaatcagccatccagtggggccaccagtaccccgtaccaccttgtaaattcggcttcttttaatttctcctctccttttcatttaacatggtagtcctcctgccgacacattcaagaaaaagcgtgcaaattggctaacccacaccagcaaaaatttatagccttcaaatttaatcttaataattagtatccttcagatctcactgtatagtgattaagcaaacaaattcattgtgtctgtttttctggcactgcttcatttagtttcttataatggaaataacaggtgttttaatggctgatcaccgatcgtgactcctaaccagcttaagcacctaaacttgcaataatgaatcacattacctcctaaccagctttgtgtatcgggttatgccactgtagagatgacatgacaggaaagtcaacctttaattgctactttggataatttcagcaaccatatgttttaaatttggcaaaaaaaaaaagggattaatgtacattgcccatgtcgcagtattaccatgtacaccattgaaactactaaaacaatctattattggaaacatgggctttaaagagacaaatgcaatactattgggtaaaagtacagttcatcttcaatatttaaaagtgaggcaaatgcaatactaccggttctttctcagcatggtggggcaaagccatcaaggggtatcctgaagagttgcacaaaggactgaactcgttgataatccctagtggcttgggacgttaggaagcaccgcaatgattgtgttttaaatagtgctaattcaatagaaaaggaatgtagtttgtggagtttagctggagctatgagcttctctgtaggttgcttacccccggcatttagtttgtgtttgcttgttagtgacatgtgttgccgttcggtgttttgtggtcacatttgtttgtttgtttgtgtgtgtgacacacacacacacagttgggtgggtggaagcagattatcaagttgaggcaattcgattcggatcatttgattttcgttttgaaaactttcagaccttaagaggggtcaattttggtgcaatggaaatataaaattttgatgattatgcaatattacatatgtatttactaactacacatcacaatgtattataaaagaaactctctgataccaaaaatagttactagaactacaaatatgcacaatatattagaactaaaaaaccaaaatgtttattatgatagttgtgatcatttcaacatatagagagcttttactaaaaaaagagataacacgattagacccccagcaaccagttgatggtaagatgaagcatgagaattggatgatcatcaagaaatgaatgcatcaaattaaatgaaagagagcgaaccacctgaggctgttggtcttccagttcctcttcctgttgaaacagctgcagctggagctgttcttccttctgcttctggaagagcgcctcctgcatgtcctcaactgtgggttcagcctcagcaggtacctcatgcatctctacgattggcatgctatttttgattggtgtgtcctccattgctccatccaattgctgcattacaaaatatgcacgttcttagttgactggatagataggaacagaaaacaccaaacacacacttttcagtttagagctacaaatcaaattgtgttagaacccaattcaaagagggaagacgtcatattaaatcatacggtgtgtttggctctttgccaaactcaaccataccaaaatattggtgctgccaaaaattttgtaacttattgggtttgtacccaaaattttggcgttgccagttttttggtttgattgattttggcaaagtccatggaggaatactctatggtagcaaccaaacactagcctagccactcttgccaaaaattttggtaagcaatccaaggctaaacttgttatgtgatttatcctgtgattttttttggacgaagggcatactaatatactactcctagtcctagttttagtgttgtctatacagagaccgttgccgtatcactctcgagatagaacagtagtactactatgcatcaagcatcatgccgctagcatctcctatgttcatagttgaaagaatcgcacaaccaacaccatgtacaaagaccttccattcatctactctacaaccaaacaagaaaccacaaccgccaccatgtgttcttcatctagttcttcatcctcgtcctctgatattcatcttctagcgaggacgaatggtacccatgtgtgatatcgaggccttgtcgataatttcaatcccgaacgaaaattggggcgtgacaccatacctaccttcccaaataaacaaaaccacaaaaggatagtgatctacttgctaaaattatattgaccaaatctctcatgttgcagcggcggcaatggcgaaaactgaggatgtgtgtgaattgtgatcaccctcgccatagatacatgtagaaggatagtaagccaagccgatgcaaaaatggcaagatatggtcagaaaaactcaaatagaaatggagaaggtagaaaaaaggctggcgatgataaagctaataatgtgtgagattgaggttggatgatggggatggcggaggtggtggcaacaatggtagtggcggtggatggacagaaaatgatgatggatgaagaattatttagggttgcacaagcaactatttatatgtaaaatattagtaagacgttaacccccaataaagcatgtgccacctgatttccatcagtgaccatggctactacagatacaaccattgctcacatcatggaagaacaagatgatatcaagatcaagtcctccaagtgctggaatcaaattcggccacctgctacactgctgaattcaaacggcccccgaatctgcgtacgacctccgttttcggcccgtgagtacttgatggaaagctctcggagtactctttccaacggatctggcctcatcgccaaattccatccaagccattcgcagattaagaaacgaggtgttgcgtcacctgtcatgggcctttgggtttgtaacttcgtttggaaccccggcccaagtggggcccatgtggggtgtgccccaatgtggtggagcacgaccttaggaccctcttggtcgttctcccacccctataagtagctaggtaccccttcagggttgcttgggttctgtttagatgaaagtttagccattgctactttcttgcagcgcgcgtgtcggctagaccgtccgtctgcttgtatccgaaaccccaacttatcgtgtgtattcattcctatttgcaattcagattgcttttatcttgttcttgcttgtttcttcgatttgcttgtaggaatagggttgatcagcaccggcaagatcaatacccacggagaggtgtatcgatcgcaaaggcgcaacacaacaacgtcttgtacggttgtagtcgggtcgtcaacgtttctcccaaatcgtagttatcatcaactcaccgaaaaatcgggccaacaacagccttgagtgtcgagtggaactcagggttaatcacctattcctgcaagcaaatcgaagaaacaagcaagaacaagataaaagcaatctgaattgcaaataggaatgaatacacacgataagttggggtttcgaatacaagcagacggacgatctagccgacacgcgcgctacaaggaagtagcaatggctaaactttcatctaaacaaaacccaagcaaccctgaaggggtacctagctacttataggggtgggagaatgaccaagagggtcatagggtcgtgctccaccagattgtggtgcaccccacatgggccccacttgggccagggtcccaaacgaagttacaaggccaaaggcccatgacaggtgacgcagaaccttgtttcttaatatgcggatggcttggatggaatttggcgatgaggctagatccgttggaaagaagactccgagagctttccatcaagtactcacgggccgaaaacggaggttgtacgcagattcggtggccgtttgaattcagtagtgtagcaggtggccgaatttgattccagcacttggttgacttgatcttgatatcatcttgttcttccatgatgtgagcaatggttgtatctttagtagccatggtcacttcaatagggttgatttgcactggcaagatcaataacccacggagaggtgtatcgatcgcaaaggcgcaacacaacaacgtcttgtacggttgtagtcaggtcgtcaacctttctttgaaatcgtagttatcatcaactcaccaaaagatcgggccaacaacagccttgagtgtcgagtggaactaagggttcatcacgatggtacggaacaaaaatcgagaaagtgtatgaaatacttttacctccaccttacatctgtttgaattaattgggtaattaatcaattgcaatcaattaaatcaattaaattccaaggctcattacgctagaatctgtgtattcatcttctcatgagttatcaaaggtaaatatgaagagtttttttagaattaatgcaataatttattaatggaatggtaaccaacgtcaatttgatatttcaattatatcaaattgatggttgtttcatggtggtgtagtgaaggatggttgctgactggttgatgcataagttactatctttctgttcatcttccatgagtcatttcctcttcatcttcctttctcctataaaagaagaatgaatttgatctcccgcgcaggagagaatacacactttcatcctatttcacttatgttgatgctatgattatcccatccaggcgagtgcatgcacatgtgctaggagagcaggcctttggaacccccgtttccttgatcttgcatcgagaggaagagaaaatcatgttttttggaaccgcactgcgttggtgcttgagtacaactatgtcaacagcttcctcttcatcacgtctagtggtgagactaggaacaggaatggcaatggcaacagcaggaacggcaacggttctcctctcgctattgtcacaaccactttgttccagcaccatatgttattctcctccttgtttctttctattgatcttgtttctatgcgcaaatgagttaaatatgcttgtttccatagtttacaaccatagcatgtctaattggaaaaatcctaactattgatagtaatccatttatgtcgtcgtaatttactccctagatttctagattaaatattatcgtaaattccttatatttccaacatatatgtagatggtgagccaagatgaggaggtgctgagttgcatgtttggttatcaaacggagaatggagatattaggtgaaaaggggcgctgataccaaagcaaatcatgtgctagatggatgtaactagatttggaggccaaggtgctggcgatgacggtggtggcagcagtgttggaggtgatcatagcagatgaagaaatacagggttaaaaccataatgcccatgaatagaaacatgtgctacaaaatttcaaacaataatcaaccatgatggtgacacaaaataatgtttgtccgcataacaaattttagcaaaataaccaatccatgcaaacaaaaaacccaatccacgcgttgcctaaatgtctattataaccaccaaataacaccaaaactccgataaacaaaggaaccaagtcattcatttgcaatctaaatagataacaaaaggagatattgagcaaacattgtcgtatcccgacttggttaaaaactttcaagttgcaaatttgatgccaaaccttctttgtgaaatcataatttctgaaaaggtgatcggtatcttcgaaagtgtccaagcacaaggagcatattcagttacatggccaatgcgtatgagcatggtccctgcagtaagcactctttgatgtagtacaagccagtgaaagaatcgatgtttccgctcggcctatgctttcacaacatagagtggttttcataagttgttcttattgatagaattgggaaaggtaagtgacctttgctaagtatgcttctatgaagtttttatgaaccatttatgcgttgaagggaccaatttgttttttgtgccgattaacataatttcttctcggttatctgtgaaatactcgtttgtgttaaaccgcctaaggttggtgacttatagaagagttatcccgtaatcaagtatttcattataatggacccaactctattggagtcagattctgagaagacctatcgaggatgcttgaaccatcattgaggtactttagaacaatgtgttctaagaaggaatggcgaatttgtatttattctaatcctttcggagtttttcatttctaaatatatgcatagcaatgttagttttgaaatttgttgtatcatacttgaattttgttactttagtataagttgaggaaagctagcccgaaagagtcattcatcgtttgcaatgagtcatctacaatctagccaaaaatattagatatgcaaataattctattgacccaaaatgttgcatacaccatcaatcatgttaaccaaaaaatgttagacacataaacaatgcagttaactaaaaatgtgacatacaccaataattctaataactaaatatgttagatactctaggtggtagacagaaaagcacaacaactagaattctatagatgtagaacttgatattgttggcaatgaagttggtagtcaaaaaggtgaaaacaaggggatgaaatggtgtcagcttcgccgcccgctctcacaaacagacgcctgatgagacaaaatggacataaatgttttggtgttgtgcaaaacatttcagtatttcctgattcttcatctcttatttctacaaacaaattgaaatgagtaggtcatatatagtagctgcatcgattgtgtgccatcatcctcccaacatacgacctctttgccatccaaatacaaaaaccatgaatggatatctagcaactaaacaaaaaactattgaccaaatctctccgatgtgacttcagcaacaacagcgatggtagcaacaataatggtatggtgaatacctaaggatgtatatgaattgtgatcaccctcgccttagatatatgtagaaggatagtaaggaaagccaatgcaaaaatagcaatatctggtcagaaaaactcaaattaaaattgagaagctagaaaaaaaaacgcagctgatgaggacacaactagcttggatataaccatgactaccttatgtattaatcaaccaaaggtggatatgttctatattaaatttacttgctatatatttgaacaaacgttgctacacaatgagtttggtgtgttttcgtttgcagaggtacttgcttgggcgaaagaaaagagaccgagcgtaagaaacgcatggatgatcaaagaagttgattggggaccaaaccaagaccttctccaagtccacttgtacctcatcacgtcactttttgtgcatataagacaagagataaacttctacatgttttggattcggattcgggcctcctgacagcatcaacttcaaacagacctagctgctgatctagaaggaatttcggggcccatgagtactttttggaaagcttgtggagcctactttcatgtggttttggtcccacgtcaaaattcctaccaagctgccgggaatctgcaaaacaagccacgtatctcattcggtccgaatctgattttgggttttgagccatgtaattgtgccgtgggcttagcccaagagagtgtgcgccctagggcaaccctaggacgtccctaatcacattaattcagtagccgtcatcgtttagaatcaggttttgcttagattaatctgtcaagatcagtttccccgctagatcggtttgtggaaccccaaattcgagtgcttaatcattcatatgcaattgtgttgcaatatatcttattctttcttgtgttcttcgattcgcatgcagggattagccttctcggcgaggtcaaccgggtttcggcacagttgataactagaggatccgtggtgctgcaattgcggggctcaatagcgtgttcattcagaagccggatcgagttgtgtcgtgactccgtccaaatcgattgtttatcaatacgataggggtgggagaacgacccctatcgtaagatcgggacctaacatcccttcatcagttggtatcatagcgcggttgcccgttaggtaatttatatttgcataactagaaaattgccacaaaaaaatatttattctttacctagacaatttgagccgttgcattgttctattagattttgctttgttgaattctagattgcatcatcgggtcgagtgttggtttagtcttagatttaatttttagttttgagtattgtatatgttcatcacttaggtgtagggttcatcactcaagtctgtgtgagttgtacttcagctttgggtccagttttgcatctcgtcggttgttaccaggaccttgaaaaattgaattgtctcatcgttgagtttccgtttttatacttttcagaagtttttatcggtcgagttgggagttgcgactagggattgctagtgcttcttccccttttgttgagctcacaccggctagattgatgcaatcgccacatcacgtcctttaaggtgtcatgaaccaaccaccggttgtaccgtccttagcattgctagtaagacacttgtaagagcttggtaaggtgctccatttggctgagttgttgagaggcatcactacaccgcgtagtagattattagggataaccttcactgtttgttattgtttttgtgtttgcaatgacaggtatgagtggtgcttaaaatcagcgataccaataaggcaacaataattgtgtgcccgatgatccttattctaaggttaagtttaaaataccgtctttttgggttattatgatgctaagaaatactttgatcggcagatgacagtagagcaaaagtttagtgcccaccttgtgcctgagcaacatagagttcgacaagccagtagtgggttcaaagagtttgcttatatttggtggtctaggttagatgttgggagagctttacctactacatggaaagaacttaaggtagctattcgtgatagatttgttcctccatgttattatagagatttaagcaagaaactgaatcgtttagaacaaggggataaatctgtacaggattactatggagagctacaaaagggattgatgcgatgtagcatagtggagggaactgaggattccatttgtagcttttacatgggattgaggcgcgagattcaggacatggtagaaaataaggaatttaacactgtcaaccagttgtttcagtttgctatgcttgcagagaaggaattgcaggggcgtgatcagcgcacgtacatgccgtggacaaagccatcttcggggctacccaagcccatctctttctgggcgaccccaccaacgagcaagtgaccagttgcgtccggagtttctatagcgccaaaaccaccttccccacgacctacagattcaggtgaaggttcttcgcaggtatccaccaagagtgcctcatctgccgctttgacgggacgcacgcccaggattcagtgtcaccgctgccatggatttggccatgtgcagaaggttttccctagtcaacgtgcatacattgctatggaagatggctacataagcacctccgacgttgaagatgatgaggaggaagagaagaaagacgaagagcaaaaagacctgtccatagatccgtgcatgcttgaggaatgtttaattactaagcgcctataatttctgaagatgagaagaaaggtaataataatggtgctacaactactaaagctatgcatagttatgatgtgctaactctatgcatagttatgatgtgctaactatatccactacttgtgctacattagagcaacctatagtggaaacaattgttgaaatacctttgtcacaaaacaatttgcttgatgtttcttgtgataaagaagagttgtgtgatgcttcacttatatccatgccacaactagtgaatgaacatgttagttctatagtagagccaccatgtgttgagtttaaacatgttattcacattgctagcgagaatgaagagcttaaattgttatcttctttaaatacttggggttatatttaatttgatgatctttgtccactcaactttttagagaagaaactatttgctagatttgaattgccatgctcttctgatgtgatttttcatgttattggcaattatgatagtaaaggagaatataatgtacatcaagtatatatttgtgagaatttgatgatacctccttttcatgatgagatgtgttgtctagaggaccacatgcgtataagtgattctctatctagttcctctagttgtttaaatgagttacaagttggtttgcaagaaggggagtgttgtggttttgcgactacaaagatttcaggagccaaccatatgaccatcaagaaatgttcctcaccagatgttatgatagataaagataagttcaatatgctccatgacaaggtgaaaccgaggacggtttccaatcaagaaggggaggatgatgaggacacaactagctcggatataaccatgactaccttatgtgtattaatcaaccaaaggtgcatatattctatattagatttacttgttatatatttgaacaaacgttgctacacaataagtttggtgtgttttcgtttgcagaggtacttgcttgggcgaaagaaaagagaccgagcgtaaggaatgcatggatgattaaagaagttgattggggaccaaaccaagaccttctccaagtccacttctacctcaccacgtcacttttggtccagagaagacgagataaagttctacatgttttgaaaacggattcgggcctcctgacagcatcaagttcaaacggacctagccgctgatctagaaggaatttaggggcccatgagtactttttggaaagcttatggagttaattttagatggttttggtcccacgtcaaaattcctaccaagctgctgggaatctgcaaaacaagccacgtatcttatttagtccgaatttgattttgggtttcgggccttgtaattgtgtcgtttagattcgggttttgcttagattaacactactagaaaaatcatttgttgctacgaaaaaaatcgtggcatcaatactaaaattgtggcaatagatgcatgttgccacaattttaaaatcgtttctagccgtggtaataaatagcgtcgtaataggttattgcaacgatttttattttgtggtaataaatttagatgttgccacggaatggatgtggcaaaaagtcatattgcaacacttcacgtcgttgtaataaaaattattgccaccactccatatgtggcattagttttatgtaccaaactaaaagttcaaatattaatctatcatcctatctattttatctatttattttttttgatattgtgtcttggctaggatacgaacccaagacctatccttcacgcaagctctcctttaccaactcacctacgcatcaattctgttgaaaatgcatatcgttccatttgagcctacgtaactgagatttgaatcatagatttgaatatctaaaagatttcaaatgaaaaggttatcacctataaaattgtagatctcgtcgagagctataatttccatataaaatttgtctcaatccgtgttcatatgaaaaaattaagttaaattatgagacaacaatttttttattgcaacgaatttgttgatcgcggcaacaaaaaatagtgaaaagtaccatgtactatgtaaattgccacaaaaattaaaattgtggcgatagaacatgttttttgcaacaatacgattttttgtggcgatatctcattttctattgcaacaaaactactaaataaaacaacgattgtagatcgttgcaataaaatataattatttaccacggaaaaactatcattgcaatagtacaatatattgctacgaattattttttgtagtaataatttggtggcaatagctcaattatcttgtagtgtaatctgtcaagaatagtttcgccgctagatcggtttgtagaaccccaaagtcgagtgcttaatcattcatatgcaattgtgttgcattctatcttggtcttgcttgtgttcttcgattcgcatgcaaggattagccttctcgacgaggtcaaccgggtttcggcatggttgataaccagaggagacgtggtgctgcgattgcggggctcagtagcgtgttcgttcagaagccggatcgagttgtgtcgcgactctgcccaaatcgattgtttatcaatacgacaataccgatcggaagatcgagacctaacatccctcatcagcagcgatgacaaagctaataatgtggagatcgatgtcgggcggtggggaatgcaaaggtggtggcaactgcaatagtggtggtggtgtgtgagaagacgatggtggaagaagaattaccttgggttgccaaacaaccatttattattatattgttggaaaaatcttaacgtccatcaaaacatgtgttgcacgatttaaatcggtgatgattattgggtatatgttagtcaagtcccttaaaaggaatagcacatgacatgggctggtcagcgattgtggcaacaatatgtcacaaaaatcgagaaagtgtatcaactacttttacctctaccctacatctatgtaaaggatgaggcaatatgaggtggcgttgagtagcaagtttggccaacaaagggagaatggagaagttaggcaaaaaggatgttgatacccaagggaagttttcatcagctattgacataagcgctttttgcttagtagcttctatgaagtttttaggaaattgttactaaaccacctgaggttgattaattatagaagagttatcccctaatcaagtatttcatggaaatggacctaactctaatggagtcaaagattctgaaatgacctatcaagtatacttggatcatcattgaggtactttagaacaatctggtttcagaaggaacagtaaattcatttgaatccttttgaagtatgtcatttcttggtatgtgcatagcaatattagttttgaaattttttgcatcatacttgagttttgttacttataatttgtcttcagtctaagttgaggaatgctggcccgaaagaatcgttcattgtcaacaattagtcatctacaagctatccaaaaatataaaaaaagaaaataatcctattaactaaaagtgttggatacaccaacaatcctgttagcaaaaaaatgttagatacacaaacaatccagttaactaaaaatgttaaatacacaatagttctgataactaaaaatgataggtgcaccaggtggtaggaagaaaagttcaacaatatgaactggaattctatagaagtagcacttgacattgttggcaatgatgctgacggtcaaaaagggggaaaaatgggagggaatggtgtcaacttcaccacccactcacaaacaatcacccataaaattgtgaaaaaagaatgggcatatgtgttttagtattgtgtgaaacgttttagcattgaggcacaattggttccgagcttgttcatcaccacatttcctactcttggatgttatcctcctagttgggtagatatcactcgcaagcatctggtggacagcccaggaagtattttgaggttcaactccgcctccataagaaaaaggggtaaattgagtgagaaccaagcccagtctttgtgattgcttggtgctgtttagggttgaatgcaacctatcttgtaggagcctctcaatggagacataggatcgttggatccaaacttcaataagaaaattggttttctatctatcattattgggcttgtgttactactccctttgtaccttataaggaagagcacgtcacaggcttgcggcggaggcggctacaatgacagtgatgatatgtcaaaaataacaagaaagtgtatgaaccgcttttacctcaatcttacatctatgtagaaggtgaggcaagaggaagtggtgctgattggcaagtttagttatcaacgggagaatggagaagtttggcaaaacgggtgttgataccagagtaaacaatgtggtagataaatgtaacgtgattaagaggccaatgtggcggcgatggtggtggagggcatcagccatataggagatgatggcggatgaaaaaatatctagggttatacaatagcaaaatcataatgctcatcaatagaaacatgagctaccaatttaaaacaatgaccatgatggtgagatacaatattatattcttgtcaagtacgaatgccacattaaatgggcctaatcccattgggccagtacgcttagggctaaccttgcgaccataactcaaggagcaaaataggctagtcctaacaaagtgggaagcaaattgctgagttgctgagtcgttacttgtatatgtcaaccaaccaataattctgtgtatttctactgctcacctagatcttgtgtattagctggtaggtgtcacctagttgtccatgtgcaccatgtgtttgactgtcaagtgcatggtgcacttggatgaatggctatggtagcatgtctactattcgaacatttttataaagtttcaatctaacttaccttctaacttcttatagacattaggtttctcgtctacaagactacatgaattaggcatactgcaacaacaactaccaatttgaataggatctcattttcctttttnnnnnnnnnnnnnnnnnnnnnnnntttctctaatccttaccgacaagaaattccatatctagtttcctacagataaaaattgcatagttcccaaccggtcagaagagtgatgtgttaacacattatctatcataatgttgttgcctaaatgttcaagaaatcctgaaccaaataaacatgatgctcacatcacagtgaacgatagtgccaggagaccttaaagcatcaatccacataacaagcaaaacaacaaatccatgcaaacaaaatacccaatccacacattacctaaatgcctctttcaaccaccaaataatactaaaactcagataaacgaagcaaccaagttgtttgcaatctagatagatcagacaaagatattgaaagaaaattattgtttttatgattagaatgaaacaacaccatcttaataggatgggcgcacatcccatccgctcggccgcctcctctttgagagcatccctctatgatgagtatatggttccatttcatgtctcatagcaactgaaggccttgcttgctcaacatatgaccatccattactcatcttatgattcgtagcagatggaggattagattgctcaacagctgacactccattgtccaattcatcatcctcggattcactctcaataagccatccatagcatgggcgccttgttgaggcagtatgtctagctgcagtgatagggagtggcactgaagttgtagaatcgggcatctcatcggccactgctgctacaactttggctggctcagatgcagcagctggcacttcagcttgtgaggtttgcacgccattctctggaagcggctccattgcagtagttcctccttcatgctgcttaaacaagggaagcccaatggaaaattatgacttgtttggcaaccaactgaactaaacatgttatgataggaaataacttacaatatcatgagattagagagtagaaacaacatgagaggtctaaaaggaaagaatacatcaaggaggtttgaaggctaacgtgcactgatctatgtcctattaactaaaaatgttggatacactaacaatcctattaaccaaaaatgttagataaacaaacaatccggttaactaaaaatgttagatacaccaataattttgataactaaaaatgtaaggtacaccaggttataggaagaaaagcacaacaatatgaactggaattctatagaagtagcacttgatattattggcaatgaagctgacggtcaaaaaggtaaaaaaaaaaaaaggggggaatggtgtcagctttgccgtcaactctcacaaacaatcacccacaaaattgagacaataatgggcacagatgttttagcgttgtgtgaaatgtttcagcattttctgattcttgatctcttatgtggagattatgggtgccatatacccacacggctgggttaaccgactggatatatgggagagattatgtttatggaatatgtaacacatcatgacttgggtattatgtttccttgtatataaaggaacggtctaaagtcctggttcagtaatattgtacagtagattaagtaaaccgatgccatatttggctatgtaacctccccccaccctccccaaacctatataaggtgggcagggagcccctcaagggcataaccactattagatcgtcagaataatacacactcgacggatacaatccccaaacaggagtagggtattacttatcatcgagagagcatgaaactttctaaatccttgtctccgcatccatccacttttaggtctcatgcactaccccttttattattgccgattttcagattcgatagttggcgcgccaggtaggggtcgcgtcgagagttttccgtcaacgagtgtgatcggggtagctagcagatcttgcattccaagggctatcaacacctaccaaggacaaattcttttgccacgagttcaacagcctagctcatttgatgcaaacagtatcagctcatgaaagttgattgtgatatacagaagacgatcaattttggagtcatcaaaatcagaaagaagataattttgaagcatgagttctcatactccaaaattggggggcatgtgttaacagtgaaatttggtaagccccaaagtcatcatcggcctagagtcagtatcggcttcagagtatttgaatcggcttataggaattatcaagtcgccaatagtcggattcttagtagattcggttaaggaaattaatctactgaagaaagcttatccagaagtgaccgagttcaaggaggatgcggtatggcagtttaactattaattaggaatagtttgttagtgtccttttatctttaggaaagtgtgtttagtgtccgataaggactttatgttttccttttatctttagaaaagattctttcttgtccaagaaggactagtatctacctataggtataaatatgtacacccagggttattgtaaactatctctcgatcaatacaacttcggtgcatcgccaccttttacatttctactttttcgacgaattcttacttcgatttagggtatcagcttagatcttctgacaagaggtatgacttgtctcagcggtttgcattggcagattagggcgtcgttttagacgttctaatctatcttctacaaccgctagttatcatatatcttagttaaatctagtttagcatcttaatttgctcatatcggctgagattcgttttagggtttatgcaggtatcgactaaattatcttgctagattagattaactaaggtatccaccacccagtggcggagcaagaaaatctacacgcgtagggctgaactaatgagagttcaaatatttttagaaattacatggtatttttcaaaattataatggggatcatgaagccaggcatggggctcaagccctagctgccccatgcctgtatccgcccctgccaccacccagaaaatcagtcaaaggcttgattgcctagatatttttgtttcttttcatactttgcgctgcaactgccctagtcgtgtttagaaccataatctcttgcctgctttttgattgccaataagggtttcattggggtttcagccgatgagtaatctggacgttgcatcggcttacaaggattacatacaagtaggatttagccgatcacaacaaaggttttactatttatctagtcgtttggatttaatgacatcggacctccagctgatgcatgttttaaccttcgaatcaacactttaccattagtagccgattggattatattattgttacattacattatcatcagccgattatctttatatcattatttacatcaagtgtcagattctacatcaaacatatagccgatagctcaaaaccctatcgacatcagctggtatgggcatcggctggaactagtccaccggcttgtcagctgatcagctctttggtgatcttcaatttatatatcttgtcagttgtaggatcaaactgactagcacacccacatctcatcaagttttggtcatgcactggagttaagcagatctcccaggtcgttgtgtttgtcgacttagttcgcgccaacacagttccagcaccatcgacgagcgcagatctttcgttagtagtattactcgaataaatcaaaagcatagagataaaatcatttattttctgctattgataattgttgaagtacccaattagcacatattttgatctataaagctctgttccatgaatgacgaattcatgttactcctatgcatgtttgggaattgccttgagccgactcccggtgcttgggggctatgactagttgggcatagtgtttaaacataggaagtcaactactcaaggaaactaaaattgatacgaggagaaatacatatttataaatattgcaaaatgcttgaattttcctcgagtattatattaacatcaaagactactcatcctacatgtttatactataggatccaaatccagatatgcatagtagggattcatgtctataagcttatctcttatgcttcaggaatgcatcagtcagaacaccaccgtcagtcgccttcgccgccgccgactgatgtcctcaccttcacggctggcctattatgccgccgctaatgggtgtattcgccttcaccaccggcttgcctttgccttcacctccacggctgtgcgattatgccaccgctgatggtcgtcttcgtcttcaccgccagcttgccttcatcaccgtcgactggtgccttcgcccccacggttgtgagattatgccactgctgatgggcatctttgtcttcaccgcagccggctagtgcctttgcctttaccgctggcctattatgctgtcattgatgggtgaccatgttttcaccaccagcttgtttacgccgccaccgactggtgctctcacttccacgggtgagcgccttcgccatcattattagacaacttcatcttcacatattgttgcttctgttgcagccgatcatcttcatcaccagcaattccgatcgcctctacttcaccagctttgctacttcactcagcatgcgccaccaaatatgacgtcgtgctaatctactacaagtggtgctccaatcctcaagatttctactcgaacatcctcaacgcatatctttactcaagtgatggttactcgacaataagaagctatagtttcttgactctatgttcagttgttcccaactaagtatagagtcgggggctgcacaaacacgtctaaatctcgacaaacgttatgtcaagatgaagtaatcaattaaccagccaacgagtcaactttgggagtcattatcttcatcttcattctagagcaagcgttctacttcaacaactctgacattctcatcggcaacattggatctcagctacttccacggtttactccgagtttcacaaatatcaagttcaagatttaatttacatgtcctggttagattcaactctgccctctggagtacaactcgtatatgactttgagcttaacaagtttgggcctatggagtttggagttatcaaccaatctacttagattcggcaagttggacagcagcatcaacatctactttcctccaagtgaagcatctccaatagctacaataccaagttctaatgtcatcttcataatcaagaggtgttgcatcaatcttcgtcacgcacacatcaacgtcaagaaaactgctcgagcatggatatattctcgacattttgatggattattatcattgacgtcaccatcgacaccttcgtcatcggcattatcttcatcttcggtcaactactatccatcaggttctttacttcaggaagctggacttcatcaacgttaaaatctgactagatcactaacattgtcatcttcatcaacatcctgctatgccactttgacctagcctattctgctgctgttgatgggcaacttcgtcttcacagctaaccatctctgttgccaccagtcgtcattactgttggttgcgtataccatcgctgactggtttctccgtctccacggttggtggatttcatcatcatcattgatgggcaacttcgtctccaccaccaacatctccgtcacttctgatgggcgatatcatcttcacgttggtgatctcgcctccatgacaactacatcagctgccgccaatggactatttcaactacaacagaaggacaagcctacttcataccttcaatcacaagcacaaggattttaggggtttaccagctcaagcacaaggatcataccttcaatttggacttgttttggatatatgtgacatgaattcatggccatgtgcctacttcctacgctcaaagattggaccaatcattattccctacgagggccatcggttgagtacttgctccagtccggatttgattatcgcatctactttgggcgctctggtgagatgcacttcatctacattacccagaaaatctatcactcaagagcttattaataggtatgctatacatgtcatatagcaagggcattgatgggcatatttcggggctaatcccaatatgtatgcaacccatattctaggtgtggtctatcgcatgtccctatggacttaagcatatttgtttttggcaatatgtgcgagttcaagtgacttattaccttaaaatccttttattcagctgttacacaacttgttaggggttgatacagcagttgttatacaacttgttaggggttggtacagagtacaatttaaacagtggcaagcactaaatctttatatatatagctactctgttaactttttataagttagagacattgtttgggtttcatgaagcaattgattttatattatatcattgcttttcgtcacatgcgtgcattttttgatacaaccaatatcatggtttaggttgaatatatattggtcatttttaggcggttggtgaatccatttatgagtgttattttactcagattttacaccacatatgcaatatattttcaagtgtggtggtgttgtgtgtcttataggaacttagcatatttgtcttggcgatatacgcactgtgtgaacccaataccttacaaaattcctttattcgttgcataaaggctttttattaaagtcatttactatgcaatttttaaagatgtagttagcttatagctatgcgcattatactttttagtaagcagtctgtatattgctcggattatcatagcctcctagacatttcccatctctcttattcttggatctaaagcttctagtgtatcaagtgggcagggattagacagatttttgggattgagtgcaagttaaaagtagggatttatcatgggggcatgatcagcaccgagcttgttccttagcgcatttcttactcttcgaggttatcctcctagtcaactagatgtcactcgcaagcatctggtgattgtggacagcctgggaagtttttgaaggttctactccacctccataagtaaaaggggtaaactgagtaagaaccaatttaattggtgggttttagggttgaatgcaactcagcttgtaggagcctctcgatggagacaggatcgttggatccgaactttggtaaaaagaattggttctctctctctaccgttattgtgtttgggttactattctcttcgtgaggttgcattgtgatagcttgtgcaatgtttacctatcaatttacatagcatattgttgtatctaccttgtgcaaatcatgcttattgtgatttccccttcgtgggctatattcttgctaactagaactttcagtaatttgacgagaactttcggaccgagactagaagttctagacctatattgatctattgcgaataaattcaggataggtgaaatcaaggtctttccatggcacaccagctatacaagcgtgatgttgagaacatacagccacgctgtgccacttaggatcctgaacctacgtgacatcgttctcaaccatagcttttcatctagactcagggtgtgttcgtaacttggggttagtaacctgtatcctctcacggaagacggagcaatccattagcgtgtgattaattatgtattagctatttttttcaaaaatgaattaatttgatttttaagaaacttttgtatagaaactttttgcaaaaaaaaacaccgtttaatagtttgaaaaacgtgcacgcggagaacgtgggacaggagttgggaacccagagcaccgaacaagcctcagtgagttctcccagttgttgaatagtcaagaaatatattagactcttgacattgctagtgatcgccgaacttatagaagaagagcatcatgccaagaccatcaatgcagaccctagagacgtccccaaacttggcagtcctacaaaagctaccaagcttggagaaggcatcacgacacccatcgtgtggcttgttgttccattgttgaggaaccaagcatgatcaaatggatccccccttccccgcaaaaaaaaaaggatccccttccctgctgagggatacttgcacgttgatcattcaaatgaaccaggcatgtgccaccatatctcattctatccttctagtgcgaggatacatgactatatcattaggagcatgcatatgcatgcctcgatgttggcttgtagttgacttgtctgtagtaggttacctagtacaatatggccatgcagcagtcctaggcccaatggtctagtttgccaaaatagtgacactttacttggacgcgtcaaggcctacaatctagattggcctaactcacacccatatagatattaaaaacccaactgttatgatctacttcagatataggtcccgttctttctccaacaagagctagatgaagattaagattttcatggcacgcttttcaaactgctaaatggtgtgtttcgtgtaaaaattttctatataaaagttgctccaaaatatcatattaatctacttttcaagtttgtaatgattaaaactcaatcaatcatacattaatatcacatcgttttgcgtaaaaaaacgtcatcttcatctttagaaaaaaagaacaccaccatatacgcccccaaaaccctagatcccacactcacattgttgatagagtcctctcctccgccgcttccctccatccagatccatgcgctgcctcgtcgcctccagcctacaggacctccaggccgacaccagatcgacagtcgataccgatggccgacgccttcgtgtgaagggatccaagccacgccgcatgtctctaggagacaaggcaaccaggccgcacgcccaaggtctagctccactactgcggactcatcaccaaccagcagtcagctagtagttgatttgtatgctaccagagttagttatctacgttaacttcttggctttctctttgaaggaaacatcttgctgctctgtagcaggctaacagcacggaaggttgacttgttttcaagcactgaagttacactctgtttgcttgtgcctattcttttgggtcaattttgtgttcaatcagccgatttaatgatgatttcactgctaattgcatactcaatacattaataataggctaattgtcacctgggttggggattgttcctggcttgcactttatattttgatagtgttgtcgggtgtaaagacccatgggtgacccatacccgctgcagggacggacgggaaaacctacaacaacgtggggatggagatgggaacggatgattccctttacctcagggtgggaatggggtgatgaaaccgacaggtgcagagctgttgtcattcctaactagggctgagcgcctgagcctcgtggttccctttgctgtggcaccgtggtgtacacattcatcgtgttgcctcactgaagcatctaggcccccggtgttaattttggtaattaatgataagtgctaattgtggactaaccgttgtctttgagctatacattttaagttaggtccacgtcatatgtgtgcatggatgattatcgatggattaaaattgacgacgcaaagcaaagggaaagaagacggtaaaactagcgctttaatttagaattgatcgaggtgtagggcgatcaaatttgctagtttatttttagtttcgccgtactattaagaagggtaatgacctagcaaagagatgattataattgccacattaggtcattgcattttcatttgtgctctttttttcatcacgcacacattcacttgcaaattcactgggttcggcctgaccaggggcggtcagaccggccacatagtggcggtctgaccggcgtgccctggccggtctgaccggccgcaagaaggcggtctgaccggagcataaggccggtctgaccggtggcatttgcgcggtcagaccggccccctggaggccgagatggtgctgctcaggatggccgatacagagccgacggagccgtattcggtcagaccgagccgatggcggtctgaccgagccgaggccggtctgaccggccaccccatgccggtctgactggccaggccaatggggccctctgacagggctacaacggctagttgagtagcacggtctgaccggccacatacctccggtcagaccggcagagcacagagttgggggatttcgcccccaacggctagttttggtgggtgggagtataaatactcccccaccagcagcaagggggctctcttggcacccaattcaattgcatacactccttgcacctctctcacactcacttgagctttatgttcatccatctagtgtgttagagggttgtttagccaagagtcaagtgcatttgcttccattgtagagctagtgtggcacttgatcatctccacaccgggtcattgcttgttactcttggaggttgccgcctcctagacggcttgtggaggagttgcccggtgacctctccgagaagattgtggaggaggcccagtgccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggcttgcctcaacggggagtaagaaaccggcgagtttccgaacctcggtgaaaaatctcttgtctcattgtctcatttgattgtcgcatttacatttgtgcaatttactttcctagagatataattgagccactatcaccctaggtttgcaaaacataacttagttgcttagttagagttcaccctcaccaagcctagcaacttaggttagatttgattaggtgttatttattctttaaatcgcctattcaccccccccccccccctctagtcgacatctcgatcctacactcacttcggtgcgtcaacatctctctccactagtccacctctcctcgagccgtggaggtcccgggaggccatttgagaacccggctatgtctcccttcccgcccgtcaaccatcaggccatcacggcgtttgtcgttggccgccaacccctcggccaccgttcgccccttttcctggcttcctatagggctcatctagctgatttgtcggtggaagccggtcgcgtctctctcgcttcacgattgtgagctactccctccgttttatattataagactttctaccattgttcgtattcatatagatgttaatgaatctagatacatatatatgtctaaagtcattaacatatatatgaatatgggcaatgatataaagtcttataatatgaaatggaggaagtacaattgacttgtctgtccatggaaaactaggtggggtactggggtttaatagctttctggtttttttttcctggccaattatttgatcactctaatcactccaaattagcgtatgcatctggcattttaacattttaatactgctgaaaatataagtccatatgtgcaaacccgaattaatggtagtaaaatgttactatactatcttcgtgcaatttatattacgttcatgattcattttcattgatgaacagatataaagagtctatcttcttgagatgttcacttgtattgcaaaacatgctcaacaatattgacaaaataaccctaaacggagagcataacaaagtttgatttgtgacttctatttgttttgcactttgctacatttgtatcttttttatatatataaatttgtactcatatctatatatgggatttacggtgtccgaaaattttggtatgtgatgttactatatgaacttttgaagtgagactacctaatgaaaaatttcttgctacattactagttgcgtcactcactactgcaacttaaacacttgctccgcacaacaaacaccgaagcagataaaaatggaactgagaaactatgagcgcaggaagaaagaaaagaaaacctttgcatcttcctcctgctgctcttgctgatttgcctgtttttcgagtagtctgtcgaccacaatgcggtaggagccttcctctaggaagacccacccattcctcccatacagctgaaattaagttcaattagcaaccttctaaggacacgaagataacctagaaaaacatcaagacagattaccgtgtccgcgaggagttcattgatggtctgacggattatgggcctcggaaagccatactctgataggtggtcaatggcagcatcgatccgccgttgtcctctccccggccgcaccatctgatctgcttccttctccttcacccaccttccacaaacaaagagagcaagatgacagcgacttatctagctatgtctagctggcgacttatttgttaaaaaaaaaactatacaccaaatctccttgatgtggtggtggtggcaacggtgacgatggcagcaacaacgatatggtgaagaaatcaaggacctattgatcgtgatcaacctcgcaagtagagcgcagagaagctagacaaaagaaaaaaattgtgatgacaatccagagatggaggtcaaatggcggcggcggcggcggcggggggaaggggggacaagataatggtgggtctagggttgcacaaacaagtatttgttacttgtaagacctcaatacccatcagatatgccgcacgattcagaccaacggtcatgatcgtgtctatttttgtcaagacacaaatatgggccaatatgcttagggcaagcctaggatttcaaaccaaagagcaaattagattagccctataccattttcttcttcttaatatatttgtgggccctcaaatgcaaaagtaaacctaaatgtcaccctgagtttaatatcccccgcaaataccccctcctaatttattttggtttaggattcctcttagttatcgttactcactcattctcattacccattctcatgacagcaaactccatttcacgatcgtgaagaaataacatgtgaataatggtaattgctaattggggaggaatatcaaaccaaggtgaattagaaggtgtttaaaacaaatcatattatagaggaaatctcaagctcaaggtgacgtttatggtgaattttacaaattttccctaccatctaagattgcatcatctatctaagaacatatcatcatagtagtcatgtgtgaccattatgattaaccggcctatactgcttataagtagagatgaaaacagattggatattaaaattttggaggatttggataagtagttgagtggctgattcagatatgaatatggttttttctttggaaaagaaagccgacatatgtggattataaataaatagaatactaaccaagcctattactctctccgtgctaaaaaaaagccaacctagtacaacgaatctggacagctagcccattactcccacatagtacaacgaatatggatagccctttgtccagattcgttgtactaggttggcttttttgggacggagagagtacctcactagggccatctctctacctgccttagagtcttagacccaaacactcctaggccgagagagcagctataactctgctcgtcgttgggctaggccaagtttgagactgccgctgtagaataagagacctgcggccatccgccatcttatgttgtgttctaaaggaattcctcattttgctcttagtaattctctacgggaacagacgcataaactgtttataattatctactccctccgataagtggtgaaggtcattttgctcttagtaattctctacggggacggacgcataaactgtttataattatctactccctccgataaatggtgaagggttatagttggatgagcagttaagatagatgaaaaaagatgaatgatagagaattgtaattagttaaggagaaaatattggtagataagttattatattttgggacaaattctagggctaaaagttattatattttaggagggttgttattatattttaggacggagggagtaccagccaagaaaatgtgtaattgtgatgatcgtatatattcaccgcaaggaccgaatggaaatttctaaagcaagtgaagactgaagacgcagtatgctcacaccggtgaagccaacaaagtagccaaagtttgcttcatttggtgcagatcaagactgctaaatcatgcatcacccacaaaataaaagatgctaccagaagacataaagtagcaatccatatgataacttataaagcaaaataaaagatccgagcaaacaaaatacccaatccacgcgcattgcctaaatgcctagttcaactaccaataaaactaaaactccaataaaccaagtaaccaagtcgttttcaattctagatagataagataactgagatatggatcaaaaattgctgtcgtcgttatgcttaggaggaaacgacgccgtcattcagcgacagagaagcaagctgctgttcaggcgtcgcgttcgtctggatctgctgggccgtgcgaaggacctccatggcttcagcaaccttggccttgagagcctctggagactcgagcaggtgcagcacctcagtctggtccatctccagcagcatgccagtcaccttcgcagcctgctcatgctccagctgatcaacaagaggatacaagttctcaccaagcatctgcaacaatcaatgaacaaatgggtcacgcttcaagacgaacacgttcacgctatgcataagaaacagagaaaggcatgaggtcccaaaccattctttgctgatcaggggctgcgttggccagtgcagtagccaatgctccaataggtacaggctgtgacgcagcagcatctctcatgggcatgcctcccatctcatatggagatggcatcacaccacccccaacaccatgcattgcaggatcaggcatgccacgtcctgtaggataccgatagccacggccgcccctagccatcatctgcagcattaactatatttcagcaggcactcgatacacaagggaattgtcaaattaacactacaggaatgcttacggaaaattattatatgttcagcatacacgcacaaatatgtcatacctgttgctgacccattggcatgggttgctgcattccaccagcaccagcacgcctaccagccggacgctgcggctgttgtccttgctgaaccataggcatgataaagttcggcattggacctgcacctggcctcatcccaggcataagaggctgctggaagccgaaaccaggctataataaaaaaaggtaaaattgtcaagccagcaaatcatataaacaatcttaagtatccacccagtccatcataacaagacaaaaaaaaactattggactattcctatgaaacaaatgtaaattgcacttgaccatctaacagtgtcaaattttggacgggttatatattactacagttttgtgtctcctcggcaaacaggaatagcaagcaacatagagctctagatgcatgattaaacaactgaatgctcacaacttagtgttgcatgtcttatcaaccaaaagaagtgtagtgttaatgaccatcttgtgttgcaaaaccaaatgaggaaaatgatcaatgttgcaaagttaaaaatacagcgccagtataacattcataaatgcaacacagaataagaagacatcaatttgctagataaaattatttgccacttactacatataagcaagctttatactttcaggttggatgtagtattttcttaagaccaatatatgagacataatcagaaaacagtaagacatatgtctaagttcaatcaatatcatttaaccacttaatctaaatgcacaaaggaaacaacactagcattcgatcacctcataattatcataaaagcctttaggacatgattgtttgctatattcttacaggaataatctttataaataggactggaaattaaacagtggcattaaacgttacatcatgatcttgcatttgtcagcaagaacttattactatgcaaccgccaaatagtcaaagcaaatggtcacaagcgaaagcagtaagaagataccactaaaacttatgaaagaaagaaattgtgcacactaacacacaacaccaaaaaaaagggggattattatggaaagagaagatgtcaaaagaacacatcaataagaaaattaagccttatttacctgtgtgttgataaacgctggagggggctgaccatagaacagttgctgtccaactccaggaacaccaggtggaaacatgggcatgcgaggaccaactgaaggagcaagtgggacaggcctcagttgtgaaaattgtgcctgcaaaagtaaggaatagccaccaacatcatactacagaaagtaataataagcattataatgaaaaacatgcaagttatgtgagccaagaaaattcaatctaatgacagcttgtttattggtatgccagaattctattcaaaatgcgagacatcacagaatattagctaccgcactcttctatgcataaataacacccgcactcacattgtgacgtgcaaaaagtacacacaatgctactctcaaaactggccaattgaggaacctcatggtcctcataaaaacaaagaacaaggtcatcgatcatttcttacctgcagccttgctttcctgtcttccttgcgctgtgcaagcgcaacgtagagcggtttgctgccaaccatcttgctgttcatttcggcaagctgtagggagacattaaagcaagacattattatctgtgaaacatagcaacctaaatatcatgcatacacatccagcttacagctcgggaagcatcttcagcagatttaaacgcaacaaatccagaacctctgctgacaccatttgaatcccgcatcacctatggcacagtttctattattagcaccagaaattgataagcattgaaacacatgcataggcagacaagtaaacaaaccttgcaggaagtaatagtgccatactcagcaaaaagctccctcaacttatcatcatcaacactatcatccaagttcttcaggtacaggttagtgttttgatacttatctgctgcttcttgaaggttcttctcaaatttctctttcaattccatctctctttccgatttcttttgtgcccttccaacataccattccttatcatcaaacttcttgccattcagctcttggacagcctgagcagcatcatctggactttcaaagttaacaaatccaaaacacttggatcttccatctccctcacgcattacaacagcgctagtgatggttccaaattttccaaagatttccttcaagtcatcttcagtagtattctcagacaggttctttacatagacattattgaacttgacctggcctggagaattatccctctcctgcttacgaatgaaaggcccaacatacacctttttgtcattcataagcatgccattgagtttatcaatagcagcttgagctgcctcatcccgctcatactgaacaaagccatagcccttcgattctccagaagcatctgttgcaactttacatgaaagaatgtttccaaacacacagaaagtatcatacaaagctttgttgtctatcgacttatcaaggttctgaaaaaagagaagtcaggatgtcaaactacaaaaaaaaaagatgaaaaaatagctttcaagagtgggcacagataccttgataaaaatatttgctgtgccactcttgcgcaagctggggtcacggttagaatacatgatcctgataggttttccattgataggagtgaagttgagcatttccaacgctcgtgcagctgcaagatagatataacgtatttagtatgaaaggactaatacaaaagtcaagcaacaaataaaaccattgtagatgcatgtggatattctgtaagaaaaggaaatagacaactatcatagccagtagtaaataaatatatgttgttaggcaaagaattttaaaatgtgcaagtttcccaaaggcagcacaacttagaaattattgcatattagtcatggcatctcaaatgttttaaaattttaggtgacataacagattcacgtgcatctctgcagatgagagcatttactagaacaggagatattacaccaaaataagcaaaagcccaaaatctccaatacaaacgttataaaaataataactttactcaatttaaggaggattcatatcaaaatttatcgtgcctgccatctagacagaaatgtgatgctcaataggggtgtttatgtaccatcttaaatgatttgcattatcttccaacataacagattaatggacattaccgaacatgatgtagaattacaaatatgaaaataagaaccactgaaatgtatttatattgggggaaggcaatgatttgtgctaaaccatagttatttctgcaatggaatagctcgctgaggatcaggaccctaaccacgtcagaaaaaagaagggcagccttcctatcttttttaaaagaaatatgcatgctttaacactgccgcagcgacatcaattctaatggcattctaatccgacggtagcaaacctaatccgacgagaccaaaccctaaaatccgacgagaccaaaccctaaacgtgtgaaaagaaaaaaaaagagtaccaaaccctaatcgtcttgggaaaaggaaaaaaaagcaatccacctaaacctagatgctagattcgtgggaaaagaacagcaatcgagcagggcgaggcggatcggggaggtaccatcggcggggctgctgtagttgacgtaggcgtagccgagcgacctccgcgtgttgacgtccctgcagacgcgcacggagacgacgccgccgacctgcgcgaagacgtcgaagagctgcgcgtcctgcacgctgacgtcgagatccccgacgtagagcgaggtcgccgggaaggaggcggccgccgccgcagcggcctcgatgttttaggccggggacccgccctcggacgcggagctcgccgcctgctgcgcttgcgcctgcgccgccgccgccgccatctccgatttgggttttttttgtttttgcggatttttttggggggtaaattttttcggtttagggtttgataagggttgggagagagatttgcctcccaactgcaactgcaactgcggcgcggcaacgagggagggaggcagcgaggcccggggagccccggtatttgtacccccgcccccaaaacccttatcggatcctcaccctccgtccgcctccgccctccatccgacgactcctatcgggacacatgggccgtgcacgtgtccgcgtagtcgaaggatccgtgacgtggtcggcgcttccacttcggtggatggattccagctggttccgtccggactcggacctatcacctagaggtattccttattccaaattccaacccaaaacggtagagcaaaaacaaccactaatagtactacttaaaaaaggtttccaaattaaattttgtgtcatatctctatctctactattataaaaattaaagatgtttttgccggtattttgatatgtcatccgtgtatgggtcggtttttaagttcgtttgcttttggaaatacatatccgtggtatttgagtcgatttttaagatcgtttacttttggtaatacggaaggaaacatataagaatctttttttaaaaaactcgcatgctaacttgagacaatcggactcctaactgtagctcatgattttctaaaaatatatatatccaagcgaactcccacggtgaattttatcttaactaaaccatataacaataataagattaaaatagacttcacctgttacaacgcacgggcattttttctagttatttttctttgtaagaaacacagcgcaagcgtatggattcaccgcgcgcttacactcgttatccgtgtgcacgtttttcaaacaactaaacgatacatttttattaattttctatacgaaagttgtttcaaaaaatcatattaatctattttttaaaaaaggaattagctaatatttaattaatcatgtgttaatgcatatatatagttttctgtggcgctcccgaatacagcctcacatagtaagtcgtctaccacttaatgaaagaataattagccaaaaatataaacactcgtgtcaagtctatctagaacttgaacctaagtggatcggttctaccacaaggaacctaactagttgaattatacctacttatataaatttgtgtaacattttaatcatgtcacttaaccacaaatagagtgggtagactaaaacggaccaatgtacgagcaaatttattatattttctttctatcgagctatcatgtttaggcaacactattagcgtgaaactagataaaaatatgttagagttagtccgactaaaaatgccacataaacttataatatgttgttggttattcgcaatcttaatggattgtctttaccaatattgttatattgaaaattttcaatttgatttgttaccatttgttgttcgagccttacaaggagctcttaaatgcattgtcttatgttacttcgttgatatcgtcataaaagattattgatttggattgaacaatatcacttgtatggcccagttgaaattaaaataaatatgaaaacaacaaaagtatgacaaacatactaaattataagcatagctagatactattaaaacatgttttattagtatgaagtgccatatcacatcatcgctacatgacaaatccattagctagcttagccgtaatgtttttcaccttggttatataattatttttccaccactataaacaaattattatgaaaagggtaacatccaattttaaacaactctccctccatccacttttgagaattgcaatagacatcaactattgcacctgcctattcgatcgacttcatcttcaacatcttactcttggaaatagggttcctccgtaaattagctccttggtaactatgattacgattatagtcttattgactacaaatctagaaccagcataagcactatgctatgatggcacggtttcggaagaggatggtggcatcaagctgtcgagtggatgacaaaggatcttgccgtagcatggacatggttggatgccaaatgtatggtattattgtttaggggataaaatggattatcacaaaagtcaagggattggggtaaattgcacatgattaccagacaattataaatgtactgttatgaatgtatttggatgtaccgtgtatgtggagttaaactgtgttatagtggttaagagtgactgggattgcatgtcagttttagaaactaatgtaaaccctcaaaaaaatacttggaagattttacaaccttttattttataaaagggtggtctttgcttcacatgctgacaaacttataatctcgtccaacttcattgtttcctagtggaacttcagcaaaataaatcaaaagagtaaaaaactacacaattaccatggttgttactattaaaagtatgaaacacatattaaacatacaagtcatttacaaccagtactattaaaacatattttattagtatgaggtgtcatatcacaccatcactatgtgacaaacctaataacttagtcaatgattttcaccctggttcaagaattattttttcaccactataaacaaattatcataaaaagggtaacgtctgattttaaatgactaaccctccccttccctacttttgcgataggcatcaactactgcacccatctttttatcaaatttattttcggtatcttaccattggaggtagggtcccttcgtaaatgagttcattgctcactaagaatctaatcttaccgactacgagtctagaagcaccatgagccctaagccacgatggcacatgttcggaaagatgacggtggcgtcaaacagtcgagtagatgatcaaggatctcgacgtagcatgaacatggatgggtgtcaaatgtctagtattatagtttaggagtaaattgaattgttacaaaagtcaagaggatgacttatcagttttagaaactatcaaactaacataaaccccaaaaatatacttagaagatcttacaacctttcttttcttttttaaagaacgtcagtgacgcaaaaggggtggcctttacttcgtatgctgacaaacatataatctttttcaacttcattctcaaaaactacacaactaccatgatgaaattaaacgtaggctctaacttataaatttaccttttacaaccttgttcgttgtataatctaaacattggaaaatattttcacttcaacccagatgcggaaggtatcatcatatcagaagtgttacatttcaatacactgatgttcttgaatacaagtcaatgataaaagtaaaaataaaaataataacattctccatgttatgctacctaataaggagaggcgaccaaatctggtggccccaaacagattgcggctatattccaaatatctgcaacaatacaatacctatatccatctatgttccaagaagaattgactgtcgaattcgcagtatctgtaaggctgatgtagttcatttcaccaaataatgtttcagtggactaaatttccaagtgactgcagtcccagaaatgacttataaagaatcatctacactgtctaatttaagcagtttcttcagctgtcttctttattttgagggcagctctgacaacagtcccccttgtgatcatcccaaccttgagaaaagaaactttacttaagactagatactactgaaacgaaagcggaaggaaggaaaggcagatcaactcaccaatttaccagtgctatcaacaacaggcaatctgcgatatttggtttcaagtagcaacctgaaacaaatgaacaccaatcgtgatgtctgataataaattggtagacgtggtcctgagaactaatggactgtttgtaggtaccttgtagcagcatcaaggttggtactttcacgaaccgcaagaggcgaataagtcatcacatcagcgatgactttgccattggttttgctcaagagtctctgtatctcgcgaaatgtctgtacagcgatcgtaatgagtctaatatattaacgtgtgaaataaaaaataattgataaagataaaaaaaaaagatctgctactacaaacaatatgtggagcatgactaattatttatttaaatgctagaaacaatatatttaccaaattgaagtactaaattgtggttcagactaatgcatgaagagtgaagaataccaagattttaaagatcattactggggtgtgctacaaaatgggtggtaaatactgttacaaaatatatgtaaggtatacgggatttagtatttaacccaatactgactaagcatcctaagttgagaggtaacaacattcttgatagggaaaacaagtgacaatttgctggacctaacacagtccattacatcagccactatgcaaggtacacttctactttattatttagtcaaacagcattttgtcataacatgtgaaggttctttgtggtgggaacattttatttaaggaggatcattgcttctgaatatagaaactggggattttccatgattaaaaattgcttttattccaaaccagaccattccatcctaacacctggcagtaggtggtaaagataacccaatctaagaaaatggtgcatagctagaaaatatatataaaaaaacatgtaacattctatctttattagaacataccttccaagtactatccacctcaggaaacatgcttgtgtttgtgccagtcagtccacttcctgaaagaatggatttaaaataccaccaatgtaagaatacaaggattatggcatttactacccaacagtatactttcaaaaaataagttaaatagctcaagttaatctttgcagcttagagttccagaaaagttgcagtgtgggcaaagcttttgttgcattcagaatttcagatcaaagttatggttgctatggtttaaacaaggtttggttgtaggtatgcaaaagattatatggtccaagccgccactacttatggttctttctagttgtgatcctgcctatcaggctatcaagatattgacaaatgaccaccatgtatgactgcaagcagatggttagatggtagtgcaatggtgtgttaatgacaaatactaggcttatgcagtttagaggatgcaatattgtactagtaatatgaatttgttgtaagcaagtgatttgaaggtccaagaaggaatacctgatattgagtcaagtgctaacagatcataatctgagacaacacccacctgcaggtggaagtaagattgagtggcagaatgagaaatcagatacaattcaaccataatgtcaatgtaatgtttcttaagacacaacataatagaggagatcaaaaggcccgcatgtcatggggacaaggacaccgttttatgaatcagcactacattctagatgtgagcattccaagatctctaaatcctttaggtagaatcaccatactagttcgaatttagcatgtaaaaaggtataaagtttgaaaccgtgtttgagaaagaaaatatcctagaatcatgttactgagataactatttagcaataaatcatttccccttgagaaaagcccaacgttgttgacttgtaagcataactgttttgagaataaaaattgcagagagtaagtagaaaaagattgaatagagtgaagttttgatgggcactaaccaactttccggtgtcatcaacaacagggaaaccagagatcttgtgttgcaccagcgtctcgagagctgtaaaaacgaacagaataataagttggcgatttggtttagcagcaagcatagttaggacatacttcatattatagaagtagagaagaaggtagtaccttcatcaaccgaggttgcaggtgtaacgacatggagattaggccttttggtcatgaagtcaccaactgtgtagactccgttgttgtgctgaaggaggaagatggtgcatctcatcagaaattaataatgattaatttgaaactttatagttcatccatgtatactcctagcatactcctatacagtatgtatgaatatattcgaagtaaaataaatcagtttggagaattaatgggaaaatcatttatgacgaatttttgggaaacaatgaatagatattcctcccactcacacaaaagaaaaggaatagatatttcagttagaggaatacagacagcttcatgaaattccaagagaaaaggaagaaaggtacacatatggttgagatttgagaagaagcactaatttgagatgagcacacaacaataacaacagcagcaacaaagcactaattaaatagagtactatttgggatgggagcggtgttgtgtagtccagcaaaaaaagaggaaaaaagatgaatatatagccccccccccccaaaaaaaaaaaaaaagcaccagcagtaagtagatgttgttaaggaagctgttgatttggtgagggaaggggggaaagggaaaaggggggtcgaatgaatgaagtggattatacccggccgggcgcggggcaagcggaaacggcgtaggcgcgaaggggcccccaggcgcagaaggacggaaggggaagggtactgggncggtgaaggcgaggccgagccgaaggcgcagtggtggtggagcggacggcgacggcggcatcggcggagcggagcagcgtggcgtccatggctatggctaatccaattccaagtagcgcgcgaagggaagggaagggaagggaaggcgtaggtaatggaaaggccaaggcgtggtgggaggtggctatggcttcctctccgccgcttgcgcttgcgcttggagcaaactaaacggaacggatggatggagcgaagcggtgaaatagctatagctaggagggcctaggggaagggctcggctatatacgcatttgacatgtcgtcgatgtacgctggctggatggtgccactgggtccggctgggctgcgggacgcgcatcacatgggcccatcggctggagatgtgtgatgggcatggacatgggcgctctttgtcctggaccgctcgctcggctccgtcctggattccagagacgagaaaaatctccactgcatccatatgcttccttttctatctactcaatgaaattgattattactacaacgctctacccaaaaataaaaaatgctagcaataataacttttaaattgtatactagtataccacaatttccttttacttgaccgtacaatacatacatagatcaagttgtgtatgggttgacaattaaacacgcacgcacgaaataaattatacgggagcagttttttcagaaaaataaaataaactcgagcggaagttggcgatgtaccgatcgagaaacaaaccataccaaacacaaacacacaccacgagcaaaatcaacggaacgctctgcttaatttgcgtgtgcgtgtgcgcgtgcgtgcgtacatatacgccgacgcaacgcaacaagggcgggtgtcgctgtgaaagagacacacaagacgacgcacaaccaattggcgctgctgcttccgacgtccctgtttcactcgagttattcaggtgagatcacgttttcctctcttcttgcgtgtggatttctaactgcttgctttgcttttctactcgcctctatttttcgtattatattctgacgaatatatataattgacctacatatttttcaaccgcgagacgtattcctacgaaaaggacccccgatgctaccgtcaaaatccaagatttctattttggaactatctatttcacttttcctgactggagaaacaaaaatcttctcttcctattggagtactgcgtggacaaggaagagcggcaaaatatatattcactaattatgatatttattttcctgaatgaagggttgaatttcgtatataaactcaaatcaaaccatcttttctaccctcccccaaaatcaattaatcgctgaccgtgtctttataaatcaaacaaataatttggtacaacgtaaaagtaccacaactcatgttgttattggttcttggaaaatgttttagccttcaatccaccaagtgatatttttttttctcgacactaatgctaccatagctttgaaggtgagggttagatttattttgagacgagaaactactataatttttttagaaaaatcatttaactgattccattagtaatatcatcactgccctctactctcttatggtccacgtgtgcaaaagcacttataaaaccgcttcatgagttgcacttcacgatcaccgattacttagagcaactataatagtaggctataaaccgactaaatgctgaggtagaggagagaagagaggagagagaggagaaaaaggttgtaaacttatagccggcttggatacaagaacgaagaaactctctgtaagagggacaagtggatcatatattaattgtaaatagctaactattatatgggtgaatagagagaaggctacaaagaaccttatagctaataagtcggctgttttattagccttgctcttagccggtacggtgagagcgtttaatttaacttaagtcttttaaattctgaaaaaaacaagtagttctgctatttaagttccattgcaagtttgcagcacactgatcactggctgttttttcaaacattctaacatatttcgtgtaagttcacaccgtgtagaacattggtgccaacccataggaccattaatccattcaatttctttgtattacttcgtgatgggtacaacgtaaggtgctagcctagaacatatcgagcaggcatgagaggaaatttctcaggtcagacagccaaacagaccagaccgtaactctctgaatctattctagcctagatggctaacaagattacttactgtaattgtaatcccatcacataggagacattaaaaacgaaaaagaaacgtggcaaactcatcaaaagaaaaaaagaatgcctgaaagatcaaaacggcttaatgatcaacacaagacctagcagtagcaaaccaacaaatttactagggatgttagcattcgaaatgctggctgctgaagcaggtgacttgaattctatagttcctgaatatacgtttccatttacagaagaggaagtccggttaggggctccggtgtccttgcatgcgcccgctggtgccccagcctgtaaaaatagttcttcatgagaattgcaacttgaaacacaccaatattgaatgaaagaggtgctagaatttttatgctcaaaagtaagaatagtttgttctaagattcatgcattactatttttgtttcaaataacacttttggcttcacaattacctggcaagcagcaatggtgttgcagccacatagtgtcacgccattgatcctgtcttgaacatcaaaaacacccccaccatcgcttcgctgccatagtaagaaaatttccattggatacaatggcaataacagatatgcattttcttgtatgagcagtgctgataaagtaataccatgtagtaattcacagctatgaagttagggattctatttccagctgcagtatagcaagtttggaccatctgtggtagtccaacagaattctctttacacgcttcattctctacaggaattgtggggaagtaattttgcataaacagagatgcagatcttgagtttagtggttgtgattcctttctatttggacaagaaccagtgatccctggatctccagctgccatgataatgagaaaacaaaaatgacctcagatgtaaggtaagctctcttgccattgttcttggtgaaattggcaaatacagataaactctagacacgggatagttaacagctgtgaatgcaagtagcacttggttcagacagcgcatgtgcagcaatcaccacactgctatataaatttactcccggactatgttttgaactataaataatgagaagaaataatgttaaacatgcacagtctatatcctgatgtagaccaggtattcagagcagtcttacagaattagaacacaaaaggaagttgctatagataatatgctcacaagttctaaaataaacttatgaacttataatcaaagaagttttgacttaggacaaaaataaaacatcttacattttggaaaggagggagtatgaaaacgaggaaggagaaaatatgtgatgagaatgttgattgcgggtctaccaatgtaattatgtactaaaaggtgcaatattttcattatatcttagtaattagtatcatataaaaatgttttggggtctgtggattttgtgcagaattctttcttctgtaatcaaatgatatgcagccctcctacatactcgggaaaaaaagagtgttttctaaaacattttgattcaaaactttggttccttgaaacaaactgtaaaacctaagactttgtgttataaatgcccccaaacctggatttttgtgacatgtactcaaatttaatgctattgataacaacaacaaccacagccatagctatatcagaaaggcccatgtgctctagtagtaacacattttttttttttgaacaactcgcacaagacggtgcgaagttctattgatagagcaggaaaaaattacaagattacaaccctggagggtcgtaaccaggaaaaggaaaaaaatataccaccacccacataccgacagcgccaacacacaacccgggagaaggctagcaccagaccggccgccgctaagcgtgaccgactgccgctataccgacaaaggaacacagaaaagatcgccctctaagggatgccaaaacgacgtcttcaagaagagaagcgacggaaaaaaaccgccgccaccgtccgtcggggctcaaaggagccgagactaggctttcgcccggcaaccacccttgaggggtgaggcagcacgacaacgccctcaggagggggaatgaaccatcattgtcggcctggccaaggccggactaggttttcacccgccgctcaccacctgcgaatccttggctgacgcaccgatgctccaccacctctctagctctgccgacatgcgggacccctgcatcggcgtcctccgccggccagtcttcgtgcgccgaagaccgcgccacacccaccgacagctcctcctttccgccgctcgcgcctctcgcgccgagccggcccgatgtagccatctgccacgccctcagctagccgtccgaggccaccatgcctccggcgaccatggtcaccgccaccgctgtaggaataagtcttggctggttggtcttggtcttgtggtgcctttttcctgtttttcagctttctaggacagcatctctactttcagtttggatgctctaggacagttaggacagcagtttgttgagatgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtnnnnnnnnnnnnnnnnnnnnnnnnnnnnnnnnnnnnnnnnnnnnnnnnnnnnnnnnnnngtacaacggacgtgtcattcaattnnttcccacg

SEQ ID NO: 394 - DNA, 1065 bp, Oryza sativa
  unsure (1)..(1065): unsure at all n locations
ctccaacccaacgtcccaagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctttagaaatttccattcggtccttgcggtgaatatatacgatcatcacaattacacattttcttggctggtactccctccgtcctaaaatataataacaaccctcctaaaatataataacttttagccctagaatttgtcccaaaatataataacttatctaccaatattttctccttaactaattacaattctctatcattcatcttttttcatctatcttaactgctcatccaactataacccttcaccatttatcggagggagtagataattataaacagtttatgcgtccgtccccgtagagaattactaagagcaaaatgaccttcaccacttatcggagggagtagataattataaacagtttatgcgtctgttcccgtagagaattactaagagcaaaatgaggaattcctttagaacacaacataagatggcggatggccgcaggtctcttattctacagcggcagtctcaaacttggcctagcccaacgacgagcagagttatagctgctctctcggcctaggagtgtttgggtctaagactctaaggcaggtagagagatggccctagtgaggtactctctccgtcccaaaaaagccaannnnnnnnnnnnnnnnnnnnnnnnnnnnnnnnnnnnnnnnnnnnnnnnnnnnnnnnnnnnnnnnnnnnnnnnncaatccaatgccctg

SEQ ID NO: 395 - DNA, 758 bp, Oryza sativa
  unsure (1)..(758): unsure at all n locations
cgccaaaaaaagatgggcttgggtagccccgaagatggctttgtccacggcatgtacgtgcgctgatcacgcccctgcnatcccttctctgcaagcatagcaaactgaaacaactggttgacagtgttaaatcctttattttctaccatgtcttgaatctcgcgcctcaatcccatgtaaaagctacaaatggaatcctcagttccctccactatgctacatcgcatcaatcccttttgtagctctccatagtaatcctgtacagatttatccccttgttctaaacgattcagtttcttgcttaaatctctataataacatggaggaacaaatctatcacgaatagctaccttaagttctttccatgtagtaggtaaagctctcccaacatctaacctagaccaccaaatataagcaaactctttgaacccactactggcttgtcgaactctatgttgctcaggcacaaggtgggcactaaacttttgctctactgtcatctgccgatcaaagtatttcttagcatcataataacccaaaaagacggtattttaaacttaaccttagaataaggatcatcgggcacacaattattgttgccttattggtatcgctgattttaagcaccactcatacctgtcattgcaaacacaaaaacaannnnnnnnnnnnnnnnnnnnnnnnnnnnnnnnnnnnnnnnnnnnnnnnnnnnnnnnnnntatcaaattggcgtatcagggcaatcaaaannnnacacg

SEQ ID NO: 396 - DNA, 776 bp, Oryza sativa
  unsure (1)..(776): unsure at all n locations
gtggtccnntttgagtgacgtttcnnnnnnnnnnnnnnnnnnnnnnnnnnnnnnnnnnnnttttacagctctcgagacgctggtgcaacacaagatctctggtttccctgttgttgatgacaccggaaagttggttagtgcccatcaaaacttcactctattcaatctttttctacttactctctgcaatttttattctcaaaacagttatgcttacaagtcaacaacgttgggcttttctcaaggggaaatgatttattgctaaatagttatctcagtaacatgattctaggatattttctttctcaaacacggtttcaaactttatacctttttacatgctaaattcgaactagtatggtgattctacctaaaggatttagagatcttggaatgctcacatctagaatgtagtgctgattcataaaacggtgtccttgtccccatgacatgcgggccttttgatctcctctattatgttgtgtcttaagaaacattacattgacattatggttgaattgatctgattttcattctgcactaatctacttccactggnnggggggtnttgnnnnnnnnnncggttaggccacacttcgaccttccaattattccagggtatttttcctttctctgggaacccttcaaaatcacctttgcttacaacccaaattcatanttacttagtaccaatattgcattcctcttaaactgcataaagcctagtatttgtcattaacacaccattgcactaccatctaaccatctgcttgcag

SEQ ID NO: 397 - DNA, 750 bp, Oryza sativa
  unsure (1)..(750): unsure at all n locations
gtgcgnnnggtggagtgacnnnnnnnnnnnnnnnnnnnnnnnnnnnnnnnnnnnnnnnnnacctatgaatcaggaagattcagtggtatgtagatctgtatcacatagctatcgctgttaatatgattaaacatagataagaattaaagcagagaaagccatacttacactcattctccagcagataactccactggtatgctattccttcgctagcctcctttgaagaatcagaagtaaacactagcaacctgtggttctttgcaaccatatctgtgacacttggccagtcctttccattagttggcatttctgagatagggtaccaatatttcgtcaagtcagcagcagtaaacaatttgctcaatcccatcgttgaatggacgtaatcctcaatgaatattgttattatctctgtcggattctcagatagaaatgcttccacctctttcaatgtgtcaaattgggctggttggctaaacaatannatattttcaattttaaaancactnnttagtttttttagggaaggttgggttaaaaaaaccaaggnaaactgttgaaagataacgtgaatagattcaaaagcaaacaataccactatgttactaaactatccaaacaattgatacctaaaggaaatttattgaaatgttgtcccaaaacaggagacgattggaaaacaaagcaaccagtgcaggacttcttatctaaatggcacgcgcctttctttaaatcttagcacaaatn

SEQ ID NO: 398 - DNA, 788 bp, Oryza sativa
  unsure (1)..(788): unsure at all n locations
ccgcgtgataactactactatanggcgaattcgagctcggtacccgaggtgagtaagtcttgtaggatcaaatcacaaaaactaatccaaccaggggggtgaatggttggtatacccaaaaaccgaaaacttttagcggaaataaaagttaccctcgaattcgacggattgcggtctgaccgaaattgccctgccggtctgaccgcctggttgccgtcggtctaaccgagattagatcttcggtctgaccaccgagatcatctgccgcttgctgttgccgccgccggtctgagcgcctcgctcccgccggtcggaccgccgcgatgccgccggtctaaccgccggttagtcgccagttaaaccgccgaaacccggtgaaacacaaatcaaagaactcttaaagtggatgacgactttattacttctctctgtgtttacaaagtgcaccaacagcactccttacaaaaatttcgactaaactcgaaaccctaactcaaaactcaactcaattgctctcaaaagcgataccgggaagcctcacgctccccctctatttatacccgaggtaggcagcctaaagccatgaaccaaactcatactaggagtcctaaacaccttaggaaaccctctagtacaagatagaaactttagataaccaatcgtaccaaatttggactccttncaaaatcgactncgcattccatacgcacacaataactncatcgtatgccatatggaatctncatcaaccacgtgcatcaactctagccttagtatnctgcatgatc

SEQ ID NO: 399 - DNA, 7158 bp, Oryza sativa
  unsure (1)..(7158): unsure at all n locations
acggcttagattgaccactcgataacaccgggcgaattntagctcggtacccnnnnnnnnnnnnnnnnnnnnnnnnnnnnnnnnnnnnnnnnnnnnnnnnnnnnnnnnnnnnnnnnnnnnnnnnnnnnnnnnacttgtacagtataaagtcgaccaagaacacaaaagattgcagcatacaattgggaaataaggggggataattggatcacacacctgggtccttgatttgtttctcaaatctttctacccaatgatcaaactaacctagctagctcctcttcttgatctttctcttcttaacatctgttacgagcaaagcgatcacctgtttgttcacaaaaattgtttgatcaacatgaatagagattataaaagaaagaagagcacagatgcgctagttccagatatatagaatgttaggaaagttaatctctcggctaaggaaatcgggagaaaatcacgcgttatcgttttccacccgttaaccagcgtgattagctaaatcaaatcacgattaaatttccttaattgcacgcgcaataatcggtagcgctttcaacgtttccttttggagcagcccccgattccctcagcgcaaaataaaaggggaggccggcccgtgagaaagatgacgatctcactcacggttccaatctccccgacatcccaaaaccctaatttcccgattctcagttgcactggaagggattcgtagtgctattcccggacagtgtaggtggcgaccggaaggccgctgccactccgcaggtgatcgccggtgaccttttcgggatcaagccggtgtactcactgctacgaccacttctacaccgacaattcgcgaggtggttcgaggttctacatcctctacatccaccccgaaccaagcaagaacaattgcaatggcttcaaacaacggtcagttatcctaaattccgcattagggtgatcatgttaggcttagcacttatgtcttagtagattcgcaaagtctacatagagtaccaattttgtctcccgaattcaaacaaaaagaactaacagaaattgggaagagtacagcccccaattttagttacttcttttccgaggtagaatgaaggactaaactcgcttttgcggctatacgctgcttccacgcacaagcgctcagctaactttctgagaaattacttatatatatagaggaactgatgttcgttcagaacacggtaggaaattaaaagaggccgctgttttgccaatatataggacaaaggcctggtttagttcttaactttttttttttcaaacttctaattttttcatcacataaaaactttcctacacacataaacttccaacttttccgtcgcatcgctccaatttcaatcaagcttttaattttagtgtgaactaaacacacccaaagaaaagatgccagtaggaattgttcatttcaatccatatatttaactcaccagtcagcttcattgcaaagtcagaccttcttaaagtaagagtgtcacgaaactgagagggaacgattggactaatttatattcattgcttaatagtgatagacacaatcctatttttatatagatgaaataactagcctctaagtgaagactcgaactaatcttatctttacctctaattgacatcttatcccaaacagtgccacagtaccacgagacactgttcatccaacagatttgggctcgtgggcctcggcctctcagcccgatgcccattatactacacctctcggttttaatatggacttctaaaacttagacgactccctaaataaaacataatactactaactaatttagccttttacatcttggcttttgacactgcaaggaaagacaatgcaaatatatagatctaatattatgaatgatagcaatatcattgtgccaacaacacccacgggtggacctcatccagatgctgttacgagaaggaaaaaagttatctatgtcctgagtgtgtaaaaccagcaagcttgatgaccatagtaatcaacagaggtatatatatatatatataaaaagaaacataagataatatgccacttggagttgtccatttcaatccatatattcaactcaccagtcagcttcaatgccgagtcaaaccttttcaatataactaggatgatagcccgcgcgagatgtgtatttgtctgaaagcagttataacaaaataaactgaaatgaaattaaagtaaggtgttttctatttttaactcggtgttcattgtatatctttttttaagaaatctcgataaacttttattggcaataaatgtttttttacaaccctgtcaattctctttttaattgattcatatatatatgcaattcattatgcatgtgaatcaataatgataacttctttaaaaaaatatttgttatattttgaatttagtgattgagtgattctaatttcgaatttgtttcaaatcaaattattgttttattctagatttttctttttaaggattttaatttatacttaatttcgtatcgtgttgtatttggactcattttttaatagttattttattattccaaatttcagatatttataacttatatttttatatggactgttgatatttcatattctacatggaatcttgttatacattttttatagttttattgggttttctaaatttttgaatgagaattttaatcaaattgctatttttctgaatttaattttgaactcctcagcgatagaaatgacactgttttctagtacttgtcggagatgcggaacgtctccctccggccctcatctcagtcctttgtgcttcacataatcatgtagcgtgctattaggctaagaaagtcatggaaagtcgatgctagtgcttcgatcggtgtccacctcactaaggttgtgttcttcccactcctttcccaacttagctcccttgtttttcgtgcgcacgctttccaaacaactaagccgtgcttttttctaaaagttttctatagaaaaattactttaaaaaacatataaatccattttataaaataaataattaatatttaattaataatattctaatgtaatgagctgcttcgttttacgtgtgtgggagagattagctcccaaacccatctaatgaacacaacctaataatatcttgcaactccgcctccgttgagtttaggcccagagtatgtatcatggttccaagctctttggtggtgattgaatctggaatttagactcaaatatttgtagtcagaacagctacgttatcaaaattttatatagtaaatatgggtaaatggatcttgaattatgtatttaattgtaaataacacaacaaaatgcaaataaattgagaaaaatgcatgtaactttgagagtcatgatcattaactatccgattattattatttatacattatgtgtttgttagaaaataggaaaagttggctcgaaaataggacaggagagtgggatctccgaggagagttagagggttgaaggactacgtacttacatatgtgcccacatatggcggggttgggggtactggatttttttaaagatctaatggttaaattattgggtccacctatttaaaggaatatcaatggttttttttctttttttatcaaaacttttaggattttttttctaatttattagatcgtcatggcgtcttaagaacatttgtaaaacgccatgtgacagtttgagagcgtttgtagggagttcaatgaacttttagtatatagcagatgttaatggattttcagtatataatatatagatagatgtgtaaagaatataatgcagtaaactttcttcaaacattatagacgtttacgatgatgcagtctacatttgcaaagttataattgttgatttctaataattaatgttatttcaattatccttaggaattataaaagggaaaggcgagagaaatacaggtgtgattagggtgaacagtttcgcacgtacatacgcatgtatttcatatgtacggacttatgggagaggtggggccattgtatgcggtaagattaatctagtccaacgtttataatatcgaacccattaatttaagtgaatattttaagggttagatattttgctttttaaaaattttctattatttattagagcgccatgtggagcataggagcatttgtagtgatgccacgtggcaacttaggaccgatttaagtgaacgttgatggacaaatatttttttaaaaaaataatgcaaaataatgggtacataatattatataatataatggtggaaactttattttcaaatattgtagagctaatttatttatgtctacttgtagagatttatatgctgtatattctatatttgtaaagtaatttttattcaagatttattatcacttattattattattattattattattattattattattattattattattattattattattattattattattattattattattattattattattattattattatcatctcaattatatacctgaaataaagaaagaatagtaacgtacctagaaaaataaaagaaagtttatgtacgtacacaccttgaacgcatgcaagcagtaccgtacctatatggatcggatcaacacaagctccttgaacgaaagccagcaatacatacctatatatggaacggaacagaggagtacttttgagataaatctaatctaacggtttataatattggatccaccgatttaagtgaaaatcgagagatagatattttgcttttttttctcagattttctagaattttctaatttattagagcgccatgtggcggcttgagagcgttttgagaaaacttaatggacttttagtatataatagaagacagatagatagatagatagatagatagatagatagatagatgtaagagtgtcatgacccaaatttgttatgagatggtttaggaaatttgtgtgccgaattctcagctttggttgttttcccttgacaaaccacagcatgactaggtagctcattgagcttgtctcggatcacagttagaattgtgttatcccaatttggttctgtcgcattcaaaaaataaaagatatatagttcagtctattgaatgcaccatggagttgatagtgaactgcactagattaggagttttctatgactttgtttggttgataatgaggatttttattactgattcttccctttttgaataaatacaaatcaacctagtatctttctgtacatgggtttaactttgtgacaggaaaatattaaccttcgtgaatcatccaaagttactgcatgtaacaatttctactactccgaaattagagcaatactggcaaatttatctagcaatatctgaaacaatttctagcaatgtttaacaaatttatctattattctagttaaattattttgtaattgtttggtttgcattaacaaatattgtcatagcgttagcacgggtaaattactagtattgttgtcattcataatattagatctgtttgtctttccttgtagtgtcaaaagccaagacgtaaaaggataaattagcattattatgttttatttatggagtcgtctaagtttagaagtccatgttgcaggtcgacaatgaactgctcaaaaggaagggttgatgaccaaagcaatcaatagaggtatagcaaaaaaagaaagatgagataatatgccacatagagttgtctatttaaatccatatatacaactcactagtcagcttcaatgccgagtcaaaccttttcaatataagagtgtcatgacccaagagggaaatacccgacaatccttgatgacgaagaattatagtgttgaagttcctgcgcatgctccacttgaatgcttagcacatgctgcacaagtatagtcttgtagtttgtggtatcgatgactcctaaaatctccccatcatcattttccatctcaggatcattggtttcacctagaagcttagcaacaagagaatattcttcctcaacatcactagaacttacatatccaccatcatccgtagcgatgcacgcatactgacttgtacaatccttcatgacatgtcacatgcccttgcagtggtggcatatgatcctaattcttcgccccgtagaagccactgacgaggagcttttcatgggtacctgcactttaatagacttactcacctcggtagctcatggattcatgatggaacggggacgggtgtcgatggagcctggttggtggaaggcacaccagagcgtgcaagaggagataccgtccttgttgaaatagcatttccaaaacggtactttgttgattgttgccgttcctgcaattcttgttctgccaaacatgcaagtagaaacaatcttcatattctttatagctaacaacatcttgaatctcacggttcaaccgcccatagaaacttacaatactagcctcttcatcctctattacatcacaacgcaaacaacttattttgtaactcctgataatattcttctacagatttatccccctggtctgagcgttgcaatttctttaaaagatcacgtctaaaagaaggagcacaaatctagtgtgcatatagttgtctttaagagcaggtataatagcagactataagcaagctataaacacatatcaagaagataaaagaggagagagaagagcagcgggctacagatttgtagccagcaacagcacagactccaagacataatgtatgtgtgacaagtgggatcatatattaatagtgtagtatatgtttatagataactattgtatatattggctattaaattgaccatagatgatttggagctaatagttggttatactattaaacttgctctaacgcttctcatgttgtaggtgctagtccatcaatacttatttgagtccatcacaatgttgcaaaatcattaaattcactagtagcttgcctaaccctatgctcatcaggaataaatgtgcactaaattttttatctacagtcatttctcaatcaaaataagcttcagcattataggcaccatgaaaagaggnnnnnnnnnnnnnnnnnnnnnnnnnnnnnnnnnnnnnnnnnnnnnnnnnnnnnnnnnnnnnnnnnnnggtcttactgccat

SEQ ID NO: 400 - DNA, 4053 bp, Oryza sativa
  unsure (1)..(4053): unsure at all n locations
tctttctcaatcaaaataagcttcagcattataggcaccatgaaaagatggaatcgtaacttaactttaactttagcatatggatcatcacacacattatgaaaattacctccaatacctcgacgattgaagctcagcaagtttctatcaatattatcctattttagattcaccaacctgtcgagacaattattgatcgttgtaagattggcattcagcatgcgctggaacctctcggtagaggtttgaaccatcctctcgatcacaacagtcatatctctgttgatagctccacattggtctttgaggactttgacaagttcctccctgagcacgcagtccttaaatttatcgttggtgcatgacatggttagtagaatatagaaaatagcacaaggatattatccctatcaactactaggtgatgagagaaagacacttgcactcaagcatcttaccacacgcatacacgtagcaagagatgcaaccagtggcgagaagaatcacagtaggaagtatagtgctactatgcatttttggtggttatcagttgagtacttgagttattttatcttggacctccttgcatcattgtgcaggaagtacagccatcagtaggcatgaaaattcgatctgcattagcaaatgaggtacattactatggtttcctttcagccgtgttccaaagtgaatgcctattgatataattttggagcaaaatgcagggaagttctgaaacaggaaacaccgtagatgtcaaatcatctgaaatgcaacaggtggtacattgcagcacgcaagaattgctaccaagtactactatccaagaagaggtatctctttgcaaggaatacaccattatctggttgcagttctgtattaaatacgtagtgcccctgtcactttgttcaggactatgccttgtcaaatatggaaccggaacattcatgtactgacatcagtgacatgggattgacctgctcttctatcactggtatagcatcactcttattatttgttgccaagttcattacgtgaatggaaagtatgatcacatcattacctgactggcactcccagataaccttgctgagaagactcctgccagcagtacccaatcctccccaaagttgagtgaccaactgagagagatttcaaactcattgaagcttcttagcactcggccagtgagcgtgagggcacaaacgtggggcatagaatgcgtctagcgaatcaatacgattgcaccggagccaaaaactcctgaagtgcatttgaaatttgagcaagcggaagatcccaaggatatacttacagcccgcagcactgggattaaggttaacctgttttttaactcactgactcattttattcgcttaatgtgtttgtaccttcttataatcgttttgcctgatgaattctctcttgttttttctgccccacagaaatctctagttcaagaatgcttgacttttctcaacagtgctaataagtgagtttggcattatctttacaaccgacttcacactactgcatttctaatgcatgtttgtttctgtgtcttttgcagggaacaatttgtagggtcgaatcacagcaactaagccaaccagggagggggggttgaatggttggtatacctaaaacccgaaacttttagcggaaataaaagttaccctcaaattcgacggatcgctgtttgactgaagtgtatacgccggtctaaccgcctgatgaacgttggtctgaccgagatcgaactccggtcgaaccgccgagatcgtctgccgctccctgtcgccgccgccggtctgaccaccgtgtgcccgccggtctgaccgctgcgatgccgccgggctgaccgccaaaacccggtgaaacacaaatcgaagaactcttaaagtggataacgactttattgattctctctgtgtttacaaagtacactaacagcactccttgcaaaaatctcgactaaactcgaaaccctaactcaacgctcaactcaattgctctcaaaagcgataccaggaagcctcacgctccctctctatttatacccgaggtaggcagcttaaagccacgaaccaaacccatactagaagtcctaatcaccctaggaaaccctctagtacaagaaacaaactttacataaccaatcataccaaatttggactccttccaaattcgactccgcatcccatatgcacacaatacctccatcatatgccatatggaatgttcaccttccacgtgcattgaattctagccttagtatcccgcatgatctctgaccactacggatgtcgtcttatccccgagccgactcccgatccatcaccgcaaatactctcccggcatcttgagtcacctacacatagaacaaacaaaagaaaccatattccgagaccaaactatccccaacttgactcattagtagcaaacaacagtattacatacgcatagtatccatctagaagccataatcatgaaacaatcacggatatctaaacaaacaacccgaaaccgaaaccgacacagagtcggccggtcaaaccgcgggctgcgccggtctgaccgcgtgatacatgccggtctgaccggaccacatccagcagtacctgtagatcacctgtgaaatccaatcatctccaaaaccacttcgtgaataaattccaaatatcaaaactaatatctccaatgccaatcgttcatcatagaataacaataaaaaacacctttaattttacacaattaaaaagcttaaaggtttgctccgaaccatatcgtggcagcccagattgcttctttcttactattaacccactgatacatgtttagggaatcggagaaaaaagggcaaactacatacttgagcttcgtgaggagtcaccagagcggcagagctatttaaagaggtgagcactctagatcaacaagggagtaggcattaattagacccaagcgaccagaagttattacatgacaatgcaacccagagctgattcctttgcttttgcagataagagcaggtacaatagcaggctattaaccggctataaacatattttaatgatataaacgatgagagagaagagcagcgggctacagatttgtagccagctgcagtacggacttcaagacacactgtgtgtatgacaggtgggaccatatactaatattatagtaagtaactattgtatgaattggctattagattggctataaatgaattggagctggtagtgggctgtactattagacttgctctaagtgatctgagagacatcatcggaatgaattcaaaagaggtactggagaatctgattgcaatgtgtacatttatctatgttctttagggccagtttggtttgaggcctaaattaggcttgccaattttttggcaacctcaacaataattgtgtatgtttggattgaggccaaattttggcatgcctatataacataggccatttcaatagccaaattagtttaatttggcttcaatccaaacatatgttggccttaccaaaatttggcatgccaaaacttgccaaaatttgacatgccaaattttggtaaggccaacattggtcacgaaccaaactgacccttaatcactggaagatagtttttgttttcacaaacattcactggattacactgttactccagctgcttcatttgcaaactccatgggttttggatgtactaaaattgccactgctttgttatcttcaccagataaaaaagatgatgtccgggattattgactcctaggaaagtacgcagcgctagtacgatggttctcctgtggagtgtccatatgcttctttggtcaaaggtgtcatgtctttgttttgtactacctccattttttaaatagatgacgccgttgactttttctcacatgtttgaccattcgtcttattcaaaaaatttacgtaattataatttattttgttacgagttgtttnnnnnnnnnnnnnnnnnnnnnnnnnnnnnnnnnnnnnnnnnnnnnnnnnnnnnnnnnnagatagcgaatgacaagct

SEQ ID NO: 401 - DNA, 12157 bp, Oryza sativa
  unsure (1)..(12157): unsure at all n locations
gggcgcgcagtgttaactcgtagatcggccgcccagttgtgacagtgccttggacatggatccaccggacccggtggctttatttttacccatacaccaaactttgtgttgaggtttttgccaagttgggtcaattaggcgccaagggtccgattccatggaatcgggtataagagcgttggtaagcaacgtggtttaacttcgattcggtgagggtattggggggtactttttcttaatgtgggtaatgaatcatatggttgaatttaaggtttcgattcccttcttttcattgtgcctagaatgctgaagcttattttgattggaaaatatcggtagatgaggagtttagtgctctttattccgggtgagcataggtttaaccgagctcttagtgaatttaatatttttgccccagtatggtggactcaagtaggggcggtcatctattaaaaaacggagggagtattttgttttatccagttgcttcttaagagctcgccgtgtttcgttccaaaataattcttcaaacttcaaacttttccattacatcaaaacttttctacacacacaaactttcaacttttccgtcacattgttccaatttcaaccaaactttctattttggtgttaactaaacacagccagcgaatgctttggtcaggagttggcattctgtgagagaatcagtgctttgcagtggtttgctgctattatgtgttctttgtaatcatcatacagtgtcgtaccaatattgataatggtgtggcgttaatgtgatttcctctcttttgatgtctgttgctattaatgccgatttattgttttagaaaaaataatgagtcgatgaatattcctctttgtcgatctgagaagcacatttctagttgttttcgtattccgataaatattcgttctgatccatatcgtttcgtttttgtattcgataatatttgactctgtttttgtatctggggtttcctgttttgattttgatttctgagaaaaatgaaaacggaaatggtagaaccagtttctttccgtttctgaaccctttttatcccttgaagaaaacaataaaataaagttaatatgggtgttggggctggtatggaaatgacatggacaagattagatattgtaaccacccatataaaacttgctcttaagatactatgtgctaggagaaagtcctattaagcaaggcagatgctaggacatatgttggatatgtagaacatgaattagtgggagggagaaacatagatgttaagtttaatatgttttttattccaaaatatagcaacctatactagaacatcacctattagtatgaatatgatggattggtcttgaatatgaaacattttgcctcaaaagatggaacattacacattcctaaaacccgagttttttttaaaaaaaatactatatttctaaatgttgttatcatgtggtagtatttcaacaggacatcatttcaagaaaacaaagccctatactccggtcctctctacttaatttcactcggccagctgaagggtgtctaatttggccgcctgcaggacaccctttatcacaagagcttttagggatcgaataagctcctatgtccgacctagaactatctcagggtcatatgtatatatggtccaactagctgaaaaggagaacgtgggagttgtggaagattaattgaacctgaataatctaagttttatcataatattatttttcctgatgcaacacacatgtttttttagtatgtatataatagtcttccatgtaaatctccacatcaactatggggtatcatccaaaaaaaatacacatttcggggtaacacccacaaattcagttcttgagattctcatctcctagcctacccatggtctgatcaggctgcactttcttttggctctctcgatccaatacacaataacacagtatattaccagatatatattctgagagatgattctccctgatccccaacataacttacgttggcatgttctgtgctgtttgcatctgaaatcatcttgaacgctcatcattatttatggcctgcacgtcgatgccaatgaactatcaaatccaatgaatataaacaatacatttcgtacttcgtttcatctttcttttcctacaacataactaaatctaaacaaataagtattctatggcatagtattataaaagttgagtcttggaaaagctagtatcggcttattgtgtacttgacagccaatggaaatcagtccgtttgccatagttgatgaaaatacggttaattgtattaccaatcatgaaattcacacgaaactaaatattacaaataagtataacataatttatgacatggaagcagagcaattctatcatgacaattttctgtgaacttaataagaacacaaaaaaaatcaaaaaatttaatgagattactctaagcggggaattaccagttttaagttttaacaaaaaaaaaaaagagttattccgtaggacgtaccagtcatgaccttaaaaggttgtgttatctccatcagcttggggcaatcttctatacgaccctgcactatttcagagacagatatagcaccaacaatagagatgaggtctggacacctcataagttgaaggctaagtcccttgagtttcattgcactcgccagatggctgttgtcgatgtactctatgcttggacaaagtaataagctgagcatccgaagagaggatggtaatgtcattctcctctgcatattcaacttgggacagtttctaatacatagcttctccaagcgagaaaaaaggtggagctcatgaactggcagtaatgctaattccttgcaaaataacacatcaatggtcttcacgaaaggcatataagcgggcataaagaactcatcaagactcaacagtgcattgcaaaacgaaatggtgactgttgaaagggatgaaaatactccaacagtgtgtatgttgcttgcctcagagacacagatggatgtgagggagccacaattatcaatacgcaaattctccaaggatggaagattactcatccaaacttgcaggggaatagatgttaagaaccagcaatgtatttccagatgtgtcaggagggagaggccacgaaagcaactcacaaagtgatctgtcgaatggccaaagttgccaagggtaacccttctaagagaagagggtaaagccaccaaaccttgccaatcaatgttaggacactggtggacatccaacacctcaaggtgataaatgctgtttgactcttctaaatcagaaaagagtgggtcaaagaatgataggctctgaatgttcctgcacccataaagttcaagtgaagtcagcactttcaggcagtctggctggagccagctggggcaagattgacctaggtaattctttattatcaaatgctcaagattccaatgaggtaacaattcaatctgctcctctgtcatctgtaattgttcatcagctatttccgttgtggaccattctaggaattgcttatctttaaccttgttaaattggaagccctttgattcaattttgtttaaggaaatcagatcactgaaaccttgagggtatcttttgaaaacacaacccttggcatttatagtctggacatgatacaggcaactaacagatgaaggaagggtctcgaaagtagaacttcccaataaaccaaggtaacgcaaatgttttgagttgcctatgctctcaggtaactttctcaccgttgaaaatttaaaaatcaatacacggatactcgggagttccttgaaccaacaatcaatcacgggagcgaattgtttaatacttcggtaagattcattgcatattagggaccgcagttttttattttgtgtgcaaatagtcactatttctgtacagctgatatttcccttggtgaatattgacagatggcgaacctttgatgggattttagctaggtcactcacatgttgtatgatgaagcactcatccttggagactagctgtgcagtatcatgtatcaagtcatgaattacgtacatatcactatagccagctgctttctgaaagaatgaccgatttacaaggtcattaaagcaagatgatgcatcttcagcctccacatacccttgtgctacccaaatgtctgctaaaaactccttgtcaaatttatgatcctttggatacagggcacatattgagaagcatcttttcatgtgtcgtggtaggtaaacgtaactcagtcgaagggctggcaaaatgtcagtctcctcttgttccaatttccacaattcacttctcaatatgtcctcccagtgctctacacttaagttacttttcaacaagcgtccaagagttttggcagccaaaggtgaacccttcaacttgggaagtatagctctaccaatgcgctccaactctggacgaatgtgctccagctctgggctattgcgagagctgttggatccgaatgcgcatagtttgaagaaatcccagaaaacatcattttgcagtccgttgagctcatagggatcactgttgctgactaggttagcaactttggaagatctagtggtgaccaaaatcatactgccctgaagaccattgcttaaagttctatgaaatgttctccatcctctctcatcttttaagacatcatcccacatgtcatcaaggacgagtaaaaacttctttgacttgacactatcacgtaaattaaccataagagtatcccttgtatcagaatcttgtgactttactccaagagacttcagaacatctcttgttaacctgtttacctcgaattcatccgagacacatatccagagtatgcagtcgaagtgattccgcaccactctatcctcacagatttgttgtgccatggtggtcttcccgatgccgcccataccaactattggcagcacaggcaactctgtcctccttgcttcagctgtagtgctgcatgccacaggtctgcctctcttgcgtccacgtactcctagcttttgcttcaactccttcagttctttttcacgaccaaatatctcatctggctcgtctaggacacggcatgtctctggtctgactaatcgatcaaacttctttggtgttttgtgaaagcctaaacccttggattggtcaaaaacctgctttagtctatttttgattttcattactttactgaagttgacactgttcaggaactccaaaaagggttcatgcgagtgatcttgccccaagttcttgctcgtgtccaccttcaccttgagagcatagtaattgtactcatcaaggaggtcctcggcatcgtacgctacatccttgatctggcgaagatgccagtcttctgtatccttgtggctatgccattcaagacgatcgatgaggtcatacattgtggatgtagttgattggatcagccataggtcgttctcgagattctgaagatcatcctcaatctggtgcagtggagctgttctgttgtctctagctgatgctgatcctacccctcctggatccacttgcagcagatgctgctgctgctgagaacgtacggcagccaagacacgtggtgcggcccagttgaagaactcacggaaggcattggcatcggcagcaagaccagctgctcccttcaatattccaacgatgtcgtccatagccaggttgagcactgtgcatgattataaacgcaaacaaattaagccaaaccgttaatagctccttgtacgaagagatgcatcatggcaaatatataagacacatgattgctcaggaaattctatctcaaataggcacatgattgcccaggaaattcaactaggctatctatctatctatctatctattatatacttcctccgtattttaatgtatgacgtcgttgatttttcgaccaacatttgactattcgttttattcaaaatttttgtgcaaatatgaaaatatttatgtcatgcttaaagaacatttgatgacaaatcaagtcataataaaataaatgataattacataaattttttgaatatgacgaatggtcaaacatacaaaaagtcaacggcgtcaaatattaaaatttgaaggtagtattaaaaatctatgaaactttctacaaacgctcctaacgcatcacgtggaagtcctacaaatgcttctaaaacgccacgtgccactttaataaacaactggacctattatttttaattattactattagaattgctttttccacctctctctcctatcccaccttcccacatccaagcatccccgcacgtacctacaaacgtacggatggataaaaaaatacctatggactatttgctaaaggaaaacaaatactcaatattagaagtttcagggttggacacagttattaagaaagtaggtagaaatgagtggtgtatggttgtgattggataagtagtgcatgtaggtgggaaaagttaatggtggagggttgtgattggatggaaagagaatgttggtggagaagttgttatatttttggacaaattctgatgactaaaagttgttatattttgggacgaagggagtaaaaaaaaactatttgtcagaaaaaataaacaaagaacatacaggtatgcaagtttgcacctacggttggaaaaaagaagcgatcaatcctcacttctttattttctctggttgttcactatttaaaattttataaagcatatgatgtatcttatctataaaaaatataacatccatattacctatatttaattacagaaagttgtgttttaataaccgacaactaaataagatccgaagccgtcaagtaacactccaataaattagagaaaataatagaaattatgaagaaaaaacaaaaaacatcaatttccacttatatatggtgaccaattgttttctactagcaatatttatgtatgtacatacatattgtttttaaatactttgatgatcatagttatatttcattaaacttcctgtatacgcttctaatccaccacgtggcaccctataaacacttatgattcatcacgtggagttctaaaaaaacagagaaattcaaccgtcgattttcattgagattaataaaccattattctccctctttccatgcctctgtgcggcgttctcactctgtaccaaacctaccattcctccgttcctttcttttttttcttatttgataattaaacttataattttctttatgggcctaaaaaattttatagatagacatcgaccgactagatctagcaagctcttactctatactctctttatagtacgttaaacatcataaaaatatttctaaataaccacatgacacactaaaattagagaaaataaaaaaataaaacattcgaccatcaatttcttcttaaaactatcacatgatataaaaaaaagtttgagatttatccacgtcatcatgagtaaaacttttatttccagtatacctctacaaatgcttgtaggccatcttatagcgatggacataataaactactatgattgttttaatgcctaattcttttaaaaaaagaagataaaattgtataggtattgcaggcttcgcattgaagattatgcacaaacacaccgtgtaaaccaactaacacacacacttttgaagaccgtgtatatatatattgggagcaagaaaaaaaaacataattctaagacagttatactcttaagaccgcaatgtagcattgaagcttttacacataaaactattttagtggagcacttaacccgtaagatagtattgaatcaatatactcccttcgttatagaaaaacatagctcattttacatcataatgatatttttattctttcaaaatttttatatttatcttcatacaagtcatattaaacacaccaagagacagataattataattcaattcagtaaattctatcctttaaagtaacttccatgggtttctctacaacctgcatgtataagcctctaaggtggcaatataaaataagtagcctttcttataataatattattaaaagttattttttcctaatatattattattttacgattcatgttggctaggtcttttccttaaaaagaagcgctatataatatatgtatatttgatcaattaaaaagagggctagcaggatggtaaaaaaattaaatttacaagcaataaaagtttctcgagtcttcttaaggaaaaaaaacttaacaatgaacattcaattaaaaatgaaaaataccctattttactttcaacttactttgttagaagtattttcgaaataaaataatatggatgcccgttagaagtattttcgaaataaaataatatggatgcccgcgcggatgcgcgggctaccttcttagttatatgctaattgtctttcacttaaattggcgggtccaatattataaaccattagattcgattaatctgaaaacaaaccatacactacatgaacggtaccacctatcctccttccccgtaggaaatagaatccaacttttaatctacccttaatttagttgtcacccccatcatgagttcgttagaagattcaatcacaggaactttgagtcccttgctcttagcgattttcacttgtaaccatattgcaaggtatatgtgcagatggtatgcatgataattagctaggagtagtttattactttgttgatacaaaagcaattcaaaacagttatcaaattagtctttcttttattcaaaagtcgatgaatggttttttatatatattaagaaaaatatataacccatgaatcattttaaaatgacattgtccaatcttcagtttgcccttaacctatatataggagataattggatcacacacctgggtccttgatttgtttctcaaatctttctacccaatgatcagactacctagctagctcctcttcttgatctttgtcttcttaacatctgttacgagcaaagcgatcacctgtttgttcacaaaaatcgtttgatcaacatgaatagagattaggaaagaaagaagagtacagatagagtaccaaatttgtctcccgaattcaaacaaaaagaactaacagaaatttggaagagtacaacccccaatttcagttacttcttttcctaggtagaatgaagggctgatgaactcgcttttggggctatacgctgcttccaagcacaagagcgctccgctaaccttctgagaaattacttatatagaggaaccaggatgttcgttcagaacatggtaggaaattaaaagaggccgttgttttgccaataggacaaagaaaagatgccagtaggaattgttcatttcaatccatatgtttaactcaccagtcagcttcgttgcaaagtcagaactttttaatgtaagagcgtcacgaactgagagggaacgattggactaatatatattcattgcttaacggtaatagacataatcccatgcgcagatcaaaaacagcgcattgacatcttaatatattggatgaacagatttggcctctcagcccgatgccttcttttgagtagttcgctctcgagctgaaatatggacttctaaaacttagccttttacatcttggcttttgacactacaaggaaagacaaatagatctaatattatgaatgatagcagtatcattgtgtcaacaacacccatgggtggacctcatccagatgctgttacgggaaggagaaaagttatccatgtcctgagtatgtaaaaccagcaagcttgatgaccatagtaatcaacggaggtacagcaaaaaaaaaaaaaaagaaagataagataatatgccacttggagttgtccatttcaatccatatattcaactcaccagtcagcttcaatgccgagtcaaaccttttcaatgtaagaattccatgacccaaatgtggtatgtgttcttggtttaagaaattcgtgtgctgaattcttagctttggatgttgcccttgacaaaccacggcaagactaggttctgtcacattgagcttgtctcggatcacagtagaattgtgttatcccgatttggttctgtcacattcaaaaaataaaagatagttcagtctattgaatgcaccatggagttgatagtgaactgtactagattaggagttttatatgagttcgtttcgttgataatgaggatttttattactgattcttccctttttgaataaatacaaatcaacctagcatctttctgtacatgtgtttaactttgtgacagaaaaatattctccctcgtgaatcattcaaagttactgcgtgtaacaatttctactgctctgaaattagagcaatactggcaaatttatctagcaatatctgaaacaatttctagcaatttttaacaaatttatctattattctagttaggaaaaaatatgaattaccccccgaattatcgcggtcggccgaatttcccctctgaaccagaaaaccagacatgactcaccctaaactttcaacaccggacgaattacccccctcgacccaatccatagcggttttatcctatgtggcgtacgcgtggcaacccagtcggcattttcttttttaaaagatgttggggcccatctgtcatatactccccctctctcactctctccctctccctcttttggcgagcacggcaggcggcggctgcagcctgcggcgtgggatgcgaaggtggcgtgggacactaaggcggcggtggtggcagcatgggatgtggaggcggcgccggcggcgtgggatgggaggcggcagcagcgcgggacaccgaggcggcggcggcggcagcatgggatgcggtggcagatgccagccatatccccaccgcctctcccattttgcagttccgccacgaccaccaccgacaaaggtgacgcaggtagcgtggtaaacgaggcgatgcagccgcctctcaggtggcccggcgagctttcgaaggcggccgtctcgatgtagtgcgctggccgtctcgatgtagccgcctctcgacgcaggatcccgacgccgccgggaggggaccgggttgtcccgcgtcccgccctgccgccacctccgcgtgccgcaccgccgtcgcctccgcgtcccgcgcaccggtggtcgaagcctaccgcggtggcctccgctctcctctcctcgctcctcctcgccgccattaccgtgcccaccacaacaaccaccctccagtcctcactgnctcgctcgctggtgtcctcctnctcctcgctgccacccgggncaccacagacgccggctccccacccaagagccgctcgcccactacaccgccgtatcccacgccgccgccgccgcctcccatcccacgctgcagccgccgccactgcctccgcatcccacgccgcagccgccgcctgccgtgcttgccgagtgagggagagagagagagagtgagagaggggaaggagagagagggagtatatgacaggtgggccccaccatcttttaaaaaataaaatgctgactgggttgccacgcgtatgccacgtaggataaaaaatctttggattgggtcgaggggggtaatttttgtctggtattgaatgttcagggtgagtcatgtccggttttcgggttcgggggaggggggggattcggaaaatatattgtgattgtgaaaaacatattattttgtaattgtttggtttgcattaacaaatattgtcatagcgttagcacgggcaaattactagtatttctagctatcattcataatattagatctgttttgtctttccttgtagtgtcaaaagccaagatgtaaaaggctaattagtagtattatgttttattcatggattcatctaagtttagaagtccatgttgcaagtcgacaatgaactgttcaaaagtagggttgtagtgttaaaaggagggttgatgaccaaagtaatcaatagaggtgtagcaaaaaaaaaaagagaaagataaggggatcctttagagtgggctgctaggcacgctaaatgagttgtntgttgtctaactagnagttgatcacaaatgcctcttggngggggggggnggnatggatagaaatatgtaaaaaagtatttatagtgatgtaggtgctgttgcganctggtcaagacctaatagactcagatgtcgttgtc

SEQ ID NO: 402 - DNA, 946 bp, Oryza sativa
  unsure (1)..(946): unsure at all n locations
ntttgatacgactactataggcgaattcagctcggacccttaagtggagcatgcgcaggaacttcaacactataattcttcgtcatcaaggattgtcgggtatttccctcttgggtcatgacactcttatattgaaaaggtttgactcggcattgaagctgactagtgagttgtatatatggatttaaatagacaactctatgtggcatattatctcatctttctttttttgctatacctctattgattgctttggtcatcaacccttccttttgagcagttcattgtcgacctgcaacatggacttctaaacttagacgactccataaataaaacataataatgctaatttatccttttacgtcttggcttttgacactacaaggaaagacaaacagatctaatattatgaatgacaacaatactagtaatttacccgtgctaacgctatgacaatatttgttaatgcaaaccaaacaattacaaaataatttaactagaataatagataaatttgttaaacattgctagaaattgtttcagatattgctagataaatttgccagtattgctctaatttcggagtagtagaaattgttacatgcagtaactttggatgattcacgaaggttaatattttcctgtcacaaagttaaacccatgtacagaaagatactaggttgatttgtatttattcaaaaagggaagaatcagtaataaaaatcctcattatcaaccaaacaaagtcatagaaaactcctaatctagtgcagttcactatcaactccatggtgcattcaatagactgaactatatatcttttattttttgaatgcgacagaaccaaattgggataacacaattnnnnnnnnnnnnnnnnnnnnnnnnnnnnnnnnnnnnnnnnnnnnnnnnnnnnnnnnnnnnnngagaagtcgactatcccacg

SEQ ID NO: 403 - DNA, 1262 bp, Oryza sativa
  unsure (1)..(1262): unsure at all n locations
caacgcaaacactttattttgtaactcctgataatattcttctacagatttatccccctggtctgagcgttgcaatttctttaaaagatcacgtctaaaagaaggagcacaaatctagtgtgcatatagttgtctttaagagcaggtataatagcagactataagcaagctataaacacatatcaagaagataaaagaggagagagaagagcagcgggctacagatttgtagccagcaacagcacagactccaagacataatgtatgtgtgacaagtgggatcatatattaatagtgtagtatatgtttatagataactattgtatatattggctattaaattgaccatagatgatttggagctaatagttggttatactattaaacttgctctaacgcttctcatgttgtaggtgctagtccatcaatacttatttgagtccatcacaatgttgcaaaatcattaaattcactagtagcttgcctaaccctatgctcatcaggaataaatgtgcactaaattttttatctacagtcatttctcaatcaaaataagcttcagcattataggcaccatgaaaagagggaatcgtaaacttaactttaactttagcatatggatcatcacacacattatgaaaattacctccaatacctcgacgattgaagctcagcaagtttctatcaatattatcctattttagattcaccaacctgtcgagacaattattgatcgttgtaagattggcattcagcatgcgctggaacctctcggtagaggtttgaaccatcctctcgatcacaacagtcatatctctgttgatagctccacattggtctttgaggactttgacaagttcctccctgagcacgcagtccttaaatttatcgttggtgcatgacatggttagtagaatatagaaaatagcacaaggatattatccctatcaactactaggtgatgagagaaagacacttgcactcaagcatcttaccacacgcatacacgtagcaagagatgcaaccagtggcgagaagaatcacagtaggaagtatagtgctactatgcatttttggtggttatcagttgagtacttgagttattttatcttggacctccttgcatcattgtgcaggaagtacagccataagtaggcatgaaaattcgatctgnnnnnnnnnnnnnnnnnnnnnnnnnnnnnnnnnnnnnnnnnnnnnnnnnnnnnnnnnnnnnnnnnnnaggaggttcatcaataggccgc

SEQ ID NO: 404 - DNA, 1240 bp, Oryza sativa
  unsure (1)..(1240): unsure at all n locations
agagtttgaacgccagctggnnnnnnnnnnnnnnnnnnnnnnnnnnnnnnnnnnnnnnnnnnnnnnnnnnnnnnnnnnnnnncttggggataagacgacgtccgtggtggtcagagatcatgcgggatactaaggctagagttgatgtacgtggttgatggagattccatatggcatacgatggagttattgtgtgcgtatgggatgcggagtcgaatttggaagcagtccaaatttggtacgattggttatctaaagtttctttcttgtactagagggtttcctaaggtgtttaggactcctagtatgagtttggttcgtggctttaggctgcctaccttgggtataaatagagggggagcgtgaggcttcccgatatcgtttttgagagcaattgagttgagttttgagttagggtttcgagtttagtcgaaatttttgtaaggagtgctgttggtgcactttgtaaatacaaagagaagtaataaagtcgtcatccactttaagagttcttcgatttgtgcttcaccgggtttcggcggtttaactggcaactaaccggcggttagaccggtggcatcgtggcggtccgaccggcgggagcaaggcgctcaaaccggcggcggcaacagcaagcggcagatgatctcggtggtcagaccgaagatctaatctcggtcagaccgacggcaaccaggcggtcagaccggcagggcaatttcggtcagaccgcaatccgtcgaattcgagggtaacttttatttccgctaaaagtttttggtttttgggtataccaaccattcacccccctctggttggcttagttcttgtcattcgatcctacaagtggtatcagagtcttgttttcttctttggatttttatcgatctagagtttttgccatggctactcccgctcgtttttcaactaagcctcatgttttcgatggaacggatttttctcattggtgtagtaggatgcaatcttccattatgggtgaagattatgatatttggagaaaagtttcccatgcttatgtgattcctgaagctattaatactgctgctgaaaaaccggcttttgaccaaaattgcaaagctcgcaacattcttttgagtggtattacataattctgattatgatcgtgttgcgcatnnnnnnnnnnnnnnnnnnnnnnnnnnnnnnnnnnnnnnnnnnnnnnnnnnnnnnnnnnnnnnncaggcggtatctaatccgcagc

SEQ ID NO: 405 - DNA, 771 bp, Oryza sativa
  unsure (1)..(771): unsure at all n locations
cggagcntttgtttggnatgngatcgtnnnnnnnnnnnnnnnnnnnnnnnnnnnnnnnnnnnnnnnnnnnnnnnnnnnnnnnnnnnnnnnnnnnnnaaaatatttgacgccgttgactttttagcacatatttgactgtttgtcttattaaaaaaatttataaaatatgtaaaactatatgtgtacatgaaagtatatttaacaatgaatcaaatgatatgaaaagaataaataattacttaaattttttgaataagacgaatggtcaaacacgtacttaaaaagtcaacagtgtcaaacattttgaaacggagggagtacttgtagactcgaccaaatctcataattggtactccctccatcctaaaatataacaacttttagccatcaggatttgctaaaatatagcaacttctccaccaacattctcttcccaaccaattataactttccaccattcatgttttccgcctatctccactactcatccaatcacaatcctccaccagttacttctacctacttttttaataaccgtgtccaaccctaaaacttcttagaggcttctccggtccagcgttctgtacctcgaggtacatgtaacgtgaggtaccgattacaatccaaccgttgatctctagaggggtacgatgggtagtgaacgaagagaaactcaacgacgcgcataggctgggcaccgacaccaacagggcgaaagggacgggtggcaatcaaccagggccagcctggtctgggcttccgacgcctcgg

SEQ ID NO: 406 - DNA, 733 bp, Oryza sativa
  unsure (1)..(733): unsure at all n locations
ccggcttgatttcgaatcgactcacttctggcgaattcgagctcggtacccatactcacgccatcgtaaaatataaggacctagtaataatgagaaataccctagtactacgaatctggacaagtccattatccaaattcgtggtactagaatatgtctcatccagtactaaattctaatattatagaacatagcgagtatcatatctgttaatttttttaaatatgttcataactatttaaaagacacgcaagcagcgatactaattggttcgactgtgcaaacaaacaatagcgaagcatggtgatgaaatttgtgatagtttaagcaacaatagtttaaaagaaatcatttcccatgatctcctgatctgatcctccattgtcagagtctggccacctaccacctcacatggtaggttataccattttctctgccacccatgatgatgaaatttctcaatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgn

SEQ ID NO: 407 - DNA, 738 bp, Oryza sativa
  unsure (1)..(738): unsure at all n locations
cacgcgcttgattatatttgcagatgacaanaggccgaattcgagctcggtacccttgaggtcaccgtagtagtcgtcgtagtagtcattgtagcaagcgaagatatcgaagtcgaagtcattgttgtagttgacgatttctggtttcgcttgagatccgatgttaggggagctaagatagctggcaatttcgtccgtcgagcaagagctgagtggttggaggatgactccgacctccctggagctagatctgatctagctcaaagtcagattagatcgagacctagggggacgatttccttgagccgaaaatggccgcgagatcgtcagggaggcgcatagtgataggcggatatcgtggcatttaagcaaagctcactacaagaaatcttatcatagatgacgcttcatttacgtcacaaaaacataaaattccgtcatgttttgtaatatgcgacgctcgtgtgaaaaaaattcattcgtcacctatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 408 - DNA, 808 bp, Oryza sativa
  unsure (1)..(808): unsure at all n locations
gtgggacattgttgatcgncttctttnnnnnnnnnnnnnnnnnnnnnnnnnnnnnnnnnnnnnnnnnnnnnnnnnnnnnnnnntctttctctcatcacctagtagttgatagggataatatccttgtgctattttctatattctactaaccatgtcatgcaccaacgataaatttaaggactgcgtgctcagggaggaacttgtcaaagtcctcaaagaccaatgtggagctatcaacagagatatgactgttgtgatcgagaggatggttcaaacctctaccgagaggttccagcgcatgctgaatgccaatcttacaacgatcaataattgtctcgacaggttggtgaatctaaaataggataatattgatagaaacttgctgagcttcaatcgtcgaggtattggaggtaattttcataatgtgtgtgatgatccatatgctaaagttaaagttaagtttacgattccctcttttcatggtgcctataatgctgaagcttattttgattgagaaatgactgtagataaaaaatttagtgcacatttattcctgatgagcatagggttaggcaagctactagtgaatttaatgattttgcaacattgtgatggactcaaaataatattgatggactagcacctacaacatgagaagcgtttgagcaagttaatagtataaccaactattagctccaaatcatctatggttcaatttaatagccaatatttacaataagttattctattaaaacattattacttaccaccctaatttaaaaattaattatattgggaaaatcccccc

SEQ ID NO: 409 - DNA, 1201 bp, Oryza sativa
  unsure (1)..(1201): unsure at all n locations
atggcanngttangatcgcctcctctgaancnnnnnnnnnnnnnnnnnnnnnnnnnnnnnnnnnnnnnnnnnnnnnnnnnnnnnnntcctattgtcgagccaactttccctattttctaacggacacatcatgtgtcaataataatgatcggatagttaatgatcatgactctcaaagatacatgcattattctcaacatatttgcattacgatgagttatttacaattaaatacataattcatgatccatttacccatattcactatatgaaatcttgataacgcatctgttctgactacaaatgttcgagtctaaattccagattcaatcaccaccaaagagcttggaaccatgatacatactctgggcctaaactcaacggaggcggaggtgcaagatattattaggttgagtacattagatgggtttgggagctaatctctcccacacacgtaaaacgaagcagctcattacattagaatattattaattaaatattaattatttattttataaaatggatttatatgttttttaaagtaatttttctatagaaaacttttagaaaaaagcacggcttagttgtttggaaagcgtgcgcacgaaaaacaagggagctaagttgggaaaggagtgggaagaacacaaccttagtgaggtggacaccgatcgaagcactagcatcgactttccatgactttcttagcctaatagcacgctacatgattatgtgaagcacaaaggactgagatgagggccggagggagacgttccgcatctccgacaagtactagaaaacagtgtcatttctatcgctgaggagttcaaaattaaattcagaaaaatagcaatttgattaaaattctcattcaaaaatttagaaaacccaataaaactataaaaaatgtataacaagattccatgtagaatatgaaatatcaacagtccatataaaaatataagttataaatatctgaaatttggaataataaaataactattaaaaaatgagtccaaatacaacacgatacgaaattaagtataaattaaaatccttaaaaagaaaaatctagaataaaacaataatttgatttgaaacaaattcgaaattagnnnnnnnnnnnnnnnnnnnnnnnnnnnnnnnnnnnnnnnnnnnnnnnnnnnnnnnnnnnnnnnnnnnnnagtgaatacaatgccgg

SEQ ID NO: 410 - DNA, 822 bp, Oryza sativa
  unsure (1)..(822): unsure at all n locations
attttttgtaagaagtcctgttggtgcacttggtaattcacagagaagtaataaagtggtcatccactttaagagttcttccgatttgtctttcaccgggtttgggcggtttaactggcaactaaccgcgggttagaccggtggcatcgggccggtccggacgggcgggagcaagggcgctctaacccggcggcggcaacagcaatcggcagatgatctcggtggtcagaccgaagatctaatctcggtcagaccgacgacaaccagcgggtcagacgggcagggcaatttcggtcagaccgcaatccgtcgaattcgagggtaacttttatttccgctaaaagtttttggtttttgggtataccaaccattcacccccctctggttggcttagttcttgtcattcgatcctacaagtggtatcagagtcttgttttcttctttggatttttatcgatctagagtttttgccatggctactcccgctcgtttttcaactaagcctcatgttttcgatggaacggatttttctcattggtgtagtaggatgcaatcttacattatggctgaagattatgatatttggagaaaagtttcccatgcttatgtgattcctgaagctattaatactgctgctgaaaaaactgcttttgaacaaaattgcaaagctcgcaacattcttttgagtggtatttctcgttctgattatgatcgtgttgcgcatcttcaaactgctcattnnnnnnnnnnnnnnnnnnnnnnnnnnnnnnnnnnnnnnnnnnnnnnnnnnnnnnnnnnnnnnnnnnngttctcactgcgcgc

SEQ ID NO: 411 - DNA, 4134 bp, Oryza sativa
  unsure (1)..(4134): unsure at all n locations
cttaaaatgttggtcgtaagccccccggggaagaggtatccattgtaatcccgtggtaattccatgcatgggaccttccgtatgttcctgggcccgaaataaaggcccaattcttcctcgatgttaaggagctccccattaaagagtgttgcaaaacaattgaaatgggctatccggaattaattgttgtccaccggcaatattgctttcctttccgagagttccctttcccggtaggtctcccttccatggcgtgattcaggtaccccgattggccaaggttcttgaatatattctccgcaaaattctattgtcctcctttggtccataaccccttggcgatgcttgcctctggacgagcacgggttacaaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgtttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagtagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacaagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtaaaaaaaactgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccggaactaaagttaagatctttagtcccggttggtgctaccaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtgatttttttcaattatgtaagaatgctactcgaatgataattctatggtatttttgtaattttttaatagcagtcttgcaataacgtggaattcaaaccaatggtaaatttgtaattgcgtgtgtttttgatacaggaattttgacaccactactatttagacccatcactgttctcttatttttatcagttagctcttttgtggatcttcttgtgtaaagtcaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaataccatgg

SEQ ID NO: 412 - DNA, 793 bp, Oryza sativa
  unsure (1)..(793): unsure at all n locations
cgcggcatagatcgcctnnnnnnnnnnnnnnnnnnnnnnnnnnnnnnnnnnnnnnnnnnnnnnnnnnnnnnnnnnnnnnnnnntgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagtaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctggttcttgtggatattggtcgagcattgcgacgtttactttccgagggtcgatgaattcagtatcgaaaacccttcgccgtcgggcctttgaatctcattt

SEQ ID NO: 413 - DNA, 6215 bp, Oryza sativa
  unsure (1)..(6215): unsure at all n locations
cacggcnattgattgnnnnnnnnnnnnnnnnnnnnnnnnnnnnnnnnnnnnnnnnnnnnnnnnnnnnnnnnnnnnnnnnnnnnnnnnnnccacgtaggataaaaaatctttggattgggtcgaggggggtaatttttgtctggtattgaatgttcagggtgagtcatgtccggttttcgggttcgggggaggggggggattcggaaaatatattgtgattgtgaaaaacatattattttgtaattgtttggtttgcattaacaaatattgtcatagcgttagcacgggcaaattactagtatttctagctatcattcataatattagatctgttttgtctttccttgtagtgtcaaaagccaagatgtaaaaggctaattagtagtattatgttttattcatggattcatctaagtttagaagtccatgttgcaagtcgacaatgaactgttcaaaagtagggttgtagtgttaaaaggagggttgatgaccaaagtaatcaatagaggtgtagcaaaaaaaaaaagagaaagataagataatatgccacttggagttgtccatttcaatccatatattcaactcaccagtcagcttcaatgccgagtcaaacctttccaatataagagtgtcatgacccgagagggaaatacccgacaatccttgatgatgaagaattatggtgttgaagttcctccacatgctccacttgaacgcttagcacttgcagcacaagtatggtcttgtagtttgcggtatcgatgactcctaaaatctccccatcatcaatttccatctcaggaacattggtttcacatagaaggttagcagcaagagaatattcttgctcaacatcactagaacttgcatatccaccatcatccgtagcgatgtatgcatgctgacttgtacaatccttcatgacatgtcacatacccttgcattggtgtcgtatgatccgattgtttgccccgtagaagctactgacgaggtacttttcgtgggtacctacactttagtagacttgtaaaatcaaagatgtttttgattattattctgtgatgaacaattgggcattggatattattggttttattatttggaatttattcacgaagtggttttggagatgattggatttcataggtgaatatacaggtagtgctggatttgggtccggtcagaccgggcacgggttgccggtcggaccggcgtgtattgcgcggtcagaccggcgcagcccactgtctgaccggccgacgctgtgtcggtttcagtttcgggttgtttatttggatatccatgattatttcataattatgacttctagatggatactatacgtatgtaatactattgtttgctgctaatgagtcaagttggagatagcttggtctcggaatatggtttctttgtttgttccatgtgtaggtgattcgatgtctctggagagtatttgcggtgatggaccgggagtcggcttggggataagacgacgtccgtggtggtcagagatcatgcgggatactaaggctagagttgatgtacgtggttgatggagattccatatggcatacgatggagttattgtgtgcgtatgggatgcggagtcgaatttggaagcagtccaaatttggtacgattggttatctaaagtttctttcttgtactagagggtttcctaaggtgtttaggactcctagtatgagtttggttcgtggctttaggctgcctaccttgggtataaatagagggggagcgtgaggcttcccgatatcgtttttgagagcaattgagttgagttttgagttagggtttcgagtttagtcgaaatttttgtaaggagtgctgttggtgcactttgtaaatacaaagagaagtaataaagtcgtcatccactttaagagttcttcgatttgtgcttcaccgggtttcggcggtttaactggcaactaaccggcggttagaccggtggcatcgtggcggtccgaccggcgggagcaaggcgctcaaaccggcggcggcaacagcaagcggcagatgatctcggtggtcagaccgaagatctaatctcggtcagaccgacggcaaccaggcggtcagaccggcagggcaatttcggtcagaccgcaatccgtcgaattcgagggtaacttttatttccgctaaaagtttttggtttttgggtataccaaccattcacccccctctggttggcttagttcttgtcattcgatcctacaagtggtatcagagtcttgttttcttctttggatttttatcgatctagagtttttgccatggctactcccgctcgtttttcaactaagcctcatgttttcgatggaacggatttttctcattggtgtagtaggatgcaatcttacattatggctgaagattatgatatttggagaaaagtttcccatgcttatgtgattcctgaagctattaatactgctgctgaaaaaactgcttttgaacaaaattgcaaagctcgcaacattcttttgagtggtatttctcgttctgattatgatcgtgttgcgcatcttcaaactgctcatgagatttgggttgctttaagtaattttcatcaaggaacaaataacattaaagagcttcgtcgagatcttttcaaaaaggagtacattaaatttgagatgaaacctggagaagctttggatgactatctctctaggtttaataaaattttgagtgatcttaaatatgttgattcttcttatgatactaattatcctcaatctgagatctctcgccactttttgaatggtcttgacatgtctatttgggagatgaaagttatatctatttaggagtctgttaatatgtctactttgactttggattcactttacaccaaattgaaaacacatgagatgaatgttctttctcgaaaagctgattctaagtctagtgctttggtttcttctacttcttcttcggttgttgatgcttcttcatctatgccttcttttcttgccacttttaatgccctatccgatgatcaactcgaacaaatcgaggaggaggatttggctttggttgctaaccgtattgctcgagctgtgaataatgccaggaacaggaaaagaggtggtccaaataggagctttgaatgtggttctattgatcatcttcgttcgcattgtcctaagcttgggagaggcaaaagagaagacaaagatggtgagaagacgaacaacaacatgcccaacaacaacaggtcgaagggctcatctcaagggaggaagatggagaatcttagaaaggcttttcaataagtttgcgccgctttcgagccactaagtgatgtagatggtgaaagtggagatgatgataaagggaagaacatctccgatgtttgcttcatggcgcgtggtgaatctgacatagagtatgaagataatgagttaagtgcgtttgaggaagctattaatattttgagtgaaaaaaaagaagtgtgagaagatgtgtagaaaacatgaatttatcattgaatctcttaaatctgaagttgctagattaaaatctcttattcctaatgatgatgattgctcaaattgtgaggttttaatgaatgagatttcaaaaattagagatattaatgctgcacatgatttgaaaaatagatcttcttttgcttgtagtttggccttgcatacacgcactttggatgagttgtttttaactaaaaagttgttgcaaaaaaaatatcaaattgcttttcatgctagtttgatgtttaacatgatttctgctaaaaagttaaaacaaccttatggtgttttggattgctcaacatgtgatttgaataagatgaaactaaaagatgctttaggtcgtgttaagtacatggaagatgttgtgaaaaacaatgaagtgctttcttgccccaaatgtcgtaaaagcaaaggtgtcatggtagattgtgaaaattgtgctaatttggaaaaagaggtttcttatttgaaaaattcttttcaaagattttctgatggtaaaaagaacctcaacatgattttggatcaatctaaggttagcacacataaccgtggtttaggttttgacccttatgctcataattctagacatcctcctattgtgttagctgttggtgctagaagtggtgagattttgattaaacatgatactaataaaactgtgtttaaatctgctggtatcatgtctaccatgaatgcatcttcttcaaaatccaatgttgagcatgcagaacctcctgtttctgcttgtgttgctaaatcttcttgtcctaacaatgtgtctaaacaacgtgaaaaatatacttgttctttttgtggaaaagatggacatattgttgatttttgtttcagattagctcataaacagaaaaaggagagagagattgcttttgcaaaatcaaagtggcaaaaatctggttttccctcgaggaaaccggtcaaaccacagtgggtcccgcggtcagaccggctacagatcctcggtcagaccgaacatcggtcagaccggcggtacagtggcggtcacaccggcccctggtcagaccggctactataccttggtcagaccgacctcggaggaatttttctgaaaattctaaaattgattttgcacgtggatatatgcctattggatcttttggtcgtgtgtctcagtactggattcctaagtttttattattatctaaccctagtactgaggcttcgacttctgcttgtgtgtaggctttggtggcaaggaaggagaacgtatggatcgtggattccggttgttcgcggcacatgaccggtgataaaaattggttctcttccctcaaaaaggcatctaagactgaatctattatctttggtgatgcttctacaagtaccgttgtcgctacaggtttggtaaagataaatgaaaattttgaattgaagaatgtagctttggttgaggatttaaagtacaatttgctttcggttttacaaattgttgatgaagagtttgaagttcactttaagaaaactggaagtaaagtttttgattctcgtggtgattctgtgctgaatatttctcgttatggaagagtgtttaaagctgattttgaaaatcctgtttcacctgtgataacatgtttggttgctaagtttgataaagatgtgatgttttggcatcgtagacttggacatgttggttttgatcatctcactaggttaagtggtttggatcttgttcgtggtttgcctaaacttaagaaagatcttgaattggtttgtacaccgtgtcgtcatgctaaggtagtttctacttcacatgctcctattgtttctgtgatgacggatgcactgggacagctattacacatggacactgttggtccagctagagtgcaccgttggaggaaagtggtatgtgttggttattgctgacgatttttctagatattcttgggttttctttatggcaactaaggatgaagcttttcaacactttcgtggtttgttttttcgattaaatcttgaattttctggttctttgaaaagaattcgaggtgataatggtggagattttaaaaatgcttcttttgaacaattttgcaatgaaagaggtcttgaacatgaattttcttttcctcgtgttcctaaacaaaacggtgttgttgaaaggaaaattcctgttttggttgagatggctagaactatgttggatgaatacaaaactctataaaattttgggctaaggctattaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 414 - DNA, 18824 bp, Oryza sativa
  unsure (1)..(18824): unsure at all n locations
ccgcccactgaagacatttgaataaaacannnnnnnnnnnnnnnnnnnnnnntgctcctttgcacattcaacgacgacatccgccggaacaaatcattggtaatataggtgagcggactacaaggtctaaggtaacggctcatgatgtttgtgcaaattctgcatttgttgcttcttttgaacccaaagatgtttcacatgcattaactgatgaatcgtggattaacgccatgcatgaagaacttgaaaattttgagagaaacaaagtttggactttagttgaaccaccttctggacataatattattggaatcaagtgggttttcaaaaataaacaaaatgaggatggtttaattgtgagaaataaagctaggcttgttgctcaaggttttactcaagttgagggtttggattttgatgaaacttttgctcctgttgctagaattgaggcaattagacttttgttggcttttgctgcttcaaaaggttttaaattgtatcaaatggatgttaaaagtgcttttctaaatggttttatacaggaggaagtttatgtcaaacaaccaccaggttttgaaaatcctgattttcccaaccatgtttttaaattgtctaaagctttgtatggtttgaaacaagctcctagggcatggtatgataggcttaagaacttttttcttgcgaaaggttttacaatgggaaaggttgacaaaacgctttttgttcttaagcatggtgataatcaactgttcgttcagatttatgtggatgatatcatctttggttgttcaactcacgctttggttgtagattttgctgagactatgcgcagggaatttgagatgagcatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctacagctgtgttggatcctgatgaagatggtgaaactgttgatcaaaaggaatatagaagtagattggatctttgttatatctaactgcttctaggccagacatacaatttgctgtgtgtttgtgtgcacgcttccaagcttctcctcgtgcttcatatcgtcaagcagtcaagcgaataatgaggtacttgaatcatacacttgagtttggaatttggtattctacttcatcttctatatgcttaagtagatattccgatgctgattttggtggttgtagaattgataggaaaagtactagtggaacatgtcattttcttggtacatcattaattgcatggtcttcaaggaaacaatctagtgttgctcaatcaactactgaatctgaatatgttgctgctgctagttcttgttcacagattttttggcttttatctactttgaaagattatggtcttacttttgaaaaagtacctctcttttgtgataatacaagtgctattaatattgctaagaatcatgttcaacactcacgcacaaagcacattgatattcgctttcactttctgcgggatcatgttgagaagggagatgttgaattgcagtttttggacacaaagttgcaaattgctgatatttttactaagcctttggattctaatcactttgcttttcttcgtggtgaattgggcataattcatccttttggcatggtttgagggggagtttgtacctcatggttttatcaagcaataatatgataatgagaaaaatttataaacgagagctttgtttatgcatatggtattttcttgtgcatgctagcaatactttgaaggtttatttgtctctagcatagcttgtatgtattctagtcttttcatgagatttagattttgcttttcagggagatgatgcatgacacttaaattctatacttgaattaagaaaatatgcaatgttaatgctagcatatggtttgatttataaatgctctatatatatgctttattgccttgttattcctcaaatagttttaattgcttattgtgaaaaagaaaataaaaaatataaaaaaatgaataccgaatccttggaaacagtcttgacgacaaggacgtattcgatgtgagcaaaataatgggtgccgaatccctggaaacagtcttgacgacagggacgtacccggaataaaaaagagaaaaatatgagcaaaaaggctcaagaaaagaaaaagttaaaaattctctttgttgttttgtgctaaaggcttatttgagaaagagtgataattgcaataggtatatgtgtttagtgtttattcttcaacctatgtgcttgttaagatgttgcattataaatcgtatgaaatcatgaattatgattgttaattcaagcttaactgtaaaatctttggttcatggttatactttaattcatgtttgttatgttatagatgggttcattttctttttattgcaacacatgacgtaatatgctatatgtatgctaagctcttgaatattaatgaacataattcctatacttgatgaaatcattgtcaaaagggggagaagtaatgtgaaaatttttggagaagcaagattaatttttgagagttgttgagaagagcaaagagcatgttttttgttcaattgggaatttctttcttttaaaaagggggagaagttttcttttggatttttgagcacgatgtgtacatttgtacgaagtgtgctttttaccacttttgttttttttttccaaacaccaaaacatttttatgaatttgccaatgtgttcatcaagggggagattgtaaaatcaaaggtgtttttgattattattctgtgatgaacaattgggcattggagattattggttttgttatttggaatttattcacgaagtggttttggagatgattggatttcacaggtgaatatacaggtactgctggatttgggtccggtcagaccgggcacgggttgccggtcggaccggcgtgtattgcgcggtctgaccggccgacgctgtgtcggtttcggtttcgagttgtttatttggatatccgtgattatttcatgattatgacttctagatggatactatacgtatgtaatactattgtttgctgctaatgagtcaagttggagatagattggtctcggaatatggtttctttgtttgttccatgtgtaggtgactcaatgtctcgggagagtatttgcggtgatgaatcgggagtcggcttggggataagacgacgtccgtggtggtcagagatcatgcaggatactaaggctagagttgatgcacgtggttgatggagattccatatggcatacgatggagttattgtgtgcgtatgggatgcggagtcgaatttggaaggagtccaaatttggtacgattggttatctaaagtttctatcttgtactagagggtttcctaaggtgtttaggactcctagtatgagtttggttcatggctttaggctgcctacctcgggtataaatagagggggagcgtgaggcttcccggtatcgcttttgagagcaattgagttgagttttgagttagggtttcgagtttagtcgaaatttttgtaaggagtgctgttggtgcactttgtaaacacaaagagaagtaataaagtcgtcatccactttaagagttctttgatttgtgtttcaccgggtttcggcggtttaactggcgactaaccggcggttagaccggcggcatcgcggcggtccgaccggcgggagcgaggcgctcagaccggcggcggcaacagcaagcggcagatgatctcggtggtcagaccgaagatctaatctcggttagaccgacggcaaccaggcggtcagaccggcagggcaatttcggtcagaccgcaatccgtcgaattcgagggtaacttttatttccgctaaaagttttcggtttttgggtataccaaccattcacccccctggttggattagtttttgtgatttgatcctacaagacttactcacctcggtagctcgtggtggaatgaagacgggtgtcgatggagcttggttggtggaagacacaccagagcatgtaagaggagataccgtccttgttgaaatagcatttccaaaacggtactttgttgattgttgtcgtccctgcaattcttattctgccaaacatgcaagtagaaacaatcttcatattctttatagttaacaatatcttgaatctcacggttcaaccctccatagaaacttacaatactagcctcttcatcctctattacatcacaatgcaaacaacattttttaactcctgataatattcttttatagatttatccccctagtctaagcatgcaatttctttaaaagatcacgtctaaaagaaggagcacaaatctagtgcacaagttgtctttaacacttctcatgttgtaggtgctagtccatctgtacttatttgagtccatcatactgttgcaaaattattaaattcactagtagcttgcttaaccctatgctcaccaggaataaatgtgcactaaattttttatctacagttatttcccaatcaaaataagcttcagcatcataggcacaatgaaaagagggaatcgtaaccttaaatttagcatatggatcattacgcacattatgaaaattacctccaatacctcaacgattgaagttaagccagttgctatcaatctcttataccgatttcagggatcggaccctggcgctgattgggccacgtggcaaaacctgaacgcaagtttgcgtatggtaaaatcacgccacgtgtccagtataccattccagtgcactgccaatctggtgcgctgttccagcgtcgcacgggcgcacggccgctgcctcccctccgcctactgccaccggccaccgctgcatccttctcctaatctcgtggtcatggttgacagcagctccaaccatgctgacaggtgcacacgtcttctagaacatctttgctcaaagccagggcgcaaggcatttctggcatctgattttctccttaaaaatttgattaaacctggttagccacagaggcaagaaagctcaccggagatgcacacaagttaccaatatgggtgcccgtttcttgaggtgaatactgactcatctgtgtgtacttaattaaactgaaaaacgcatcttgatgtgttttttttaattcaaattaatttaacaaggtttccatgtatataatgagcagattaatttcctgttgaatgcatcggcgtaaccttcagaatattctaatcttgagcgaagaaaaaaaaaactcagcatttggtgtttgctaatggattgcaacaagcttatccaactccatgtacgttgaggacttgaccaattttaccgtgacctaaacacaacctatgtgtcaatggttctggacgttaatcaatcagatatcaatcgaatgactttgatagcagtgatgctttacacctttggtcagaaagctgctgcactaatcagcaacaggaaaaatgaaagaaagaaaaagaaagcatagcaaggcatttgaaacttaaattcagttagcattatgtgaataaaatttagcagttatataagctatttacatgattgttcgttaagatccaaaaccttttgcttatctgatacttcctccgtttcacaatgtaagttattttagtatttcccacattcatattgatgctaatgaatctagatagatatatatatgtctagattcattagcaacaatatgaatgtgaaaaatgctagaatgtcttacattgtgaaacggagggagtattaatgttatgggcatttgtcaagttgttcagaaaaaatattctttatcctttttatggcacagagtagtccaacaaaactaatccaagaaatcgtttctattatactcacatcagtaggacaattttgaccaataagagcagcagaaagaaattgccctttctattttgcttttaaaactagctttctttgatttttcattcttcacctctgcatggatgagtatcacaaccaggacatctgcttgagttaccctgtagtcacaaagacctttgtcttgataacaagctacatttcttttagatcgcatatacttgtatcatgctctcccaaaactatttgtttcatgttatattctaataactgagtcactaccttctcctatagagattaaaatttgaattgaagtctaccaattcttaaattcaagggttacattcttatgttccgtttcttcagaacacattcatgaccttatgtacttcattatgccatttacgttttcataagttaacatagagcgctgggtctgggaaatgcagatgcagaactgggacttaagagtactatacgattcggtaagagagcaatgctcatgccaaacaaggctgtggtaaattaatgatgtatcaccagacgatggattcggtgatactattatcgtcaatgaaaacattatcttattttctattcattacaaatagttaaatctccttatctcagcattaatgctaatctcaaagtattgatcgtgtaatatctttgaaacggaaacatttgatatgaacctcattggttttgtaaggggaaatacggtcgacctctcattgacaggaataaaagcaattaagtttgatgttatgtaaaactagattataagttctttaatgtaaaattttgtgattatgcacccccaatttttggttttggatgtatagatttagttatgatcaattcttatttacgtgagcattaggctttaatagtgtataaactgggtccatccagtctatgtatacttccgcgcggcaaagccgcggttattttctagtataatcctattgtagattcaccaacccgtcaagacaattattgttcgttgtaagactggcattcaacatgcgttggaacctctcggtaaaggtttgaaccatcctctcgatcgcaacagtcatatctctgttcatagctccacatttgtcttcgagtactttgacaagttcctccctaagcacacagtccttaaattcatcgttggtgcatgtcatggttagtagaaaatagaagataacacaaagatattatccctatcaactactaggtgatgagagaaagacacttgcactcaagcatcttaccacaggcatacacgtagcaagagatgcaaccagtggacagaagaatcacggtaggaagtatagtgctactatgcctttttggtggttatcagttgagttattttatcttggacctccttgcatcattgtacaggaagtacagccattagtaggcatgaaaattcgagctgcattatgtggagattatgggtaccatatacccacagggctacgttaattacctgactggatatcgggggtaactcatagtaacaaaatatgtaaagataaggactcgggtatcatgttaacttgtatatcaagaaagtatctcgtagtcttagtcagttacaattgtaaaatatttatagaacttagaccataagggataaggtcttttatcttgtaatcccgactccttcgcctatataaggaagggtcgggggccccctaagggcagaatcacatccaagatcgttagatcaataccacaatcggcggaattacttctcatcgagaaggcctaaacctgtattacttctcatcgagaaggcctaaacctgtataaatcctttgtctcataacccattcactttcatagcttcttcgccacccccttttgtaatgccgaaatctagtttcgatagttggcgcgccaggtaggggttgcgtcaagtttttcgccgactagtgcgatgggatctacatctacatcaagcattgacgatttcgtcttccctctcgggcagacattccgcttcggtagcctcgacttcatcactaatagcttcggcaagatctctcttctcaactcggattcgaaccagtcgggaggagatggcatctcggccccgttcggtctcctgaactcggctgagatctactccaagaacctatccctcgagttggtttcaaaccactcgagagactccgcagaagattcctccatggcatccagcaactataagaaatatgaccttctgtgacgaattcctcgtgatatcggagctatttatcattagcacattccattttatgatgattagtatgagatggggtggcttagtgacgaaaaaaatgtattcgtctttaataccaactagaaatcgtcacaaagtatttcaatgggatatcgtgatgaatattaatgtaataaggggcacaaagcaaacatcatagatttatataatgcatttctagaaaaatatattaaatgttaaagcaattccccactccaccgccgacctctgggaggcgaagtacgaggtgctcgtcgcatcgtcccgcaccacgggcgggaagccgctcacctgcatcccacaggcggcggctgacttgtgacgcttacggcagtgagctgtagcctcccgtggcttggcatccagcggttagagtgggggctgacagaccactatggtggcgagatctagctgctacgatcccctgtgaggcgaatgagctgcggccttcacaagtgacctcggctgctgtcccagccaggcctgacgatggtgagtttatttcctgtagcgaagctcttttccaacaaggccagggagtgaatgataatagtgatgcctaacttcaatgctattagtttactcaaatgtctaacgcattgtaacactgaaatgcatataagtttctggatgtaagttactgaaacaaaattgtcttacaaaaaacggccgatctcattgttggtttgcatgtactttttcattcaaaagctattgcctgattgcctaattctcccatgagttgttcatgagacattgcatatgctacatgatttattcagtagctaaagacagtttatttccttctcaattcagtaagtaaacacagggctaagttacactcagtttgtatttaatggtttagggtgatcatgccaaataatttgttaaattaattctaatagaatcttctgtcggaaagacatgcaaacctacttaaaagataaagtggagtatttatgattgtgatgaagtgatgcatattttattatgctaatttaattttccctgtgtgatttgtcgaattactagcatggcaaataaaagattaggttcattccatcctaacaaccatcacagtgttttttttttaatattctgtacatgtgtgtgcttctaaccgtggatatatataaccattgtaccatgtttactgcacaggttattactaaactatgcagctgcgatctttaattgtcaagatgtttatgcaaactaactagattcgtataattagattaacgatgtttggaaaagtttctggatttgcatagtcagattaacatctagcggaccccattgatattgggtggtgactggtgacgaggtgcagccttattaacagatgacctccgctaagcctaatggtaagttctacttcctgtatcctccattcctttgaaaacaggccatgagggagtgatatcattgaggcatagttctactgctgtcagtttactctaatatatttagcattttttcggatgaatttactctaatattcattctaaccccaaagtatagataatttttttgatgtagtaataacagtatagacatgagtcttatgtgtgtgtcaactaataaactactctctttgtttcccccttgcatgctctaatattagcgcttttaatatttcctgttctatactttgcttcccaacaatgtaaaacacttctttttgtataaaatgtcagtcatcgcttcattgaatattttgtttttgtccaactaatgcaatatgtttccaatcttaactggcctgtttttcctagctaccagaaacaaagaaaattcgtgttattaacacttgagttcactgcagtacttggtttgtttcctaccagaaactgagaaaatatacccattttaattgagttcatgcagccaacagtatactactactccctccgtcccaaaaaaggcaaaccctgggtttgcgtgtccaactttgactgtccgtcttatatgaaatttttttataatttgtatttttattattgttagatgataaaacatgattaatactttatgcgtgacttgtctttttaatttttttcataatttttacaaataagacgaacggttaaatattgggcatggaaattagggtttgtcttttttttgggacagagggagtaagtcttagcatgcgcacggaaaacgaaagtgagtttgcgcacggaaaacgaaagtgagttttcctctccttgtgctgctgctgaccgcaacatatgcttcgtcgcagataaaagatgtttgttaacttggatagaactaacaaaaaataaaatcatattggtattactgtcctttggtcctttacaagagtgaacgaatcttgatcctttagtcctttacaagagtgttttatcattctttctagctcctgcatcagaaacttctaagtttgttcatgggatattgtaatgatatggttatcctcatggaactaattaaaattagattactatgtgtgcatgtatattgccaggtcaacatgaaagtatgcttttcatgattggttgcgtacataagttaattaatgttgttcctttttacttgcagcaaaaaaaggtgctccatgtaagggactttgggggtactctcatggcatttggtttagagatttgaaaggatttgtgcttgcctaggtgtgagcaattggttggatttggctgttaactgggttataaattttgtgttgtattggatgtttgtcgggttgtgttggatgctaattgggctgtaacctttgtgctatatgggttgttattgtgtttgattgttgggcctatatgggcttagcccacttgttatttgatactaatgtaaatgaatataataagattggctgaaaatggtgtggtataatgtttgggcctatatgggcttttgcaatggacttggtacatttattatttgatattaaagcaaatgaatataatagaattaggctgaaaatatgccacatcatagatgggctaggctaaaatctagtcgggcttgccattgggctaagcccataaacagggtgttcaatacatggattttaatgggccatcagatattttatgacgttttttatgttagatatgagcgtcacaaagttatgatgacataaggattgccactagattaatgatgaaaaaaataagatttcgtcatagaacgccattagatatgcatgataggtgacgaatgaattttcgtcacacgagcgtcgcatattacaaaacatgacggaattttatgtttttgtgacgtaaatgaagcgtcatctatgataagatttcttgtagtgagctttgcttaaatgccacgatatccgcctatcactatgcgcctccctgacgatctcgcggccattttcggctcaaggaaatcgtccccctaggtctcgatctaatctgactttgagctagatcagatctagctccagggaggtcggagtcatcctccaaccactcagctcttgctcgacggacgaaattgccagctatcttagctcccctaacatcggatctcaagcgaaaccagaaatcgtcaactacaacaatgacttcgacttcgataacttcgcttgctacaatgactactacgacgactactacggtgacctcaacgatgactacacttcgctgtacttcggcgtctttatgaccaacaatgagacagacgagcagagggcagcacgactggcagacgaagaacggacaaggttagaacaagaacgctaggagcaggagtggcagatattggaacgtgagcgtctggatcaggagcgccgtacaagagaggaagaagaacaaagacggagagaagaaaagggaaggcggagagatttggctcaatgtggacgtcgcactcgacaactcattggtcagactgttgtagatgacaccaacgtgtttctcacacctcagcagaatgcagtcggggcaatcaccctcatcgacaccatcctgcctgaggccccagactacgtgacgccaactctcaacaggatgaaggccatgatcgcggcaacacttccggacgattatagtggcagtcggtaacccaccacctcggcgcatcatcagttaggaagccgagctagttggtctaattctcgcgcttcgcactcaagttgggggcttcgagagcagttggttcactctccagctgttggcaatagagggccccgagtagatcacgagcagcagaagtcttctcatggcctggttgatctcagagaagccttgaatgcaagacggagagcgagacacggacgagggcaccaccactccacggagtgcattgatggcaatgatgaaggagtcactgcattcacacgtgacctgcgtcgagtgaattggccggccagcttcaaaccgactggcatcgagaagtacgatggcaagaccaaccctgagtcctggcttatcgtgtacactctcgcaattcgcgtagcaggaggagacaacaaggcatggcgaactacctgcccgtcgcattggctaactaggccagaaactggctcgctgggttactgcgaggcacaatcggttcccggggcgagcttcgcgaccacttcatcgccaactttgaagggaccttcgaacggccaagcactcacttcgagctctacaatgtgatacagaagcctaatgagcccataagggattacatccggcgcttttcagagaagcgcaacaaaatctctaacatgaccgacggcaatatcatcaccgccttcaccaagggagttcgcaacgagctactcattggcaaattcggacgcaaaccacccaggacggtcaaggaaatgtttgagaaggctaacgagtacgccaaggcggacgacgcagtcttagcttcgaagcagtccggcagtggctggaagcccaagaaggacagtggcaacaacggtgcaagtagcagcaacactcaccacaaggatcgcaagtgtaagcccgaggatctggttgccgccacgtccacttttcagcatcaacgaattcgtgtcaacacctaagacaagatcatgaatgcgccatgttcacttcacccgaactccaagcacgctgccaaagattgtttcgtctacaagcagtttgccaagcagtacgtcgctcaattcaagaagccgacttaaggggaaactgacacgtcaacatagaagaaggacgacaccgagccagctcaaggcactttgcaggattcaaggaaggagctcaaccacatcttcggagggccacttgcctacgagtccaagaggaagcagaagctgaccgaccgggagatcaacgcagtccagccagaagtaccacaattcctacaatggtctgaggttgcaatcgattcgatcgctcggatcatcccaaccgagtggtccacccggggcggtacccccagtactagacccagtagttcgcaacgtgaagctcaagagaacccttattgatggcggaagagcgctcaatatcctcttcgccaagactctcgacgaaatgcagatctcgaggatcgagttacggctgaggaatgcaccctttcacggagtcttccttgtgttttcatctacaccactcggccaaatcactatgccggttacctttggcactggggaaaactttcatacagataatgtctgctttgaagtcgccgactttgagacagcttatcatgcaatgcttggacgaccggcgttagccaagttcatggccatcccacattacacctacatgatgatgaagatgccaagaccacgaggagtcatatccctgcgcagcgatgtcaagcaggctatcacctgcgacaaggaaagctgcgagatggcccaatcttgcgagcaagcactcggccgagaagaagtctgtctagctacatctacttcaccagagggagacgtgcccgctaaaaatttgtccaagtcaagagaaaacgacgccaagaccaagaagattccactcgatcctttagatccttccaaaactactgtgataggcgttgagttagattgtaaataggaaagcacactcatcacctttcttcaagctaataaagatatatttgcgtgaaaaccatctgatatgcctggtattcctagaaagaagacgcgaaacctattaggcaacgactccgctgatttgcgcaagacagaagagatgtgatcaagaaagagttagccaagctgtttgtcgacagtcattagcgatcagtttcgcccgtcaatattacctaaatagaggagaacaagttatgcttgcaatgcatttttgtgttaaaataatatatattccactagcactaggattactaatctcttacacagaataagcataagatggaggagaatcgacaacaaaatggacgattaatcaaccggacgctgtcgataatcagacttaaaggaagatagaccaagaactcagaattgacacgatcgaattgggccaaaattcacaagtctgaagatagaagaggtcaaggaggccaccagtcgaattgtgggctggatgggcctgcccatggttcggcagaacccgtcgtgcagccgctggatccagggttggcgatggacgatgtggatggcttccctatggcggttggagggtattaccgacctttccaatcaccataaccgtcattaccagcttatttaaggccatcactctctccatttcaagacacacctcaagcaaaaagcttcatacatctctcaagtttagtatatagtctctagagtatagtggaatagaaatagaatagaatctttagttctccgagtcttcagaagaattcgggtatggctctagtagcttttccttcttttgtaagacttgcacttaatttaaaatactcttctttatactactttggtattgtattactttccgagtatatgatcgaaatgatcaaataccaactttattatatatccaagttatatttattatgatgctagcttatcagggagatgcaatggtgtgggtataatgatcgtatttacgatgactctatgtcatgacgatgatattagactagtattttgtaacttaagcgtggtgtttagattactggatatcattatttggggttatattctacggaagcgaggtgggccgctgatggtgacagctcagtacgggtattcctccgcgcgtgtacatagtcctccgcgtgtgtatatagtcctaagttaatttcctggggagggtactcctccgtatttagccccggttgggtagtcatgacagattgtcgtaaggaactcggcaatcaggggtggcttcttgaagcaccaggagggcattggaaagagggtattagctaagtaatcatataactaggatgtatgtgtaatatgtttgtatactagaagtataggaatatgatctttcgattttctttccacttagcttagataattatgaatgagagtattaatgcttctgcttagtgtcactatactctttgaattatattagcccctgcttagactttgattattgcaagtaatatataaattattagtatggttctctctattataatcttcccacgggattaaacaattacgatacccttggaatactctcgggtgaaatactacaatggtatatccgtgcgcttgcggataaattctgtaaccgtaatataccagaagtatttctgcgccattgctggcaattatgtttctagtaatgcgccatttcatcaaggaggtctttcatcccgactggttggctaacccagtcctggttcggaagaaaactaggcaatggcgcatgtgtgttgactacaccgacctcaacaagtcttgtccaaaggaccccttcggcttgcctcgcattgaccaagttgttgattcgacagccggctgcgagttgctaaactttttgaattgttactcggttaccatcatatcagcccgaagaagtccgactgcttgaagacttcattcatcacgccattcgggtcttattgctactttatcatgccttttgggttggagaatgcatgagctacatatctacgcatgatgcagaggcgtttcacaacccaagtcggctgcaatgtagaagcatatgtcgacgatgtcgtcatcaagaccaagcacaaggataatctcatcgctgatttggaggaaatgtttgccaacatccgagccttcaggatgaagctaaatcccgagaagtgcaccttcgaagtaccgttagggaagttgattggctttatggtgtctcacagaggcatccaagccaacccggagaagatcaatgccatcctcaacatgaaaccgccgagctcccagaaagacgttcaaaagctggctggatgcatggcagcgctcagctgattcgttccaagactaggcgagcagtggatgccttttttgaagctgctcaagaagacagaaaactttcagtggacccctgaagcctagaaagcttttgaagacttcaagaatttcctcacaactccacccgtattggcttcaccacacccacaggaaccgttgttgttatatgtctcagtgacatcccgggtggtgagtatggtgttagtcgtcgagcatgaagaggagggctacgtccaaaaagtataggggccgatttacttcattagcgaggtgatggccgacaccaaaacacgctatccacaggtacatatgttattatatggtgtcttaattactgtcaggaagttggcccattactttcagagtcactcggttacggtggtcacaaccgcggagctactgggcgtatcactaagtgggcattagagttgatggcattagacctaactttcaaagcccacacctcgatcaagtctcgagccttggtggattttgtggccgagtcccagacagatgtacctgcggagaagctggagtactgcactatgcatttcgatgggtctaagagaatttcaggcacaggggaggagttgtgctgatctcctataaattatgattattttcgaggatttaagccgcatatgctttgtaattgattcagtcattttggtgactataattttttttaaaccattcggttgtttattttttccttgactatatgtttaatttgttcaactaatcatatagtcgggggctacatctaattaggtttatctagtcgatgcacctagatttttcttttttagcccttcacagcatgagatgattgaggtactcaggatttatggtgaggatgattcaagtacttggattcttcatgaaatcactcgggagaatatcattaccactcaggagaaggttgtctcatcatctgtgaaggtcttaggggttactgtggagattatgggtaccatataccctagggctacgttacctgactggatatcgggggtaattcatagtaacagaatatgcaaagataaggactcgggtattgtattaacttgtatataaaggaagtatcccgtagtcttagtcggttacaattgtaaattatttatagaacttagaccgtaagggataaggtcttttatcttgttttcctgactccttcgcctatataaggaggggtcggggccccttgagggcagaatcacatccaagatcgtcagatcaataccacaatcggcggaatatatccccggacaggagtatggtattacttctcatcgagaaggcctaaacctgtaaaaatcctatgtctcataacccatccattttcatagcttgttcgccaccccttttagtattgccgaaatctagtttcgacgcatttgcaaatgaggtacactattatggtttcctttcagccgtgttccaaagtgaatgcctattgatatagttttggagctaaatgcaagtatgttcttaaacaggaaacaccagagatgttaaatcatctgaaatgcaagaagtggtacattgcagcatgcaagaactgctaccaagtactactatacaagaagaggtttctctttgcaaggaatactcattatctgtttacagttctgtattaaatacgtagtgcccctgttactttgttcaggactatggcctggtttagttccccaattttttttcctgactggccgataggaattcatgtattgacatgggatcactgttatagcatcactcttattatttgttgccaagttcattacgtgaatgcaaagtatgatcacattattacctgactggcattcccagataaccttgttgagaagactcctgccagcagtaccctatcctccccaaagttgagtgaccgactgagagagatttcaaactcattgaagcttcttagcactcggccagtgagcgtgagggcagaaaagtggaacatagaatgtgtccggagaatcaacacgattgcaccagagccaaaaactcctgaagtgcatttgtaatttgagcaagcggaagatcccaaggataaacttatggcccacagcactgggattaaggttaacctgtttttttttaattcactgactcattttattcgcttaatgtgtttaattgtaccttcttataatcatcttgcctgatgaattctctcttgttttttatgtcccacagaaatctctagctcaagannnnnnnnnnnnnnnnnnnnnnnnnnnnnnnnnnnnnnnnnnnnnnnnnnnnnnnnnnnnnnagcaggggatcaatcgcg

SEQ ID NO: 415 - DNA, 9638 bp, Oryza sativa
  unsure (1)..(9638): unsure at all n locations
atggaangtgagaccncttcttataagccnnnnnnnnnnnnnnnnnnnnnnnnnnnnnnnnnnnnnnnnnnnnnnnnnnnnnntaatgtgtttaattgtaccttcttataatcatcttgcctgatgaattctctcttgttttttatgtcccacagaaatctctagctcaagagtgcttgacttttctcaacagtgctaataagtgagtttggcattatctttacaaccgacttcacaccacttctgcatttctaatgcatgtttgtttgtgtgtccattgcagggagcaattaaaaagcttaaaggtttgctctgaatcatatcgtggcagcccagattgcttctttcttaccattaacccactgatacatgtgtagggaatcggagaaaaaagggcaaactacatacttgagcttcgtgaggagtcaccagagcggcagagctatttaaagaggtgagcactctagatcaacaagggagtagccgttagacccaagcaactagaagttattatatgacaatgcaactcagagctgattcttttgctttcgcagataagtgatctgagagacatcatcggaatgaattcaaaagaggtactggagaatctgattgcaatgtgtacatttatctatgttctttgatcactggaagatggttttagttttcacaaacatttcactggattacactgtcactagagatattcctgaatagtattagactccagctgcttcattttgcaaactccatgggttttgggtgtactaaaattgccactgctttgttatcttcaccagatcaaaaagatgatgtccgggattatcgactcctaggaaagtaagcagcgcgagtgcgatggttctcctgtggagtgtgcatatgcttctttggtcaaaggtgtcatgtgtttgttttgtaatttttttatccagttgcttctctcaagagcgaatgctttggccaggagttggcgttctgtgagagaatcagtgctttgcagtggtttgctgctattatgtgtttcgtgtaatcatcatacagtgtggtaccaatattgataatggtgtggcgttgatgtgatttcctctcttttgatgtttgttgctataaatgccgatttattattttagaaaaaataatgagccgataaatattcctctctgttgatctgagaagctcagttctagttgttttttattccgacaaatatttgttctgatccgtatttgtttcgttttcgtattcgataatatttaactctgtttttgtatttggcgttgactattttgattttgatttaaaaaaaagtgaaaacggaaacggtagaaccggtttttgtcaagaaaacaataaaataaagttaatatgggtgttgggtttggtacggaaatgacatggacaagattagatgtaatataaaacttgctcttaagatactatgtggtgggagaaagtcctattaagcaaggcagatatatgttggatatgtagaacatgaattaatgggagggagaaacatagatgttaagtttaatgtgcttttattcaaaaatatagcaacctatactagaatatcacctattagtatgaatctgatggataggtctatattcacaatatgaaacatctacgttgaaacattttgcctcaaaaaatgaggttttacattccgccttccctaaaacctgagttttttttatttttaaaatactctatttctaaatgttgttatcatgtggttttacattatgcattccctaaaacctgagtttttttttaaaagatactctatttctaaatgttattatcatgtggtagtgtttcaacaggacttcatttaagacaataaagccctctagtctagtcctctctatactagaactctagaagtttacagtgcgtctcgcaccaacaccgaacctgggaagccacattggatgaaactcctacaaagccacccatcccacaatgcaaataactaccttctctcttatagtgggtcccaccatcagatgcttttcatcttccttctatctactctttacttttccccactcatcccctcccaaacgatcccctctctactcaactccggtgaccccgccggtgccacctctcccatcctcaccccaccggcggtgccacctcacctctccctcctcctaccggcggctccctccaccggagaggggcttggcgctccacggcggcagaggacacgacagcgacgagtctgggcgcggcgccacggtggcaagtcggggcgcagcgcagcggcggcgagtcgcgacgacggcgtggccgagctgcccagatccggtggcatcggctcgtcggggtgcggcggcggcggcgctgtggccttccaccgcggcggggcggagaggacgacttggagcggcacctcccccttcctcctccagcctccgtgccgtggcccgagcagctacggcgtcgttcggcggcaggcggctgcgcagcggtggcgacgacggtgtggggcggctgtgcttgtgcttctgtgtgtgcttttcccaatgcgctctctctcctcttcccagctgcgcttgcgcttttcacatgcttttcagcccaaaaacgggtgaccaagtttggctactcggtcttcacttggctacacatgtgaaggacgtggcaccgaatatgccattcctttctctcaggctgagcgtcacgtaggtgcattgtaaatgccctaatgtggccgcctgcatgccaccttttatcacgagagcttttagggatcgaagctttatatatgtccgatatagaactattctagggtcatgaggatatatggtccaaatagctgaaaaggagaaatctccacatcaacgcatggggtatcatccagtaaaatacacatttcccacgaggtaacacccacaaattcagttctcaagaatctcatctcctagccaatacccatggtctgattaggctgcactttcttttgactctctccaatatataataatacagtatattatcagatatatattctgaactgcaaacattatcttataagtgcatgatgcagagattgccgagatgattctccctgatccccaacataacttatgttggcatgtgctatgctgtttgcatctgaaatcatcttgaacgctcaacattataagaacatcctgcacatcgatggcaattaactatcaaatccaatgaatataaacagtacaattcgtacttcgtttcagctttcttttcctacagcataactaaatctaaacaactaactattctatagcatagtatcttaaaagtaaagtcttgaaaaagctagtatcggcttattgtggaattgacagcaagcagaaacagtccgtttaccacagttgatgaaaatacgactaactataatactccctctgtcccagaatttaagaagctgagattttttaccgtccatcatagtttttggtacctcccgatactataatcggagccatccatccagtgagatcaaacggttgacaatcactggtactgcgaggtacgggagtcccgtgtgggatacctcccacttcattcgcatgcgtggaactagaggtggccaaacgggcggcccggcccggcacggcacgggcacgggtccggcacggcccgtttcggcacggcccgttaggcacggctcatgaaacgggccgtgccgtcccgacccacgtgccgagccgccggcccaagcacggcccgtggatggccgggccgtgcccgtgccggcacggcatgcgtgtggcccgccgtgtcagtacgggcccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgccgtgccggcacggcccgttactgtagtaggccgtgccgggccgtgccggctacaggttccgccgtgcctcgggccgcccgttttggcccggcccgtttggccacctctacgtggaacaagttgaagggcagaattggactttcgcataatagacagttttcgcagagacggtttgaatccccgacaccggcaatctcactcctcccgatccccttccttcctcgacggcggcggcgcagccaagctcgctggcctccgcctccctcgctacaaccagcaatcaccaccctgcccaatcccaacttgcccctcctgctcccggtccaaatccggccgcgccgactgcagggagccgatatagctcagggcgtcgacgacctcaatgcaccaacgaagagatgtccacagcgacgagctcagtgcccgcctgaacacaagcaaagacgagctcggtaccaatctgaagcaacatgaatcgtggactggaggacgaacaggatgctgctgtccatggcatgaccagtacatcatatcgatccttcactagtaggcaagcatcttcatctttccttcaccatcatctctcgcgtcagcctcgcagcttatgcttctccccgctggcgtcgtttgacctcctggccgctcaatccacggagcggtggaacatggaggtgtcaccacgccgatgcaccacgtcgcgaggcaggcgccgaggcgtcgggagcccagacccagctggccctggttgattgccacccgtccccttcgccctgttcgtgtcggtggccagcctatgcgcgtcgctgagtttctcttcgttcactacccatcgtacccctctagagatcaacggttggattgtaatcggtacctcacgttacatgtacctcgaggtacagaacgctggaccggagaagcctctaagaagttttagggttggacacggttattaaaaaagtaggtagaagtaactggtggaggattgtgattggatgagtagtggagataggcggaaaacatgaatggtggaaagttataattggttgggaagagaatgttggtggagaagttgctatattttagcaaatcctgatggctaaaagttgttatattttaggatggagggagtaccaattatgagatttggtcgagtctacaagtactccctccgtttcaaaatgtttgacactgttgactttttaagtacgtgtttgaccattcgtcttattcaaaaaatttaagtaattatttattcttttcatatcatttgattcattgttaaatatactttcatgtacacatatagttttacatattttataaatttttttaataagacaaacagtcaaatatgtgctaaaaagtcaacggcgtcaaatattttgaaacggagggagtacaacacaatttatgataaggaaggagagcacttctagcacggcaatttgctgtgagcttaataataagtcgtacaaaaaaatatcaaaaagttaatgagattactctatgatagatggagataaccagttttaacagaaaaaaaagagctatcaagtgtggttccgtagcacgtaccagtcgtgatatcttttgaaaggctgtattatctccatcagcttggggcaatcatttatataacctgactttatttcagagacagatatagcaccaacaatagagatgaggtctggacagctattaagtcgaaggatgagtcccttgagtgtcatagaactccccagatggctgttgtctatgcactctatgcttggacagtcgactaagcagagcttccgaagagaggatggtaatgtcattctcctctgcatattcaacttgggacagccctcaatacatagctcctccaagtgggaaaagctatggaggtcatcaaccggcagtaatgccatttttttgcaatattttacctaaatggtctttcaccacaggcatataagcgggcataagaaactcatcaagactcaacagtgcatcacatgaagaaatgatgacatttgaaagggatgaaaatactccgacagtgcgcctgctgcttgcctcaggctgtgtttagttggatccaaagtttagattttggttaaaattggagatgatgtgactgaaaaattgtgtgtgtataacaggttgatgtgatggaaaatgactgaagtttgaatccaaactttggatctaaacacagcctcagacacacctatggatgtgagggagctacacccacaaaaacgcaaatcctccaaggatctaaggttacttatccaaacttgcaggggaatagatgttaagaactcgcattgtattgtcagacttgtcaggagggcaaggccatgaaagcaactcacaaagtgatatgttgaatggccaaaatttctaagggtagcttttgtaagagaagagggtaaagctaccaaaccttttcaattgatgttaggacactgtcagatttccagcacctcaaggtgacaaacgttctttgattcttctgaatcaggaaactgtggttcaaagaatgatagactctgaatgttattgcagcaagaaagtataagtgaacttagaattttcagacagtctggccggagccagctggggcaagatttaccctagtagctatctattgccaagttttgaagattccaatgaggtaacaattcaatatgttcctctatcatctataagtcttcataacttgttcctggtagggtccatctcaggcattgtttatcacagttctccttattatacatgaagccttatgattcaattttctttaaggaaatcagatcactgaaaccttgaggatatcttttgaaaacacagcccttggcatttattgtctggaaatgatagaggcagctaacagatgaaggaagggtctcaaaagtagaacttccgaataagccaaggtaacgcaaatgttttgagttgcttatgctctcaggtaactttctcactgttccccgcaaaaaaaaactttctcactgttgaaagattaaaaatcaatacacggatattcaggagttccttgaacaaacagtcaatcacaggagcaaaatgtttaccacttcggtaagattcattgcatactagggaccgcagttttttattgtgtgtgcaaatattcactaattctgcacagctgatattttcagtagtgaatattgacagatggcgaacctttgaagggattttagctaggtcacttacatgttgtatgatgaagcactcatctttagagactagctgtgcagtatcatgcatcaagtcatgaattacatacgtaccatgctcaccagctgctttctgaaagaatgaccgatttaaaaggtcatcaaagcaagagggtgcattttcaagctccacataaccttgtgctaccgaaatatctgctagaaaatccttttcaaatttgtgatcctttggatacatggcacagattgagaagcatctttttatgtcctgtggcaggtaaacgtaacttagtcgaagggctggcaaaatgtcagtctcctcttgttctaatcgccatagctcacttttcaatatgtcctcccagtgctctatgcttaggttgcttttcaataagtgtccaagagttttggcggccaaaggtgaacccttcaacttgggaagtatagcttcaccaatgcgctccagctctggcctgttgcgacaactgttgctccaactctggacggatccgaatgcacatagtttgaagaaattccagaaaacaccatgttgcaatcccttcagttcatagtgattactgttgctgactaggttagcaaccttggaagatctagtggtgaccaaaatcatactgccctcaagaccattgcttaaagttctatgaaatgttctccatcctttctcatcttttaagacatcatcccacatgtcatcaaggacgagtaaaaacttctttgacttgacactatcacgtaaattaaccataagagtatcccttgtatcagaatcttgtaactttactccaagagacttcagaacatctcttgttaacctgtttacctcgaattcatccgagacacatatccaaattatgcagttgttgaagtgattccgcaccactccatccacacagatttgttgggccatggttgtcttcccgacacctcccatgccaactattggcaacacaagcaactctgtcctccttgcttcagctgtagtgttgcatgccacaggcctgcctctcttgtgtccacgtactcttagcttttgtttcaagtcctccagttctttttcacgaccaaaaatctcatctggctcgtcgaggacatgacatgtctctggtctgacaattttgtcaaacttcttgggtgttttgtgcaagcctaaactgttagattggtcaaaaacatgcttcagtctttcttggatttccatcactttcctgaatttgccactgaagttaacattgcccaagaactccaaaaagggttcatgcaagtgatcttgccctaaattcttgctcgccttcaccttcaccttgagagcataataattgtactcatcaaggaggtcctcggcatcgtacactacatcctttatctggcgaaggtgcccagcttctgtttctttgtggctatgccactcaaggcggtcgatgaggtcatgcattgtgggtgcaattaatggttgtttggatcacccaaaggttgtgctcaagcttctgaagatcatcctgaatctgatgcagtgtagctgttcttctttctccagctgatgctgatgctgatcctgtccctgctgaacccacttgctgttgctgctgctgttgagaacatacggcagctaagacgtgtggtgtgacccagttgaagaattcccggaacgcattggcgtcagcagcaagaccagctgctcccctcaatattccaacgaccttgtccatagccaattgagcactgctgtatgatcataaacgcaaacaaaatcaaactaaacgctaagattttggagcaggtggtcagggaatgttttaccagggacatgggtggcggtctagcctgaagattggtgctccctgatttttactgctttccttctcttgttacaaactcttttgtgggtttgtatgttttggctgtgtgcatcctagttatgcagaggccgggaattttcttagtatggttctatcaacttgatgtaatcgtctgagattaataaaagcttcctttataaaataaaaaagagttccatgtcgggagagatgcaccatgccaaagctacatttactgtatctagtggttcaaggcaaatctatcacctatgtatctactattttttttaaataaagtctagaaattagggcgggtctatattatagatccataactaaaaatggacaggaactttgttttgtgagagtatagcctataggaactaaagatatggttttattaaatacaattctatctcaaataggnnnnnnnnnnnnnnnnnnnnnnnnnnnnnnnnnnnnnnnnnnnnnnnnnnnnnnnnnnnnnnnnnnaggagtcaacaatgccgc

SEQ ID NO: 416 - DNA, 12683 bp, Oryza sativa
  unsure (1)..(12683): unsure at all n locations
ntcagggacgagagaacgaaataatgttgatgtgtgtggttcttttagtgttaggtaggtctatgaactggctagatatagccgttgggttatagtcttnnacnnnnnnnnnaagagagttgttgacatgcacgacagattatnnannnnnnnnnnnnnnnnnnnnnnnnnnnnnnnnnnnnnnnnnnnnnnnnnnnnnnnnnntctgcctgtacaactaaaagtattattggattaaatacaattctatctcaaagtaggcacataatttctcagaaagttctattagttgtggtgaaagcaacatgtaagacaacaggcacagtttgaaatttttctaagcttactactacattataaaattgacgaagaacacagaagactgaaatatgcagactttgggtacaattggaaaaacagtttctgttgataattgtagtactattatctgatactcaaaaaatatcaagctggcataaatggggaaaataattggatcacacacctgggtccttaatttgttcacaattctttctacccaatgatcagaccacctagctagctcctcttcttgatcttgctcttcttaatgtctgctacaagcaaagcgaccacctgcttattcaaatgttagaacaatatgactagagattagataggaaaaaagagtacagatacactagtttcagatagagtaccaatttcatctcccaaattcaaacgaagagaactagatgaaatttggaagagtacaacctccaatttcagttagttcttttcataggtagaacaagggactgaactcatttttgggggcataggttgcttccacgtacaattgctcggataaccctctgggaaattattaagaggaccccaggatgttttcagaacatggcagaaaaaaagagcctgccgctgccggcggtggcctccacgactcgaccgcgcacggttgcttggaatggaccctacattttaacaaaaaaattgagagcagaatttaaaatagattgtgttcaatttttatacatttttatctaaaagtattttagggctaggtaaataagattgtgaaatactcattaccacccttaacgtgccaatttgatattttgccatcctccaaacggggtttcgtttttgctgtctaaaagcatctccaatagcctctttaaattggactctccaaacacctgtatagctaactatctatctgatttggctaatcaaactagatggtcactccaacagactctctattaatcctctctaaaataacaacggacccacatgtcagcctctactcctcttcttcctctctttctcccccttcttccttctctttctttcttttcccttttctttccttcccgtcgtcaaccaggcggcgcatgcagcgcggggaggtggcaggtggcggcgcggcgcggggaggcggaaggcggcgcaccgcgggtaggcggcgcggggaggcggcaggtggcggcacggcacggggaggcggcaggcggcgcaccgcgggtaggcggcgcggggaggcggaaggcgacggcgtggcgtggcgcggcgcggcggcgtccttgctccctctccccacaggatctagaggccgccgctggccttgccaacctcggcccgctctgctcgatgaagcgacggcggcggacagcttcggggggcagcggcagagcttcgggcagggatggcgacggcgagcgcagaggctagcgacggtggcggcggctcgcgacgatgacctcgatgacgacccgacgacaacgactgcgcagaggaatagcatgtggggcccaccatttggcgaggagttttggctggccaaatctaaccagctagctagcgagtttggccatctgttggagctcttttttttttgtcttgaatagctaaaatttggcttggagagactaatagagaggctattggagatgctctgaagagccggcctggctcaacacgacattgacccacaaatggtgcagaccattaaagcatcaccggtacgactcatggaacaatccatgctatgctaaggtcgagttgtatgggcccaaatatgacacgtgggtcgacgaatgtgtattaatatgtttggcatatcaaaattaaaatataagggaaaaaaaggaaaaagaaaaagaaataaatgtgaaaaagatgataaaaaacaggtccccgacccagccttctcagtaaagcagcaacaacatcagtacgatacgagaggggaaaacatgagagagcttgttctctaacatgtgtgatctacaaggggcaaaatggacctattgggttggttgtccacgatggcggaataagtccactttgacttcctcaaatataagtccaatctaattcgtatccctcaatcgtaataccagatatcttaaaccctcgactattaaaaccaggttgacatttcgcggcggcaccgatggcagggcggcctcgctgttgtcgccgaagccaatggcgctgcttagggagtgggatggggacggggagagagaaggtgaggaagaagaagggaacaagaaagagaggatgacatgtaggcccacatatgctgacttagtggttggactaggtcagcgagccacgttagcgaaaatcaacctcaaagccaccgagaaagttgttttgcaccagttttagtagttgagggtttaagatatctactgcgattaaggaatacgaattaaattgtacgtatatttaaggaagtcaaagtgaacttactcccatgttggcacactcatctgtcataccacatagaccaaagtagcaacaaaaacgtaatggcaattaatagtagcatatggagaatggttgtttcttatagtggcaaatagttaaaatttttcggaatcacaaattctcatcttgatgcctcatgctcgcatgccacacagcatctaaatgttcttgtcatgtagtccatctattccataaaaaataacttctggagatgaatctggataagtgattgtcagattcatcccattcttcttataacggagggtgtatgtatcgctcgttgttatcatacactccatccgtcccataaaaattgagatgaatctagatatgtttgttagattcatcccattcttttttaacagagggtgtatgtatctgcgagacactatttcaaggatttcatccccaagaacagcagatgacgatcctattgatcgatgtaattgaagatagggtcgaagtgctcgcaccacaaagtttttcacagtatggaggcacacacgtgtacagtgtggcggagggcggaaaaaaatttaggtgtggccaataaactaccacacgcaagagctagcacagaacaagaattaagaaaaaaattcaatacacaatattgtacaacgcaacattatctcaaataagtcatagtaatgagcactaatcacaagttcacaattcattatccatttgcaaacaaatgtaaatataaaagtaggtataaaaaaatacctcaattcctcaagattcactgatacgctttgaaattgcaatgttctgaaattgtaaaaaaaaagtatatttgataaattttggtaaatttgcaaaaaagtactacggccgtgtttagttgttttggtaaatttttttttatgtacatggatatatatttgaactattaaacatagactaataacaaaacaaattaagattctgtctgtaaactacgagacgaatctattaagcctaattaattcgtcattagcaaatgtttactgtagcaccacattgttaaatcatagtgtaattaagcttaaatgattcgtctcgcaatttacatacaaactgtaccattattaatacttcatgcatgtgtctaaacatttgatgtgacagaaaagttaaaagtttgaaggaaactaaacacagcgtacctctctgtgatgccagtgccttcccttttctctttctgtccattttctgatgatgggagattgggagtgatgcctgatggctgctcctgcttatgcttgccttgcttggtgcttggtgctgcggcgccagccgccctgcttggcgcctgcgcggctgcgcccctggccggctggccactaactcgccgcctgccacgccgcgccgccgtccggcgtggatgccgcagctctgtggctgcgcccaggagcccggcagacggcgggacatttaactttatgtcacttttaagatgttgcaattaattatttgtcactcgttgtctatgacatatgggactatgtgtcaagtagcaaataatttaacaccccttataagagtggcaaatagttaattattccgcaaatggcagccatgcctctcctcgccttcgcctgcccttccacgcgcggcgtgtcgcttcaagactctagcagaaagtaccgcagtagctgctgtcggccgaaggggattgaggattggggagggggattgctggattgggtgttgggggaatcgatggaggtggatgagatggggaaattttggtctagggttacacaaaacaagcccaatggcccgcgggcactggagttcgccaacttcgcgaagccaatgggaggcaccgccatcaacacggggagctcgccacggttcgacgtgttcggcaaagacttcgggtgggggaggccggcgaccgtgcggagcggcggcacggacaagttcgacggtaaggtgacggtgtacgaggggccgaccggcgccgggagcatgtcgctggaggtttgcctgactccggtggcgctagcgaagctcgtcgctgatgaggagttcatggacgcggtgaccgcgccgtgaactgcaggggtgtttagattcaggagtgtaaagttttggcgtgtcacatcggatattatataggatgtcgcatggggtgttcggacactaataaaaaactaattatataatctatcagtaaaccgcgagacgaatttattaagcctaattaatccatcattagtaaatatttactgtagtaccacattgtcaaatcatggagcaattaggcttaaaagattcgtctcgtaaattagttgcaatttgtgcaattagttattttttaagtctatatttaatactttatgtaggtgttcaaatgttcgatgtaacatggtgtaaagttttaggatgagatctacttactacccattgatgtcagtatcatgcacttcctatccgtttgtttcaatttgtgagcagaaaaattgagaaatttcatcatcatgggtggcagagaaaatggtataacctaccatgtgaggtggtaggtggccagactctgacaatggaggatcagatcaggagatcatgggaaatgatttcttttaaactattgttgcttaaactatcacaaatttcatcaccatgcttcgctattgtttgtttgcacagtcgaaccaattagtatcgctgcttgcgtgtcttttaaatagttatgaacatatttaaaaaaattaacagatatgatactcgctatgttctataatattagaatttagtactggatgagacatattctagtaccacgaatttggataatggacttgtccagattcgtagtactagggtatttctcattattactaggtccttatattttacgatggcgtgagtatatcacttcataaatatacgacttggaatttaaattctataagatgcaacaaaattcaagtgtgaatatatatagcactgcacaatgccacggataagctacatcgcacatattctactagtctagcactgtacggtctcgcgcactcaccgcgtgaccctaagtagtctcgcatcctcatcacgcaaagtcgtacggtaacacgtgattttgcactttcattctacgacaacaacatagttttacaaatccctttttaaatgtgtatatttatgtaaaaccaagaaaaaaaaaagagaaggtttgcagccggtctccaccaattttttttgagagaatctattctgtgtaccactgagttcgttcgagttctcaatgatttgccatcaacattgcctctttgtttaatatactggcgactttataaattgttctacaatataccattaggttgagtcatcttttcaaaaatatccttatgaacatataaggttaataattgatttatctcattaggagtgtaaaaaaacttttatggggcctccttatgcacacaacatggaaatttaaatttgtataggagtttcaacttttttacaattctattttttctaaaaaagatactttataacttatctgttatacagtatataaaaatactttattattattatttttaatataaatcatctttcatacactacagaagatatttttatgctatcatctcatgtataagcaaattctctctcatataccacataataatatttgtttagaaaaaactaaatataccagaaaaaaatttaaaacctatgtacaaacttccatgttgtgtaaggaggccacataaaaattttcatattttttgaaacttataacgagataaatcaattgtttatcttgtatatctctaagggtattttgagtatttttaaaaggaggtccagtctaatgacatatcgtagaacaattgctaaagtcgccagtacatcatagaaagagacaatatcgatggcaaatagttgaactcgaacaaactcggtggtatataatagattctctcaattttttttcccacgcgagggcattcccgttagttattaagcaaatattaaaggtctatcacatctctcatccgcaaattctaaaaacatctttagaatgcatgattcaacactggaacataatcgaaatgtaccaataaaatgttatgcgtgttgaattacggagtgttacagaaaccaaaccatagaaaagtttccaaactaatgtttgaatgatacattagaaaaaacaggcaggaactaaggcataacctcattctttttaataaaactttttatggattggcttattataaactaccagtaacatgccatgtacggattagacaaatataaatatagatacctttttataataagtgtaatagggacaaaacattggatctgatgcatatgcatacttacgcttgtgagcgtgttgcacgcggtgggaggaagagaaacggaagatttccatccaaattaattaatccctatagtggaaatggaaggatttaatttatccctatacaggaggggacacggaaggcagtagagaaattgcgaaataatatatagggatcaatcctttatgccaaaggatttcataggattttttttcttactttacaaatcccaccagatattcttcccttttttctttgtttcaaaggagacctgggattataaatttaatttgttgttttgcacgatgtatgttttacaagcaaaaaggtagatttaatattcaacttttagttttggggcatctacaaatttgctactgacactggtggagaaaccctttgtagtcccggttcgtaacccccctttagtcccggtttccaaaccgggagtaccaatccggcactaaagatcgctatctttagtcccgggtgaaataaccgggagtaaagatcgatctttagtcccggttggtgttaccaaccgggactaaagatatagctgacctttttttttttgcatgcccctgttgctgcatggtttatatatatatatatatatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtgcacatgcatatagaaacatatgtagtcatatattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaaaaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagtaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggtgtcaactttcgccttctttgttgcccttatgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagtttttcaaaggaatatgcagctcacatggtgtccgctgagtgatgtcatcaatgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgtgttcatcaaccttccttgccacctcctcttgcatgttgagttcgtagctcgatacccggaactctaggtctgcaatcttcgcctcgttatctctcttgctcctcatccgactcctgtacgtgtggatgtcctccttgaaaccaatcttccaaggaatcacccctttccctcgagttcgtcctggatgctctggagtctgtagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttatttctttccatcatcgccttcccttgttcacctgtcttatatgcaacgaactcgtcccagtgatcccttagctttgggaatgtgtcgaagttcagtgtctgcccctttagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccatgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacatgtcttttctgcaagataaaaaaaatgtattaggataaatgcgaagtaacatatatatatatatatatatatatatatatatatatatatatatatatatatacatgtatatatatatatatatacatgtatatatatatatatatacatgtatatatatatatatatacatgtatatatatatacatgtatatatatatatatacatgtatatatatatannnnnnnnnnnnnnnnnnnnnnnnnnnnnnnnnnnnnnnnngctacgtcatccaggcccct

SEQ ID NO: 417 - DNA, 1304 bp, Oryza sativa
aagttctttagtcgcggttgttctcaacacccgggagtaaatatcttttcccactatttcaaaattctttttaaacccggttagggttaagaaccgggactaaagattcccgctattaattataagtcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctagtaatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtaaaagggggttgcccatccaactgatcgtaatcctcgtcagtcttgtcctcaactccgacgatttttcttttgcctgggagaaccacttgacgcttaggctcatcaggccctctgcccttctttcctttgctagacatgttcttaacaaaaagacttgcgttacattattggcaaagacaaaatgttcctct

SEQ ID NO: 418 - DNA, 905 bp, Oryza sativa
  unsure (1)..(905): unsure at all n locations
cacggaacaagagaacccttaaaaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacaaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgactctgcgaaattnnnnnnnnnnnnnnnnnnnnnnnnnnnnnnnnnnnnnnnnnnnnnnnnnnnnnnnnnnnnnnnnnnnggcgccactgccatc

SEQ ID NO: 419 - DNA, 930 bp, Oryza sativa
  unsure (1)..(930): unsure at all n locations
tcccaagaaacagaggacatcttcgtccatctcctgaaggcgcagcattacaagacgttcatactgttgccatacacacaagagttagtttattttactgtctttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattactactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgattttttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaannnnnnnnnnnnnnnnnnnnnnnnnnnnnnnnnnnnnnnnnnnnnnnnnnnnnnnnnnnnnnnnnnnggagttcatcacagccctc

SEQ ID NO: 420 - DNA, 505 bp, Oryza sativa
tgtctaacttgttatccggcatagtccaattggcaacgaaatcggcgagtatctgggacttgatggctgttcgtggcacaaagtggacatcaaactggctcagctcgactacccatttcgcaatgcggccgacaacatctttgtttctcacaactttgccaagagggaaaaaggagacaactgtgactctgtgggcttgaaagtagtggcgtagcttccttgatgtcatgatgaccgtgtaaagcagcttttggatctgtgggtatcttgtctttgcgtcgtggagagcttcgctaacgtaatagactggtcgttgtactttctctctctcgacaacaatgacggtgctaacggaatacggtgtggcggcaatatagaggaataattcttcattaggttggggagcaacaagtacagggggtttgataggtagcgcttgagtgcaacaaatgcctcgtcggcttcctgtgtccatacaaatttgtcttgtttcttcagcagagcg

SEQ ID NO: 421 - DNA, 391 bp, Oryza sativa
ttccctctcccacctctctttccctctccttcacctcaccctccacccttctcaaagcaggtggcgtggttcccctcccctccctccctccctcctagattcgacagaaggatgggagtgtggcggcagcaaccaccacatgccacagtggtggcaacacggagggctcgtggtggcgctcccctccctagctcccacctcccagtccggccgacagcggccctcccctcccgtcccctcccagatccggtcggaggagggagggccgcaaaggcggtgcggagggctcatggcggcgctccaatcccctagctcccacatcctagatccggccgatggtggccctccccttccctcccatccggccggtggggggggaggggtggagggt

SEQ ID NO: 422 - DNA, 524 bp, Oryza sativa
ctccagctccaggaggggtggagctggagctgtgccaaataggcccgaaattaacttaggatttttcttgtttgcatgattttttttcttgctatttaatttactttagatgttatacgatgctactaaaaagcatttgtcaggtactcagaaaaaaagacaaaagaaaaaagaaaaggagacaaacaatttattgattcgcagcaaaggtaaatgagagaccaaaacctgagacctaccggggataaaacgactctcacaattcttaccttagttttcttttaatttttgtacaactatttcaaatgcatataactttcatgctatataaaattggatgaaattggcacgttctaaaaaattaaatccacaaaagagattcaataacgagagggtctagttagacaactgtgagggccacatatccatccgtcctattctttctctttcttctccatcaagaatcactaggcaaacatgattatatatgtctttttctaaaccgtatgggccagcatacgtgt

SEQ ID NO: 423 - DNA, 707 bp, Oryza sativa
atatcgcgctcccaggtgaaagtgtagccacacaggaagtgggttagggacagccaaggtagggagcagcttacaattttaagaggtccgagaaagacctgaaatgtaagctgacagtagacagagatctgaaggaagcgaaggggtatgccttgcagatttccagagaaaatcacccaggcagagagaacagtgagtgcaaagacctagcaggggtgggaggtgggtcggagaaggggcatgtgcgcctgacgtcagggaaaccatggggagctgccatgtgactttcaaacacttgaggatcaagggcaccacagtttccaatttaattaagctcactacagcaggtgaatacttcccattaaaatgtattacatgcgaatgctatttctgcggctctttgggatgtgagcttcacataaaattgctcggtcatcgagcatcgtggcctccatctgcacagccgccacctcccactagcaatttcatgcacgtgatgaactctccagcaaatttataggatattattcacactttggtttttctcagaaggaagaataataatgtatgctgctccagcaaattatcttttccacagggctttcatgcacggggtctcctttaatttgaagctcacaaagcatgaaagggagggagctgtaggcgcgccctacacgaggaaactgaggctttcaaggggtacacac

SEQ ID NO: 424 - DNA, 1647 bp, Oryza sativa
gatgatgaggctagcttttattgtgctagatctccaagcagtgctgtccaaccatcataaacagctgcgaagggaaggggggaatcaaatgcaagcaagcaaaatgtttccataagaggccaatccaagagtaccttgtaggtccttgttcctccttttcttgcctcccccctcctgtgctctctctcctctatccgtcaccccttgaggcagacttgcagggttgctgcagtccttatttactgctcatcaatcactcatcttctcctcctttgttgatcacagaccagtagaaacaatcacttcaatcccattttcagttcagttccccttgtcatgctacctacaacttagatccagccaaactgtgaaaagaagtaaatgaaggccgtacctttgggtgcaatatatgcttgagccccagatgctgcaaatccacctcttcctgtcttttggtgtgcatccaggcatcccagccgaagaacagcaacaatcaccatgcacagacaatgctacagcttgtgaaaacatcttatctgtctaatactacaatgttcaagttcatgacatagtgttggaatatgtgttcagtaaaaaaaaagaaatttactgctaagtagtaaaactccattgtggtatatatttcagtaggattttgttggatctgcaactcctatcccaatcaatccgatcctcctcttcagcttgaacgtggcaaggacccagggggaggcaacagttgtcaggcacttaaaaacaaagagcagtgtgcttttatgctcccctgccatgaaatgtggcaagtgtgtgtgcgaggaggggaatcaaatgctacaaaaggaggagctccccagaagtagccaatgcaacagtacgaagctcctttatttgtccaccaaacccaatgtaccaccaccaccaggcggcgcatttggaagttggaacgaagcaaattctggtcctctttgaattttccattactgtatctatagccttgagttacaacgatatgtaacttcacagcaattctcaactgcaaagagaagcatgagaacataaaaatgtttctttacaccataacccagatgattttagtggatgataagcatatcatccagcattcatttcttgaatgacaggaaatatttaagctgcaaagataagcagaacatgaatgaggctggtataaaaataggtaaaaaaaaaagctcatgatgtgcaaactgcaaagcaaatcagtaataaggcacatgctgaaagcaaccgcatgtagcaatgcaatgagagttccagatgcacattttattgcagaaatggcaggtgatcacattgcggtgcataatgaagcatcattatttacaaaaggagcactcttaagttttacaacacttatgaaccgagccagggcctacctgttaaataactaaattcaaggtctcaagcactcacatcacaggcagatgtcatatggaggacttaggattgcttaaagcttacaagaaacatgtgggctagatatgtcgataatcaggaaaaaaatacgttgcttcaaatataccttaacattgtatgattgaacccctaagttcatcttgtaaactgtagtgtgtgcgtgtgtgttagaaaacaacacactcttactatttc

SEQ ID NO: 425 - DNA, 2450 bp, Oryza sativa
agaactaattagaaccattctcactcgctgcaagcatattaattctttttcttcaaaaaataggcaggtgttttgcctagtatattaatagaatagaaagggttttgataacagcttggaaagctcccaagctaagggtggtgataaaatctaaagcccaatgttctgataagaactcggtgcattcgtgcgccaggtagacaacaagtatgacctccctccttgatctttgcttgggagagaagcacgttaattatactgtctaaaaacgtgccttgtgcagcctttggttcttttttttttttgccgggtcggccgaaggaacggcgaccaaatttcattaagatgggggaagtacataaagttacaaattgtttcttgcttacaacgacaggaagctgtcgagatggtgctatggcaaagccacagcctttggttcttcatattcctaatgctgtttgatcaggggtatatatataactttcaaggatcagtatcctgtatcctccgtcgagcacactgtctcctatgatctttgcctctcatcctgatctgcaagagtatagcatgggaagagattgcagttaggctgcacagatcaaagtcagaagatgccataattttcatagaccaacagtgttaagatcattgttgctatgaatgccagaataggaagacataatgatcaaatgttcatggagctacagaaaacagggtactagaaggaaagaaatggtgtaccgcatggtccgcatccgcatgtattacaaattttacatttacgcataaaattaaacatttgttgaaaagagtacggatgagtcaaccaccagacattattttggtttccaaaaaagtagccacagacagagcaagccttaatacaacgggtaattccacaaagtgagactagcagatgtactagaagagaataatttctgacaaaattggcatgtacgcactcagcacttgttaacacaatcagcaatcaacactatgtaactatgttcatccaaccagttacaaagcatacaatagaaacacacctaatgaaactgtgcttgaaacttttcaggcttgaacaaattgatagagataaggatcaacagttgggagggcttgatactgcattactgcacaccattttatcagctagttttgctaacgcgaagaattcccgaagaactcgcaccctttctcttccattacacccaaatcacacctaccacctgacgatggctcgcttctccgttagcgacattgccgtgaaatatgcttcgttcgcaaaacgggggcggagagagaactgagaagagcagactgacccttccggaggaggagcgaggacagtcgggtccagcttctcttccgcggccgccgccgccgccgccgcgcacgctcgccgctttcccgttcccttttttttttgggggggttttcactcaacacgtaccccaatccaactctcacaaacacgatgaatttttttcggttttagatttttttaaaaaaatatttatagaaataatctatcgaccaaaaaaattacaaaaatagaccctgccgcccacctctggggcggcaagctgacgtggcaaacggggggaggaacgggcggtgacgaaagaagggttttttcaggaaaacccttgccgccctctggtggggcggcaaggggcccgaatgcaaaaaagccagtcggggccggctattttgcaggcggccccttgccgccctctggccgggcggcaggcctcgctccctataaaggcctgctgcccagcccccagccctcattcttctctcctcaattccagtgaaaaaaaaagaagagaggggaggagaagagaagaaggggcgaagccctgccggattcagacgccaatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctactagtttggaatcaatactgtcatgcttccttgtcccattattatatcgtcgttgtgttcaactattgcactacctccctcctagttcaaatctaatatcatctatgtaaccgcaatgcaaatagtcgtatcatgttcaaattgtactactatttcttcatgttacataattctccttgtttaagtccatataatgtttctacgacccagactgcgataggcctatataaattatccgagtactaatacgtcgaataaggtacaaaataatacctcacgtaacatatgaaattgcgcaacaaccaacttcaatacatttttataacaatattaacaagttttaccaataaatacttctttatttattattaacataacatagaaaaatcttttggccgtacttttttcat

SEQ ID NO: 426 - DNA, 23029 bp, Oryza sativa
  unsure (1)..(23029): unsure at all n locations
caagctctttatgggcggccaaaattgcaattagccccttgccgccctttgtatggccggcaagggcctaatcgcaattttggccgacggcggcaaacggcgcggtcgacccaccgtctgccacgtcagcttgccgcccaccattagggcggcaggggctatttctgtaatttttttggtcgatagattatttctgtaaatattaaaaaaaaaaatctaaaaacgaaaaaaattccaaacacgattcggttccgagatgatttatggcccaatacaaaagcccattaaaaatctagggtttaaaggtgggaaaaagtccactttgactcccttaaatgtataccgaatctaattcgtacccctcaaccagaaaaccggttaggatgactccccattttactaaaaccggtacaaatagactccctcggcggtttcaagggcggttttgctgacgtggcggtgttgacttggtcttcgtcccacgtggcgttgacgcggcactgatgtaagattagatttaaaaatatatatgtgggaccaatttgtcattcacacacaaaaattataatagaatccactgacttgtgggggtccacatgtcattctctttccaacctttatgcctccctctttctcccttatctctctctttctcttcctgtcggcgagcagcgcggagagcttgccgagggcacggatggcggagcagagggcggcgagggaacggagtggagggctccaagggagtgcgcgaagctgtgaagccgtgaggcggcggtgggtggagaaggccggcgtgaaggccgggcggagcagcggcatcgagagctgccagtcaccgcggtcgctcctgtcgcgtatcctacagcgaggcgacggcgacggcagcggtgggaagatcgggtgccgggtgcagctgccgtggcggtacagctccacctctgtgttgatgcgatgttgttaacactccgccgccgccggtagtggcggcggcggcgtgggaagttcgggtgctggatgcggctaccggcgccggccaaggtcaaggtcatcgggagggcgccggagttgtccctcgacacgccgcggagttcttgtacactcgacgaggggagaaatggtataattcttgccgtgcgcggcgccggtgcagtgccggagacgagagcgacgacacggaggaggtgactgacacgtcggcgtccttcgccgccaagacagacgacgtggcggcaagaaggccaaggacggtggcggcggcggcgcggtgctggtgacggtggatggcgacgtggagctggagatggagacgctactgaaggcgtcggcgtacatcctgggcgcggcgggcagcagcatcgtgtacatggcggtgctggacgacggcgccgtgctggcggtgcgcaggatcgatagcgacgacgcatcgcccgcggcatggcgagagggctggccttcctccacgacaagaagttcgtgcggcaacgtccggccgagcaacatcctgctcgacgccgacatggagccgctattgacggacctcagaatctaccggctcatccgcggcgggggcacgctcaagccggcagcagcggcagcgccggggcagttcgggagcaagcggtcggcgaagtgcttgccggacctgtcgccgccgggcgcgaggccgctggcggggccgtccgggtccggtgacgcggcggcacagtaccaggagaggagcgagccagagctgatgctgagcagcaacaaccacaccctcgtctacacctgcgacaacgtgcggtgcagtgcccgcacagcaactacgcgctcggcttcctcgaccgcttgctctgctgtttctttttgggggatttgggggaaaagatagagagggagaagatggctgacaagtgggccctacgctttttatattttctcctatcacttacatgtgggcctcatctgtattttggtgactgggctgacacatcagcacaatagaccaagtcagcatgccacgtcagcaaaaccaccctcaaaaaccacttagggagtcaatttgtaccggttttagtaattgggggagtcatcctaaccggttttctggttgaggggtacgaattagattcggtgtatatttaagggagttaaagtggactttttccttaaaggtgtagtagatatttccggcccattaggcccacgagctttcctcttcgtaggctcgcggcgtctactcctccactccaccagagcgaaactgcaaggcggcaatggaggccggagatggaagaggaggaggagcggaggaggaggaggaggagcaggtgatgagcgaggtgcacctgggatgcccgccccgcttctccgggctctacgtctcccgcttcagcttctcctcccgcccgctaggtaacagcccggtctcgcgcattccgtcgaacaccttgcctgcaccgccttcttgggcgcaacccgatgtggggggtggatggaagagccatggtttagttcgattcgatgtttgcagggccatctgcgggcagcgacggcggagaatgtagcggtgtgcgcgagcaggtcgcggcgtcgagcagttcttgtgagcgtgcgtggggctgtttcttgctatggtgtagaggactgaaaggtggtgcttgcttgaactgattcttggctttgttgggaaggtggttcgcctgacgctgttaccgtggatgaggacggggatctcgttcttgacaggagaagaaggaacagaggcagtgaggcatttgttatttttaactgcattctgtcttgccgaaattggtggtttgtgcagttaatctgaccattggcttgcagggagtgatcatgtgctcactgttcagcatggtatcacctcctctcttaggagcgttggtctccaggtctgagaaaatgctgcttttgtaattccttttcgtcttcctttttgtttacgatcacgtttgttgttggttcacaggtttggaaggcggcattgctattaactgattttgtattgcataagagctttacatcgtctgagtttaatggtgttactgccatagagatcggtgctgggacaggtgattagtcgatgtgaaattagtcaaaaagtgttcccagaatcatgatttatgtgtcatttgttactaatttagtgatcctctacaatcatgaatgtttgccaggtttggtagggttggcactagctcgagttgctaagaaaatcttcattacaggtaggtagttaggccttctcgagtccgattctgtagagttgttcgttttagagttttaccttttgtccagttgcatgttccacatcaatccagtaggtataatttgatccgtatatctgacaaacagggttaattgaaatggcaaaactatataacagaaattggttcaaatgagaattcagttccatgtgcgaccgcataaatcaaaatttcctctactatacatggatctaattagtctaagaatgcaattccaattctaatccttatactcagtttcaatctatgaagctcaaagtcttatttagtgttcattgtcttgcattatttgactcaattttgctactaagataaggtaaataacccagcaggagtattacttactgttttccttagtcttagtaacctttccttgatatataaaaggttagttttgcatgacacctgtaatttggtaatgttaaaatcttgataacatttcggcatattcatcattgcaaatgatcagataggggctctgatatcctcgataactgcttggctaatgtccaacttaactcaagcatgctaaagtttgatgaagctaaagcctgtgtgcgggaactggattggaaaatgtcatggcctccacctgtgtttaaatgtgattcatctgatccaaggttatttctgcttctacaccaactattcccacttatacaaattttcatacatcataatatgcgttatctaccacgaattcatgtaaaaatgtgaatgcgagtatctgatagtcatgtgcgtcttcacaacttttggttaattaaaaattcatgtaaaacttgcaggattagtacattgttgtgtacaaagacatgggagtttttctacacttctttgtgtaatacgcttttgcatgttttatgtttttggtgaacataccctcagcattggttaggaacatgttctccaatgctgtttgagatacaaatttttttttaatgattgatgcctaagtaaaacggtttttccaatgcagttcaaaatacttatggtatacaagtgaaatcgaggcggctgagaaagctacaacactatttgctgcggatgttatttacagtgacgatctgactgatctgtttttcagcatagcaaagaaactgatgtctcatggtgctgagaaggtatcggtttatccggttaccgtcattttttcttaaaatttgacaaataccctaagacaagatgtttctcctctccatgctgaagacttggtattctccttcgtatctggtaggtattgtacttgaccctggagaagagatataacttcagtatggacgaactagatgttgtagccaatggttacaagcacttccgaagtttcttcacggttcaggatggtaggttgtttgcaaagcattttgatcagctaagaatacgtagaattggtatcaggatctcaattgtctgtgttcattccacagtactcagtctttcatttttcacaatcttttgttcgcagaaagcggagctctggatgataattcatgtagaccagattttgttggagagcagatggaccttgcagaggttcctcagtacatcagagaatatgacaggggcaaagatttggagatgtggaagataatgtacaacccaaatccagaatagcaatgtcttttacagaaattacccgctttttaatgtaccactacaatgcatttttgcatgtttgtataactgtgggtgtgtttagttctttgggtgtaaagtttttgaagtatacggatatacatttgaagtattaaacgtagactaataacaaaacaaactatagattccgcatgtaaaccgcgagacgaatttattaagcctaattaatccatcattagcaaatgtttactttagcatcacattatcaaatcatggcaaatcatggcgtaatttggtttaaaagattcgtctcgcaatttatatgcaaactgtgcaattggttttttctcacatttaatgtcccatgtatgtgttcaaacatttgatgtgatgttttcggctaaaattttttggatctaaacaaggcctgtattgtatatggcatccgcatatcataaacaaaagaagagagtgatatgttatttctcccttttgtcatcaagcttgcagactgatcacacagacacagaaggcaggagaacaagaatccacagcatattttatttcgagttctcatgtaaaagaacaaatttatccagagatctcccattctcccctactttaataacgcgtaaaagaccagtaggatgatgatcaccatgacggcgaagcatgcgcaggttccaaccgcagaatcctacaaccacgagtagatcaacacaggtcgatcaattcatccatcgtttgatcaaccccccccccccctcatcgtttgatcaaaaaaataacctaactatagatacctacagatgcgtccctccgtcccaaaaatagacaaatcatgggtttctgtatccaatatttgaccgtccgtcttatttgaaaaaattatgaaaaaaattaaaaagataagtcgcgcataaagtattaataatgttttatcatctaacaacaataaaaatactaattataaaaaagtttcatataagacgaacggttaaacgttagatacggaaacccagagttggtctttttgcttttagacggagggagtacttaccagatcgctgaggttgccggtgtcaggcttgggctccaggagcggcgctgccgctgctgtgtccaccgtcaccgccaccgacgatgacggtgggttggtttctttgagaatcttggcgacaatccgctgctgctgctgctggtgatgatggtgatggtgaccgtggtggtggtggtgatggtgattatggtgatgatgcggcggctgggtgtggtggtggtgatggtggtggtggtggtgatgatgatgatgatggtgatgcatgtcgtccatggctggaatccggatgatgatttgttggtagatcgatgcaaagggttcgtgggttttttttccggtgttttcgtgttgggtttaagttaacctgttggcgagatatatcgatcgatcgatcgacttagagttggagacgatttacgtatggcgtcgatcgatggatgatggatttactgccgtgcttgcaagatgtattctatctgtatgcgactaggggcggcattacgaagaagttaagagaaatttgtaaaagaacactccataagtcgctcgaagtttgacatttcatcccataagttatttttgttgcaaaatcctaaccatttatttagttttgttgcacaacccggacgagagtctagttgactggtgggatcaagaacaaagcaacaaagcaaatgtcaaagtaaggggatgcactcactgcacatgctcttgagttgggaaatctggtgcgagagaaatagacgagttttcaaagataaataacttcaaatccctcaattaatggcaagaatagtggacgaaatannnnnnnnnnnnnnnnnnnnngcaaaaaatcttgcgagaatagcgccttaacatctcatcctctgttgtaattttcctttttttctgctcttctcccccctgtctttcccctcgtcacctttggtgacatttgtacagtgcttatcttctgaaatataaaaccagctaagctggctaaggtttcaaaaaaaaatatcagcctagtgtgcacgtgtttaaccaaatcgatctgttataactaatacagagctaccacaagctaagctacatgagtccatctttccaactgcttgcatttattcttcatgtttcattgaactttttttcgcatacaacaaaactcaacgcgacaacatttaagctctccaaaaaagtgtccaagactatactctagaagtatttaattttaataaagacaatattaacgactcataatttaatgttcatttggctaaaacacatgtacactagagtggtttttgcaacaaaactgagtaggtcaacaaacatttgtaagaaaatgaattatgtgatgaaatgtcaaacttcaagtgatttatggggtgctttttcttttgcaaattctccaaaaattaaagctgaaaatctattgaaactaataattctattttaaaatatattacgctattgacttctagacatgatttttatcgttcgttttattaaaaaaccaatagaagtattatttatttggggtgacagcttgagcttaagaaataaggaggtggctgctagcgcgtctccttcttgacctccggcacaaggaggttatagagctcgagctcgacaaggcagcccccggtgagcgtttcctccattgccttcgaagtgaggctgtagagagcgagctcgatgaggcagcgctgccgctgcttctccccctcctccccaacactcacttcggattgagctaggggccatgttagattaaactcactttggattgagttagggggttattcatctagattagaaagtcatgatgtccgattttataatttatgggataatttggtcttttgcaatagtttaggggttaattcgtttttttcccaaaacaatgtaacacctctcattacttctcatgtacaaagtaaaattactctagaacatgtatatgtactggttctcctagcccgttggcctccattgaataataaaatctattatgacgcgatatttcaaaagcaaaactacacgaaccatcttatataatgggaaattacatcgaaaccgttgaaatctctactatattgatcctagctagctactgatcataacttgacttccattattaactcgtagccatgcatgttggtccatttgacaaaaaaggctggatcgatcacaaaaagataatgaagatggcgacgacgcagacgatcccgacggttatcaacgcacactgcaccaaagatgggaaaacacacacacacacaataacgagatcgcattagctctcaaatcaaaaatcgatccatagcgcttaattagtgcaataatgtggttgacatcggatgcgttgcgtgctatacgtaccttgcaggcggcatcatcatcgccgttggcggcggcggcagcggtggcggcgggcttcggcttctgaactagcggccggcgtacggacgacgacgacgacgacgacgacgacgacgagctcgagattgttactgctgcttagtcgaagaggatcatcggcactgggcagtgatggcaatgcatggctggtcgccggtcgcggtcgtcgtcggtcggcgcctcggccggcgcgcggcggctagctgaattaatccggcgagacgaggttcgacgtcgaggctgggagagagctgatcgctgtggttgtgcggtttgtgccgccgccaccgacggcgcgtcgttggatttatgggcgcgcgctgtcgaccaaccgatcgtgagcatggctaacagatacccacaaatatctctaaaatttagtttttagatttctaattcgattttatggtgtaaccagatttttatctctaggaaatatgttaaatcaactcccaataataaaaggtggatccactcatcactaccaacgttatgtatatataaaaaatggggaaatctaaatcgagagcgctctcggttacattttatagcgtgacgtgttcgatagccgtccattcacgcgtcgttgtcccagttgttcccaccacgcgtcattgacatccccatctaagccgttcgttttcgtcctcattcattcgccactgttcaaattatgggaatcgagagagagagagagagagagagaggggtggaggctatgacggttttgtcccatcgtggcaagggaaggtggaggttgtggcagtttcatcccatcgcggcagaggaggtgaaggctgtggtaggtttcggctgtttcccctcattgtggcgaagaggtagatggatgtagcagttttactccacaaatcacgacgaagaaggggagggtagtgattgtttcctcctaaaattctgatgaagcagcgactgacgacttctactacaacggcgacgagcggtggccgcgatgggattccgcggttgcgggcttcagctgtagcagagacgacaacatgcttttgaactagtaagtaacttttatatgtttcctaaaagttactagtaagtaacttttatatgtctaaaaagtaactatttaaattaccaagctttttgtaatcgattgtgcataactttcgaattgaaagaacttgggtatggaaccttcaaaagtaaattacgtgttactagtaagtaactcctatatgtctaaaaaggaacttttgaattgaaaagaattggatatggaaccttaaatttctccatgtataatatgttattatacatgtttctgatatacgtgtgctagtacaaataagtaatcatgtaagagatgctaaatgagcataagtttaaacttacatgtttctagcaagtaacttttatatgcccgagaagtaactttatgtatagtcgtttcaagtatagacttatttttctttttcacatttttacatgcagcttgttgtagaaaaggatatgaaaattggaactagatttttagggggtcgatgcagcatgttgctttaagtatctgtggcactcgttggtgctttatttttctatgaactacttgtgtgtttaattcttgttttgtgtttcttcttttggcgaacctgatctagatctattaaatgtgggatgtaaattacatgaaaattttttgggatcacctttttatttgattttgggtattccatgccttcttcttccttacttcagttctgttttctgactataatggcaacactggtttttggagaggcgaaggtgccgtgggcttcgctatctttttttattgctggaaatggtggtgctagttcttaggggagccaaaggtgctagttgtggtgggctttgggttggcccatgtgaggaaatttcgggcgtgcggtgcgtttttttgcattcttagaaatgagcgtatgggatggtcgtgaggtttccttttgaagaaagatgcaagttctatttttggaaagcgcgtgggtcgctggttagcgtaatcgtgctaccatgcactaggtagtcatgtttatctctttacccattccctcgtcacgcgcgaactctctccacgtgtcgcctcctcctttcgtagagctgaaattaagagcgagagcttcttctgacttgtagagagtgagaaaggagaagaaaatgattctaatttttagatacatctttagaagaaccgtttaagcaagattttcacataagaaatctaatttttaaaattaggttttacttaaaagaaaactatggataggtcaatcgatgcaaccatctactaactatctactctattcatgcatgaatgtatatattaattttaaaaataatatttcttataaactactcgtcagatctaccatctaagcatattgttgtattcgttgtaattaaatatttacaacaagagatcaaataattatattctgatgaaaaaaatatatgttccacactgttcaaactaagtttcacacgggatagcaacatgtttcaacttgtttttccactatgtttccaaaaaaaaaatgtttcaatagttgattttttttacatcatggacaacataatgtttcaccggtggcggtggctaacaaagctacacaactacctacccttactctttctcgtgtcacgctacttagggtctgtttgacacagctccagcatcacctctcctggagctagagcccagccaaacagtttcagctccacataaaatgagagtggagctaggtagagctatctcacaaaatgaactagaaatgtggagctgagtttgggcagctctacaactccactccagacccaactcctgaagttaaattgagttggagctctaacaaacaggctcttactctctctctctctccactccatatatgcatgcatataacgatattcaaaatactttttctcctattctatttatccgatctacgatccgaacacaccattgcactagatgtaattaaatctttataacaagatatcacataattattttctgataaaagaaaacaagatatcatatatgttttaaaccgttaaaacttcttgttttatatgtgatagtgacatgcttcatcgggtgtttccactatgtttcaaaaaatattttaaatgtgtcaatgcctgttttttcatttcaccacatataaaacttaatgtttcaccggtaatcaaccgaagcatttaaccatctgattttttattttttattttggaatcgggtgttcgtatgtagtttcctccattttacttacgtaggtactctatctccgagccggagtggaacgtgctgcgatcgagatgtatgtgtcggggataataaaagatcgggatcgagtataatacggcgagtgattaatcttcaacttattcaaacaaacacaaaatttccacatctaaatccaagacggaattgctaaagaattgtcgtaagcccccccttttattttttacggttttgctgcctgtcatttgacaaattctaagtacctgtatctttccacgaaatcgtttctctcttttattttctcgaaattagccatatcctctcgtttgagagaagtttctgacgagcaaagtccatcgtccttgcaagcaaataaccaaggattcagagatcaagacgcaaccttgactgaactgaataacagaagattaagcaagtagcagtgactgtccgatccagtgattcgcagatccaagacacgatcgttctctatcactctatcatgtctagtcttttgcagggccagtgagagcgcccattgctgtttctttttgtcctccggaacggctgaacctcgaagcaaagtggatctggagttcttgtgctgcaattttatcgattcaagcatgtcaatcttgtgaagcaatgtctcttgtttctgtgagacttctgaactttgacaggaactgaactgtataaggacaaagcttcaccatcacaatgggtcgtcaatttggaagctgtaacctgaacagagactctgcaactgtttgcctatttggaaaactagatatttcatccttagcatagtcgatgactgtgacgagtgtcattatattgtcactgttatttgttcctctttatgtgaaggccccaataataccatcttagtaataaatattaacctatttctccaacaaagaacactgcacaagatggagataccttggctcttttatcttttgtcagtactatgtatgacaatgttgtctcaggccatccattgtactttgctcatagcctcgtattcattgggagttggaactaggtacaagctttactttgaggattcaggctttgtcagctgctcatgggaacacaatctttaatttgagctaattaattagtaatttaaacaggtgtttccatgctcatgtaatcgagtccaagtgcaaacctattatactctctttttttttctgctaaacgtacatttttagcattgaagagttctgtacataatcttgtctttgctaatgccttttgtttgttagtgctttagtttgtcattacagtaagaaatgaggcgtacaagcagagaactgatgcgaaagagtgtggcacccggagccattgctggccacagatgcagaaatcttgcagaaaatggagcagccaagttctttcaaattcttatcataacaagatagtagctcagtaatctagtcagattgttgtgtcttgttgcactgaagtaaaatagagagataatagtactaggattcctttgctgacagtcagacagaggctttagtccagagctctttagaaggcaatcaagtgtgcttagatatttttggaccataccaaatcttcagataaccaaatcctctttggtttggctttcagcttttcagggaggaaagggcacaaaatcagcaaaatgattaataattagtggtgtaggttcagctgttcagttggatgtcaaatcatctacttaagttagtaatagtgactatgtcaaatcaaatcatctgttattactgagttactattaactgaatgtaactctgctctgcttctgaatttccttgcttagtgccatcaaattttaccatcttttgctgtggaaacaaagggtcaattatatagacaaagtgaatcactgaatctttcatcaactagcaacctttttttaccacacaaatgatagcaccacagcatggtcgagaaggatggagaagtagggaataataatatgttgcgcctgagacagtatttcaacaatcttagtacttggtatagcaattaccaaccatttgcagtccaaaatgacggcactgaaataaagttttgtagcctcatcattcccttggaaaaccagtggttgcatcttgcatcaagtaaaactaaaagtgtttggttaaaagcaaaacaaaaatactcaaaagtggactaatgtgggatccctgactggattttttttgaacctttttaatttttaattttaaaagtaaaccttttcaaaactaatttccaaaatctaaaccttctgaccatgccagcccgtctggcgtggcaaaacaacactgacacgtcacctgaagtaggtgtaacagttttatcctgccacgccagcaaaagcggtgtaaccaaataacgctaccacaccagtgagaccggcgtagccaaatacctctatcacactagcgagaccggcgtgataatattgttttgtcatggtagtttggctagcatgattaaaacattcagattttaaaataagtatttaaaataaaaaaggttcaaaaaaataaaaaaatattcccccaatgttgcgtatctttgatatatcatctctacgttaagattttacacctgtttattaccctcgatattttaaacccgaaatattagggcccatttaagataactgaaattgattgattcatggataatctgatctttgtgatatcttaagagtataaatgaatgcattagcttgtaaaattttaaaaagttgttttacaaacgtatttcaagaaaaaatatataattttctttttgcacgaaaaggtgttgcttggaagcttgggaagcgtacaaacaaaaatcaagaatttttaaaaatatggcatactccctccgtcccataatataagggattttgagtttttgcttgctgtttgaccactcgtcttattcaattttttttttgcaaatataaaaaacgaaaagttgtgcttaaaatactttggataataaagtaagtcaaaaaaaataaataataattccaaatttttttgaataagacgaatggtcaaacagtgcaagtaaaaagtcaaaatcccttatatcatgggatggaggaaataacttttagtatgggtcagtttgcgttttaatgatgttgtaaattacttgtatatccttccttttttttttcttaaagagaaggaaaaattttatgcctcatgagtcttgaattacatgtttttcttaagatataagaatttagtccggataagttccggtttttatattttgagatcgaggaaataacaagctttatttccaagtaatattcaaataactgtttaaaaaaattaaataactcgaaaaaggaaatgaccaaaatgccctcgctcccccctccaccgcttcccctccttcccccggcccccgcttcttctacagttctactccacacctcctctctctctctctcgctcgctcgctctcctctcctccctcgcgcgcgcggccggcgagcggagcgggtcggcaggtgcgcggacggcgtcgtctcctcccccgactccgccgcagcctcccaccctccctgtgccgcctcctcgcgcgcgctgacgccgccggcgagcaggtttggagttggggggcgacgtggcaggcctgcttgctcctctaaccgaattgaaggtatccgtttctcctcccctttgctacttcatgagccgtcatagattggagatccatccgggcgaacaatggattttgtgcggtttcttccattccacacccaatttgttaacccgtacaggttactagatggcagtttgcttgaagagaggattggggaattaatcggctgaacaccgattccccggcgttatgtcctcctctgctctcgtgccccattgactttttgcgttattgtaatggccaaattggccgggttgagtgagccttactggttactgagctgttcttgcttgagcttggagtgaccacattccccggcaagcacggttaaatcctggtgcccgtgaatattacgcatatgcatgtggactttcaaaaggattttagtaagatcagggatgtgcggctggtgtccgtctcttagagcctatgttaagtggtgtatatgcgggggtgtgagtgtggtgtcacgtgagtagtggtgtgtgtgcgtgtgtctgccgtgtaattgcaaaaaagaaaagcttctagtactttaccccactaaaaaagttttggatttctgatgctactagtttcagccacagaaaattgggttgagtttcatttggtggagtgctgtgctccagaaacaagaaaatcttggtgagaacatagaaagttgaatgttgcctgagtgcttaatggcgaaattgtgttggcaggaaatggcagggcaaagatctgattcgcagtcagatgaatcgttcgaatacatgttgcttgagagggaccctgatctttaccgtacagtcttctcgggcccgagccagataagtccgtggattgacccgagcgtgctgactttgcagcaccggatagggagaggtccatttggggatgtttggattgcaacccaccatcagaggacagaggatcatgatcggtaccatgaggtcgctgtgaagatgttgcatccaattagagaggaccaactgcaagccttctcagtgaggtttgacgagatctttagcaaatgccaaggtctaagcaatgtgtgcttcctacatggcatctcaacacagaatggaagggtatgtatgctattagtggtgtgttgatctttcttgtcttgattatctttgcacatcaggccagcctaatagcttattttgtatcatggttttttagatttgtatagcaatgaagttttacgaaggattcattggagataagatggcccggctttaaaggtggaaggatccctttatcagatgttttaaggtacggtagaatttcccacagtttatcacatatactaatattgccatgatcaacgcattacaaattgaaccttaggatttcagcatgtagtttgcaacttcctattgatgttctgactgctgacttggttggttggattatttgtctgatttcctttctcattttagcattggcacaagttcttattgatttctgagagtgattatggtctatttagaggaatttcgtgcttattttcttcagaatgtttcttatatatctttttaattcacagatatggtgctgatttggcccgtggcattatagacctgcactcaagaggaatattgattctaaatcttaagccctgtaattttctccttgatgaacatgaccatgctgtgctgggtgattttggaattccgtccttgctgtttgggctctcactgcctaatccagatcttatccaacgacttggaactccaaattacatggccccagaacaatggcaaccaagcattagagggccaattagctatgagacagactcatggggttttgcctggagcatccttgagatgttgagtggcattcaaccatggcgtggcaaatcaccagatgaggtttatcagttggttgtcctgaagaaagaaaaaccaatttttccatacaatttgcctccagcaatagagaatgtcctttctggatgctttgaatatgactttagagaccgcccccagatgactgatattttagatgcatttgagaggtaacatgcttattatcctgcttttcatgttcaacaatttacattttgattgaattgccattgagttattttttttgcttatatactataatttacaaaagctaatcggtgctaaatatgtgaatccatggaattgtgtgttttaatacttgtattctgttagcttgttgtaatttgaagtatcttatatatttatatgcatttttttcctttgcataattctttactgtcccatagcagtaacttggattacatgttgtcctaattatttctttttaattttgattagtgcaaaagatgtagattacgaaaatactgaccagggaaattctgaaaatctaaggatggtcagtccagccctgccaagccgcactaactggtcattcttcaaggacaagttgcaagtgggagacaaggttcgctcgagaaagcttaaaaacacttgtagtccaacaaccatggaagtccctgatggaaccatagttggaatggaggataatggagagcgtgatggctacattcttgtaaggatccatggtttacatgatcctttgaaggttcgctcttcaacagtggaaagggtaacctatggtttcgctgctggagactgggtacggcttagggaggatgagaagaagcgatctcaggttggaattcttcatagcattgaccgtagtggtactgtttatgtaggtctgattggagtggacaccctctggaagggtgaatactctgaccttcaaatggctgaagcctactgtgttgggcagtttgtgcggctgaaagccaatatttcaagcccacagtttgaatggcagcgaaagagaggtggaggactggctacaggccgtatttcgcagatactaccaaatggatgccttttcataaaatttccaggcaaatttaaccttggtgaagtatgcagttgcttggcagatccctctgaggttgaggtggtgagctttgacaagtgtgaggggatcgtgaagaagtacgagcacctcgaggatttccattgggcggtcaggccgctgttcattgctgtaggtttcttcaccgctctgaagctaggcatctttgttgggaagggcattgctcggccaagaagtcgaaaggttgccagcgtctctgatcagagtgatcatcagcaactacagcagcaagaagtgcaaaacaatgccaatgcagcatggctccctccaactgtggcaaacatgctgtttagagacggtcctacgctttctggataaaatgaaaatcaaaaccagtgcaagatggagagtttcagaactactggataatgcaacgcccaagcaaatcgtagttcatacttagacctgaaacttgtcttgccacaagacctgtaaatatttccaccttcactctactatcatctccatgttcacaaaaacatgttctgtgcttatgtctgtaaattgtaggcttgcagtccaaatcctgatactgtcttttgcttttgtcattacactgcaatctctcagtatccctggattttctgttcccgatccatcaatttgcagttgcatctgcaacgtgatgaacggcatgcgaatatggatgaaaattgccataaacgctggcaacacaatcaacataggaaattatatggcatcatctgcaattctgcatataatataccttctttccgaaaggacttcattcctagtacttgtccagattcgttgctagaaatgaagtctttttggacagaggtagtacaatttcaacctgattaacaaaagagtttgtatagcagaagtccacaactgaaccatacatgggattggactggctgatactatccaccaaattgcctaatttgtaaagaactaaacctctacaaactacatttttccagagagcaacaattacacaacaccagaaccttctgtgtcaatactttttctgagcatcctctcagctgaaacatgaaagctactagtcatcaagtgatactgtgaagctcgtgtgaaggccttcccatcttctcggagaccaggttcagcatctgaactagaaatcaagctgtgaaccttgtgaggatgaggagcaactgccagatgcatcaagtgaaggaccacctgatccatccactggagcttgattcaaccgttctaacaccagcgacctcctcttgcgcaacttcagagaaaacgtggacgcctccaatatgacggggacctgcttgttgataagaaaggcatcgaaacgagagagtgcaaagttttgtttatacaactattatgaaagcttaattcgtggaaaaaaaaaacaatcatgaaagctttgatacctggctattagtctgtgccaccttatgcacatgtaaaaaaccaaccatatcctgatatccagtgaggagttttgctaactctttgtcctcatctggtgacaaataaaatggaaacttaataaaggatatagttgatcaaaatagcaatcacatgacatactttaaagggccatgcttgcttacctggaattgctttgattgacagaagtgtgtccgccaggtgctgccatctcttacaaaaggagcttgataaaactgtatttggaaatgttataacagcaactgcattagatgcacgaaccatggccttcagcgatctgataaatgagaccatgtcccagtcctgcaatacacaaatataattagttgcaagtacataacgatgatattagaaaggtgaaaatatataaattggtctgaaaaaagattcaatgcatcgcagcaaccaatcaagactaatagacatcagtcgcattaaatactttccttctcaaagtatccgcattgtggtgcacatagtgattgtatagcaatccgtccagcatgcgcatttccaccatcttttctgaacaccaataacaaaataaattcacgagtaataacgaatatggtacatgccatcaaattttatgttaataaaaaaaatattatggtagacgaatttatggtaacatggcattgcaatgttagaatgattttccttcagaaaaaccgtctgagcatagagacaagaacccttacctcggaagtttggacaagaatgtggaacaacggtcctggaggacaccaagagtgtctccttcttgagtgctagcacattcaatattctgagcattaagtaaatgcctttccaagggcttccgtaaatcaaaatcattgctaaattcttgcttgttgtctgcaattatactaaactgagtcagaactttgacaaacatcttgatagacagtgatgatagctaataaaaaacacttttaaagcaaactgataggtattatgaacattgctattatcctgaagtatgctaatattatgcatttaggtctttgcccaaaaggataatcctagaatcccatctttcttctggatttggagaaatgtcgattttcaagaaagaacgcgaatcttatgatatggtgggaatctcttatcatcatcatccacgccttaaatgtatcctaatgcccagctcaggtgtcagtgacaacaatggtgcttaggaataagtagattatagaagctaagggctcagacaaaatccattcacgaacaatattatttattttgttttcttgcgtatcctcaaaaatgtttacaagcatgcttttttgcgtattcatggccaacaagaatacaaaggaaataatagtatcacctctgtgttcagcatgagaagtcttctcttctccaaagtatttcttgtactgccaagctatcctcaaagcctcgtcctacacaattacatgtcgagatcaacattaaaataataacacttttcagggctcaagttgactgccaaatattcttcctcgagacatacacttgttcggccatcgctacttgttccagcccccatccctctttgtcgtccatcctcctttgaagatgcaacagcaggtaatgtaccaaggaacaagcggggttccttcataggtcctgcgaagagcagcggttgtttgtgcacaacaccctgcgccatgaagctccgaagcagtaggaggtggtgaggcgcatcagagtcctccatgatcattacaactgatccaataagaaaacccccacctagaatccctgcatccgttaaactagtaaattatggtgaactgaattgcacatcaccataactcataagagcatcagcttttttttttccagtttaaaggttttaccccattaaactcaccgcaagaaccaaactttcctcacggcatctatacatggctaaacacaaaatattgaaaggaatttgtactcctaaaataacaagtaatgcaggtgatcaagatatatcatcgaagcaattttatttgattcctaacaaaactacgcacattgcatttgcaaacatagttagtagtagcatatattgtactatgaaataatactccaattagcaccctttccctaatctcctaggtaacaaccaagcatgtgaagtgacctaaagataaaaggaatttcttacataaataggaataatcgcgttagtagaacagaaaaaaaacgctagatttttattcagcaaaacaataaaaagggtctgcaagcaagaatctgcttactgtcgaggtcgggaatgcccaagaagacgaagccggcgccattaggaccaagcttgactcctgcggcggtggatgaggacgccacatgaggtgccgctgctcgagagaagctgctccggccgacggtctggcctccggcggcggcggccatggagttggcggcgaagtttcacggggcacagatcgagctccacttcacagcggcggcttagactaggagaaggaagggagaagaccgcagcgaggacgccgcggcggcggcgagagcgctcgagaacgaggcggaaacccacggcggcgggaggggtcgagggcgaggcgacggcggtgcctcactacgaagaccacatgggctatttgcttgggctatttcttgtttgggccaagcccactaattaatttcacaatatattagttcaccgatcactcctcccgtcccataaaaaaccaacataaaatgagatgtgatatttcctactgtacaaattatttgtatcagaaaatattacatcttatcctaggttacttttttatgagacggagggagtatgtttgtcgacatcatcatgatgttagtatggtatctaggtactagatgtgttacgtataggtatcgtatctggtatcatcggcactaagtgtgttacctatggtatcatcagcatcaacatggtaggtactagagtttaaggcatcatacttatgtctgtgtgatatcatcacttaaaatgttccttgggaccaacggtataccgatctagtatttattatccgtttgttaatccttagtcatttttttagagggcgactagacgataggatccagttaggacgggatacttaagtgactcctccctcttcctttcctatgtctagctgagctttaacgtgcaagcggatagcaaatgcacttattttttcccttgtctcgtcagctacatcaacagaagggaagggaaggggcatgttaaggagaggaagggagaagaggataggagatgacagcaaggggctcactggtcggtctagcggcgatgacgtgtgctccctctcacactcggttcgtacctggtacctatgggtaccggctagtacctaggtatcaaatcttggtacctaggtactagggctgatatttgtgggcatcattcatgattctccgtggtaccag

SEQ ID NO: 427 - DNA, 5755 bp, Oryza sativa
agtttcctagtaggagtcctattaggtgtctttcttttatccccgatatatacttgtaagccgtacggttaaggggtggcgttctcattgtgattcccctacgtttgtaatcatcacctctatagtgatcattgccggtcggcgcccgtggttttttcccgcaagtgttttccacgtaaaaattcgtgtctccgttgtgtatctattttcataacaagtggtatcagagcattgaagatcgatctactgcagtcccggctaccggcgatttttcccgatcgaagaaatcgatctaatcggtggcacgcgtcgtcgtgttcgtcgttccgtcgaatcaatctgttcacccccctacctgtcgactccgagtcggcctcgtcccacgcctgcgcgagataaaaaggcagcaccgcagcagcagccgctcaggcgtcgtgagaggagtactacaagcagcgcacgcgtcacgaggattaaaacaatcagccgaaagcttggctgttctgttcaggcttttttccagggaggaaattgctaggacttgttataataaaacaagcaggttatagaaaaaaactctttttttattatttatcaacaaagcaaaaaggggtcttatcaaaccaacccaccccataaaattggaaagaaagataaaagtaagtggacctgactccttgaatgtttctttagcagatcccttgctaatccgagcgagctttcaaatatttgtcccacattcattcgggagggtactcctaagggattgaaaaccatatcaacaggcgttccatcttgcaaatagggcatatcttgcctaggcaaaattttggaaatgatccccttattcccgtcttccggcgtttttgctattttaccctaatttcttaccagcaaattcaggattaattcccatggcgagtttgaagtatgatctaccgctcatggaccgagacacaagattctcactttggcaagtgaagatgcgagccgttcttgcacagcaagacctcgatgatgcgctttctagatttgacaagaggactcaggattggtccaacgatgagaagaaaagggatcgtaaggctatgtcatatattcatcttcatctatctaacaatattttgcaggaggtgcttaaggaggagacaaccgctgggctgtggttgaagctggaacagatatgcatgactaaggagctgaccagtaagatgcacctgaagcaaaagttatttttgcacaagttgcaagatgatgagtctgtgatggaccatctctccgctttcaaggaaattgttgctgaccttgagtctatggaggtaaagtatgatgaagaggatttaggccttattctattgtgttcattgcctagctcatatgcaaacttcagggatactatactttatagccgtgatactctaactttaaaagaagtttatgatgctttgcatgccaaagaaaagatgaagaagatggtaacctctgaaggttcaaattcacaagcagaaggcttggttgttcggggcaggcaacaggagaagaacacaaagaaccaatcaagagataaaagctcaagtagctaccgtgggagatcaaagtccagaggcaggtataagtcatgcaaatactgcaagagagatggacatgatatctctgagtgttggaagctacaggacaaagacaagagaaccggaaagtatataccaaaaggtaagaaagaagaggaaggtaaagccacagttgttactgatgagaagtctgatgcagaattgcttgttgcttatgctggttgtgcacaaactagtgacaagtggattcttgatactgcatgcacctatcacatgtgcccgaatagggattggtttgccacctatgaagctttgcaaggtggtactgttttgatgggtgatgatacaccatgcgaggttgcaggtattggaacagttcagatcaagatgtttgatggctgtatcagaacattgtcagatgtgcggcatattccaaatttgaagagaagtctcatctctttatgtactcttgatcgcaaagggtacaaatattccggtggagacggaattttgaaggtaactaaaggctctcttgttgtgatgaaagctgatattaaatttgccaacatgtaccatctgcgaggtacaactatattaggtaatgttgcagcagtttctaattcattatctaattccgatgctactaatctttggcatatgcgtcttgggcatatgagtgaaattggtttggcagaattgagcaagcgaggattgctagatggacaaagcatcgagaagctcaaattttgtgagcattgcatatttggcaagcataagagggtgaagttcaacacatctacacatactactgaaggtattcttgattatgtgcattctgatttatgggggcctgctcgtaagacatcttttggaggtgctcgttacatgatgactatcgttgatgattatttgcgaaaagtttggccttatttcttgaagcacaaatatcaagcttttgatgtgtttaaagagtggaaaactatggttgaaagacaaactgagaggaaggtgaaaatccttcgtactgacaatgggatggagttctgttctaagatatttaaatcatattgcaagtctgaaggcattgtgcgtcactacaccgttcctcacacacctcaacaaaacggcgtagctgagcgtatgaacaggacaattatatcaaaggcccgttgtatgttgtctaatgcaggtttgcctaaacaattttgggtggaagctgtttctactgcttgttatcttatcaatcgatcacccagttatgccattgataagaagactccaattgaggtatggtctagttccccagcaaattattcagacttaagagtatttggttgtactgcttatgctcatgttgataatggtaaattggagcctagagctattaagtgcatttttcttggttatccgtctggtgtgaaaggctataagttatggtgtcctgaaaccaaaaaggttgtgattagtaaaaatgttgtcttccatgaatctggtatataacatgacaaaccttctactaatgttcctgttgagagtcaggagaaagcaagtgtgcaggtggagcacttgatcagttcagggcatgcaccagaaaaagaagatgttgctattaaccaagatgcacctgttattgaagattcagattcttctattgttcatcagtctccaaaacgttctattgcaaaagataagcccaaaagaaatattaaacctcctcgaagatatattgaagaagcgaacatagttgcttatgctttgagtgtggcagaagaaattgaaggtaatgccgaaccttctacatattctgaggctattgtttctgatgattgcaatagatggataactgctatgcatgatgagatggaatcacttgaaaagaatcatacttgggaattggtgaagttgccaaaggagaagaaacctatccgttgcaagtggatcttcaaaagaaaggaaggtatgtctccaagtgatgaggcaagatacaaagcaaggctagttgctaaaggttatagccagattccaggtattgatttcaatgatgtcttttcccctgttgtgaagcatagttcaattcgcactttacttagtattgttgcaatgcatgattatgaactagagcaaatggatgttaagactgcatttttacatggggagttagaagaggacatttatatggagcaacctgaaggttttgttgttcctggaaaagagaacctagtctgtaggttgaagaaatctctttatgggttgaagcagtcacctagacagtggtataagagatttgactctttcatgctttctcagaagtttagaagatccaattatgatagctgtgtttatctcaaagttgttgatggttcagctatatatttgcttctttatgtcgatgatatgttgattgctgcaaaagataaatcagagatagcaaagttgaagacacaattgagtagtgaatttgagatgaaggatttgggtgcagcgaagaaaattctcggtatggaaattactagagaaagacattctggcaagttatatcttagtcagaaatgttatattgaaaaagttcttcatcgtttcaatatgcatgatgcaaaaccagtgagtactcctttagctgcacatttcagattatcttcagatttatgtccacagtcagattatgatattgagtacatgtctagagttccttattcaagtgcagttggttcacttatgtatgccatggtatgttgtcgtcctgacttatcacatgcattgagtgttgtcagtagatacatagctaatcctggcaaagagcattggaaagctgttcaatggatttttagatacctacgtggtacatctagtgcttgtttgcagtttgggagatctagagatggacttgttggttatgtggattcagattttgctggagatttggataggagaagatcgctcacaggttatgttttcactattggaggatgtgctgttagttggaaggcaagtttgcaagcaactgttgccttatttactactgaagcagagtatatggctatttctgaagcttgtaaagaagctatttggcttagaggtttgtacactgagctttgtggagttacgtcttgcattaatatattttgtgatagtcaaagtgcaatatgccttacaaaggatcagatgttctatgagagaacaaagcacattgatgtgagatatcactttatttgaggtgtgattgccgaaggtgatgtcaaggtatgcaaaataagtactcatgataacccagctgatatgatgacaaagccagttcctgctactaagtttgagctttgctcaagcttggtgggtgttatagtatagtcttagagactatttggcgcgcggtgattttacctacatgaggtatttttggtgattgatgtttttatgctacaagaggaaattcgtctcaaggtggagattgttaaatatgtgatccgaattttgggcccacaatatattcggattagtttcctagtaggagtcctattaggtgtctttcttttatcccctatatatactcttgtaagccgtacggaaggggtggcgttcccattgtgattcccctacgtttgtaatcatctcctctatagtgatcattgccggtcggcgcccgtggttttttcccgcaagtgttttccacgtaaaaattcgtgcctccgttgtacatctattttcataacacaattaatatattaaattaagtgagaattggtcaaaagatggaattaattaattatatttccttttcaattcaatcaagatcatcctgaaaaatagttaatccctctcttttctctctctctaaaccgcatatacgtgcatggtaatatatactccctctgtcccataatataagggattttagagagacacatcataatactatgaatctgaacaaagtatgtagcacatttctctaaaatctcttatattataagtcggagggaatattatatattttctgaaaggtagcgtacacatgcatgatttttgtttgagactatatcatgattgctagctataaatgagtgataagtcaactacccaaccacttctcctgtttctaaatgatctgataagtgccacgtatgccacaggattatatgctacatgtcaataagacaatatactccatccatctctaaatataagggattttg

SEQ ID NO: 428 - DNA, 6468 bp, Oryza sativa
taaaatcccttatatttagatagggatggagtaacaaatactaacaatacaaagaaagtgaaaggtgatcgtcatgcatgtagctagctgctagcctgctactacagggaaagaaaactaatggtgatcagttcatgccatgctgaagttgctagctggaggataaagtgtaaggacgacgatggcgcgtgactgaggaaggatgggatggcacgcgagatcaagaatttttcctcgccaaagaaaataagacgattgggggctgcagcctgcatgtggagtccgcaggtctataggatatacgagttgatttgggggccttcttatttttggccgtatattagaggtccgtatggacctcgtttcttcacatccacacacacaaaaacaaaaattgtatgagtgtttagtttagggtgctttactgaatatgctcttactttttaactctccaacaagttcaaacatgtaatagtaatatgcccatacttatttgacagaagtagttacgcacacggaacatatggacgtgctacacgtgatgggaggaagggatggaaggaacatgacatcggttttagatactctctctatctatttttgatagttatattttatcttggcacaattactaaggataagtatatcatccatttaaacatgctactagttattccttataaacaagcgatttatcaatatttacatttctcgatgcccaccaattttgcacggaagtatggagagtcatcaaattcgacaaagtcattaagatgatataggtggttggattgaaatatgcatatcaaacacaaaatttttagatttggaaatatacctatcaaaagtaaatggagagagtactagaggcaaatcttttaaatttgaatagcctaagctttgaatggtcaagtcggagccccgtgagcttaggccacggaatatagctaggcttggcacggtggaggaacctatgaggggagagggcaagagacaacgccatacagtgggaggggccaaaggggtgagaaacattgtgacaaagtccacatgacctaacaataatacggtattagacgataatgaaacgtggtgtggttagagcaggatctgctggtgaaaaggaacaagatgagagacctgaagtgaacttattcaaggctagaattaaagtgaagttgaaaatggcttgggactttaaattagaggttttatacaataaccctaaaattggtcatacttgatggaaaaatggagattattttgttccttccctctttcccgtattttttttatttcaacctaagtatgatctttagaattatctttatttattatactttagaatattaaatccattgttttgatggttgaaaatcttatcattcgtatatctactagtgacttgggcagatataacacggaagcatccaaagggtgttatagcgcggagaactatcagtgattttcctcactgcaaaggtcagtgagagaccataacataagccctagcatggacagaacgactctcacaattcttatcttaattttctcttaatatttgtacaactattttaattaatgcatggaactttcatgctatattaaatgaaattggacaaaattggcacgttttaaacgtcgattcgtaaaaaaataaaaccacaaaagagattcgataacgagaggatgtacttaggaaactgggagggccacatatccatccgtcgtattatttctctttcttcaccatcacgactcttcgtgaagaatcactgaggaaacatgattgtatatgtcttcttctaaaccgtatgggccaacatacatggtttaatgaagcacttgttttctttttctaaaccgcattaattaccagttaagatcaactttaaaaaacactgtagaggaagccccacatcaaaaattatattaaaataggaaaattaaaaaaaaagatacaacatcaacttttttaaaaaaaaactgtagaagaagctaccacagtaaaaagtatattaaaataggacaatttaaaaagagttacacatactacgtagtagtatttaacaagaggaaataagagatctctcccatctaaatttactcggaaaaggagagaaagatcattattgaagaatgtcttctaagactacacagagggaattatactatcaaaaataagcccatggttttcctcccgattgataggaacatttaggaaaattttccattgatcatgctaactgacaagagaacagacgaccgagaccaaaattgctaccggtgtgaaccttcaaagagaaccagtagtgataggcctataaaccggtattgttagcccgttctgtggcagtagtgcattgatcacgccgaacgtaagccaaatcattgatgacccaaaccggttctcattggtgatttgatcatgacgaactcacaacaggacgccggcaccaatctaatctcatcctgttcgctaaatggagaaacaccatatgatgttttgcagccgcgtcctctctactgaagatatatatgcacgtcgtccattcttaaaagctgtaaataaatatcctactgtactgctcgaggcttctttcattccttcgtttggcttcagcaccacacactttctaaattgctaaatgatagatttttttacacaaactttttatatagataaagtttctttgaaaatcaaataaatatattttttatatttataatagaatgcttaataaattatataataatgtcatttctcattttacgtgcagaaaaaaaaagcaaaagcgaaacgaactttcaaatagacgcttaacaaccgcacttcaccacttttgggttggagtatgtgtttcaaccactatacttcatcaccttcgaatctatcgtgaactctaatttagtaattctataatttgacggtatatcagatctatctttaactctcaatttaatattttatttatttataaaatttaaaattaataattaatgggctgtaaatgacgtggacttttattttaatataaaccgatagagttttaaagataacaactttagtaatcacatgtcgtgtaacacacaagttagtcgtatatatttcttcggttaatttagtaattttttagctatataaatatttcttgttttatcctattaatgtgtaatttttaggttttcatagaaagaatggtggcttctttttaagattataagataatagatggacaaacatatacatataatcatcttgcgctagcacaagagtcgaacctacaactactcactaaattggtcaagataaagataaagcataactatcataattaatgaatattcttatccggttacaccattaaaatactatccagtccttgatcgatggtgaactagctatctccaacatatagaattaatagatggaccttacccccattcaaagaatattttttttggaaaatcacaaaagcacaccttatgagatgacgtgcatgggaagtttagtaccaccatacacagagggatacctccttataaagatgatactcttctagccactttaggcatgtgcggagagaagagggtgaacacgtgctcctcgcctcacctggcatggtggcgcacgtgcacatcgaatgttccgacaaaattggttcatcacccatgtgtagatgcagtctacttttgtagttttgttttgctgcggaaaattcggatttgtttttcggaaacagttctacttttgtagttttgttttgctgcgggaaattcggatttgttttttggaagcagttcgaataatccggtgcgtgagacggcatggggtccaaataagttacacgcgacttatccggttcggttacacggaatagagatcgtgcaggcgtcctgatcaaaagtcaagcctccgcctccacgcaatacacgtcaaatcaatttagggtttgctttttcctctgtattgcaccgtcactcgtagtctactccatcccgcttgtcggcgtgcaccggtacggtgatgggggggcaggtctccggaaccttcgccttcgacgtcctgcactggggtgaaacggtgtggagtccgaataagttacacgcaactcatctggttcagttacgtggagtggagatcgtacatgcgtcctgatcaagcgtcctgatatctctatataagtcaaaccacagcctccacgcaatacacgtgaaatcaatatagggtttggctcttcctctatactgcactgtcgctcgtagtctactccaccccgcttgtcgacgtgcgctggtgatcgggagagcaggtctccggaaccttcgccttcgacgtcatacaatgggagaaggcggtaataaagtttatgggaagcgcttcgtacgactgctccctgttcgatcacaacggcttgttttccttttcgcttgcgtgctgcgcgccgtcgttaaagcccgcaaccgcgagtctttcctgctaagcagccggttttccgataccctcagtatgtgttcaacatattacgcatatttggtctgttcattctttactgtctagtttacatgtgtagattttatgatgcgtttatgctagtttatctctgtaatatcatgatgaaataaattaaatcgttatgttatgtgcttataaattcaacatgtacacacccacgctgccaaaaactgaaagctagctagccgctcaagcaagcatggcgcacgacgcaaaaatggcggatgtactatctcagggttacgtctacctcgccatggctctcgtggcgctgctcggcgtgctgctcacgaagtgcagccgcacggcgacggctcagcggcggctgcctccggggccatggcagctgccggtcatcggcagtctgcaccacctcatcggcaagctcccgcaccacgcgatgcgcgatcttacgcgccgccacgggccggtcatgatgctccggctcggcgaggtgcccacgctggtggtgtcgtcgccggaggcggcgcaggaggtgatgaggacacacgacgcggtgttcgccacgcgggcgctgagcgccaccgtgcgagcgggcaccatgggaggcagggacatcgccttcgcgccgtacggggactactggcgccagctccggaagatcgccgccacgcagctcctctccgcgccccgcgtcgcctccttccgcgccatccgcgaggaggaggtcgccgccacgctgcgcacggtggccgcggccgcggcggacgggcgcgccgtggagttacgagcggcgctgtgcgcgctcgtgaccgactccacgtcgcgcgccgtggtgggggaccggtgcaaggagagcgacgcgctcatccgtgcgttcgaccgttccatggagctcgcgagcgggttcaacccggcggcggacctgtggccgtcgtcgcgtctcgccggccttctcagcggcggcgtgcgcgagattgaggcgaacctccacacggtgtttggcatccttgaccgcctcatcgagaagcgcctgcagcagaagaagactgctccatcgtccgccgccggcgaggacattctggacgcgctgctgaggatacacaaggagggcggcgggctccagttcccgctcgacatggacagcatcaaattaatcatcgctgtaagtgaccaactgcatgcatgccttcgtgtgatttctcatgaagaacaagtattgtcgccgcgttttgtgttttgatgctgtcagagtgtgggtggtgttttttttttcattttcctgagtatgacctcccaagtatagctgtccaaaaagcccgaggctcgtgagctgaagggttcaaactttcggttgaaggtgtgtccgaaattatttcagaccgaaattatatgaatttttgaacaaaatttgaacaaaatattaccaaattcacgaaaaaaatgaaaaaaatctaaaaatttcagccaaaataatatcgtatgggggtacgatagaaccgaaatttcaaaaatttcgatccgaaactgtgaatccttttgagctgctcgagcttggctcgctcgactcgtgaataatccgaaccgagcccaagtctacctcctccaagctcgcaagcttgacgagccaagctcgaatagttcgttgagcctaggttgccaacatttcttttcagctggcgttactgtctctcacatttttaaaatttttcttgtagcagagacaccacaactactactcatctcccaactcctaataaaaagctgcatagaaatagagcatgggttcacgcctgcaggccctggcctcctgctagtactattagcatgcatgcatctccattaatattactattattagtcacatcatgttttaaaacgataatagttccggtacaagtctaaggacatctacaatattgtgctataagaatgactagccatatatattgtaggcactagccataagatattaaatgctaaaaaataac

SEQ ID NO: 429 - DNA, 1292 bp, Oryza sativa
ctcggctcgagttagtatcgagctcgagcctacacatataagctcgttcgatcaagctcagcttgttgacagccatattcttaaggttataatcttataattttttcctactttatcaatatgaatttcgtactgtctggtgcgagtcattaaaaaaaaagtattgtcgccgccggtaacctccaacttgccgtatgtggagcaatgacactatatatgatatatggacgcaactatactgagcatagtagcgtgttagtcctaatccgcgaccagcactgtgttactaaaaataaaatcacacattgtttttgcacaaaaagcactgggtcctccacgcaacacgcatacccagttgacctcactttgattgctactagtacattcattagtgcatgtcttgctttttctttttatagaaatttttttaaaatcacttatccgatctataatctgattatatcgttgtgatcgttacaattaaatctttataacaagatcttacatgattatattctaataaaaaaattatttatcttgtaaattacttttattatatatgtaagttatttttatcatatatataaattacttttagatttaacctctttaataacttatatcttttaaatcacatattgttttcaagatctatttgcatcattgtacttgtcaacatttgagatcttgactacggtattttgcatagtatggggatcgttggtatcagggtatatacgagattgaagtatggagacaaagatttttatataggttcgggccccttatctgataggtaatagccctactcctgttggccaaagtcggtgttgctcttcatttatctgaattacgcaagtacaataattgggataacatatctagctgtcgtcgacttggcggcatggataaccgacacgtagtcgacgacaaggtagtcttcctcctcaagtatgaactcgtcgagatcagagatgacgctagatccctcttgccggcctctgtaggcaccggatggggtatgtctagactaatctctgatgttgatatctggcatgtcttgtcttgtgtgttgatctgttgtgtcttgttggtctgtgtctatcttgattgtcccactctcctcctaaggagtctatttatacccataggtgtccctttgtccaagtagaactagggagaccaatatggatacaatccgagtagtccttatagtttccatatagaactatatttgtcatgattacgaataagaaataccttctattctacgacttatggaatatacggat

SEQ ID NO: 430 - DNA, 15123 bp, Oryza sativa
  unsure (1)..(15123): unsure at all n locations
ataaaaaaattgaggtgtattaacatgtcatataataatgtacaaacatgcaagtttaaattcaatttctacatcttgcagcgaaaaaaacaaattaaaccgcaactagttaatgtatattcagagtcaaatttgtttttttcgttgtgagatgtagaagttgaatttttacttgcatgtttgtggagtgatatatcacgtgttaatacatcttcttaattttttttttcaaattttttcataatcatttgagtgatgcaaaaatccacttcctacatattcctataatctattcaatcaatgaccccaatctcttcgtatgcaggacctcttcagcggcggcggcgaaacggtggcgacgctgctggtctgggcaatggcagaactgatccggaacccaatggccatgcagaaggcgacaacggaggtgcgacgagccttcgcactggctggcgccgtgtcagagggcaagggcgcgctcggcgagctccggtacctgcaccttgtcatcaaggaggcgtctcggctgcacccgccagcgccgctgctgctgccgcgcgagtgctcggagccgtgccaggtgctcggctacgacgtgccgcgcggcacgcaggtgctggtcaacgcctgggcgatcggccgcgacgagcggtgctggaccggcggcagcggcgacggcagctcgccggaggagttccggccggagcggttcgaggatggcgccgaggcggtcgacttgaggggcaacaacttcgagctccttccgttcggcgccgggcggcggatgtgccccgggatggcgtttgcgctcgccaacattgagctcacgctcgccagtctgcttttccacttcgactgggaggtgcccgacatggccgaccctgccaagctggacatgaccgagacgttgggcatcacggcgcgccgcaagggcgacctcctgctacgccccgtcctccgcatgcccgtgcccggcgtctactagacgccgttgccagaatttcagccatctgctcagccttctttcttgtgttacatctcctaatcaccgttatacaagtcaccagtaacactaatatcgcaattatatatgtcaaacacaacaagccatgttgtagcctcgctgttaaataagtggagaaagaattgaaggagaaaagccgtggaattatgccgcacaaatctctcatgttttgtccgactacgggtgtaaaaaaaagaagtccattttactttctgaactatttttccagagcacttagcccccaaaataattttccgcttatttcacactcctaattatcaaaatggctctcccaccaattcgttccctctcccacctctctttccctctccttcacctcaccctccacccttctcaaagcaggtggcgtggctcccctcccctccctccctccctcctagattcgacagaaggatgggagtgtggcggcagcaaccaccacatgccacagtggtggcaacacggagggctcgtggtggcgctcccctccctagctcccacctcccagtccggccgacagcggccctcccctcccgtcccctcccagatccggtcggaggagggagggccgcagaggcggtgcggagggctcatggcggcgctccaatcccctagctcccacatcctagatccggccgatggtggccctccccttccctcccatccggccggtggggggggaggggtgaagggtggcgtcaacacgaagggctcgtgggggcactcccctctcctagcttccacctaccagatctggcagatgagggccctcccatcccctctcaagtctggccaaaggggaagggcgtcggcgtggtttttcccctcccctccctctccctcccaaaatcctaaccctagatccggctggaggaggagggcggcgacgggtaagggtggtggcggagaattttttttttgtttgttgaaaatattttcatagtcgggtggatttagctcctgcgaagatggagaggtcgtctgcgaaatttattttcttagacggagaaagggtccgcctgcaaaaatatattttgacagcttgcaaaaatacttcttcttgtagtggattcacatcacacaaatacacactactgagaggacttgtaggaacagagcaacgaaaagctggaaagcacaattgtctgaacttcacttatttacttcacaatgcattactctttgctggagactaattaaatgtttcttttatagacaaagaaaagcagactaggccggtaacgctgcatgcatgcagcattcttggatggctctggcctaggccggttgtgcgatcgcctaagagctagagcggacggccccacccaccaactctccatcccccaggcccccacccgtggcagccgacgtacaggcccagtactccagtagaggccgagtctcaccgggcgcgtgggcgcgcggccattcaggattcagcccaggccaccgcacgtcgcttcgtcttcgatcccatcgatctactgctgcgccgcgccgttctctcccatcgtctctgcgccttctctcctgacctcgaagcgaagaagccgacgagggctgttgatcgtctgattgagtgcagccagccggccctgatcgagtgatcccatctcgcaataatcaaagcaagcacagcagcaggtagccttcttaggtcaagttttataacagaggaggtggtcacatctaattttgtccaactctctgtctctcatatttcttgaaacttgtgtggaggttgctccttacatgaggggtggctgctcctctctctctcttcttttttctcctccacatcatcatttgagtctacatggcatcttgtaattagtgataagatgcttatagtacttgcgtttactccacccctcctgaagctggagctcagccaaatagtttcagctccaccaaaactgggaatggagttggatggagctatctcacaaaacatactagagttgtggagctgggncnnnntngtaaagagcctggttccggtgctgaggagtttacgcctagttaaatagatatggacaccatccctttttttgaattcgttgcgtcggttaaatgagagaccgaaccctgagacctaccggggataaaacgactctcacaattcttaccttagttttcttttaatttttgtacaactatttcaaatgcatataactttcatgctatataaaattggatgaaattggcacgttctaaaaaattaaatccacaaaagagattcaataacgagagggtctagttagacaactgtgagggccacatatccatccgtcctattctttctctttcttctccatcaagaatcactaggcaaacatgattatatatgtctttttctaaaccgtatgggccagcatacgtgttttaatgaagcacttgttttctttttctgaaccgcattaatgtaccagttaagatcaactttttttaaaaaaaatactgtaggggaagccgcacagtaaataaaaaattatattaaaatagactattaaaaaagagttactacatatttaacaagaggaaagaagagatctctctcatctaaatttactcggtaaaggagagaaagatcattattgaagaatgtcttctaagacaacacagcaggaattatatattatcaaaaataagcccatgatcttcctctcgattgataggaacatttaggaaaattttccattgatcatgctaactgacaagagaacagaccgagaccaaaattgctaccggtgctaacaatatcagctgagaaactagaggaatggaaggcccggaattgctacaggaagtgcaactcaattatagtactaacagagatgagatgaaatggaaactaaaaaaatggggcaaattctcagtcaaatccttgtacgtataaggaatagacttttttttggggggggggggggggttgagaaatatgaaaaactccaatagccctgaaaatcaaaatttttatatggctaatgctgatagggagatttcaagctgctaagcaactcaagaaaatgaatcggctgggaaaccaactctgtacactttgtggagaaattgaagtagaccatgtgatgtttagatgtgctccagcaagatttatatggtgctgtgcgagagatatacttcctccgttttacaatgtaagttattctaacattttccatattcatatttatgttaataaatttagacatatatatctatctagatttattaacattaatatgaatatgaaaaatgctaaaatgacttacattgtgaaacggatggagtattaaactagagctctgtacctcgaagcaaagggcagagctgacttgctcagaaatttgaaggaccctggagagaagagcaacctagctgtatttgccttgtttctgcagcttgttgggccatttggcttatgagaaatgatttagttttcaatgataaatatatgagacttgctccggtccaataaaaagtatctcgaggtaccggtacttcacggtactaaattgtttccgatcgttggatctaactgtgcaggataggtattgttatattcaaccatcgaaaaagattggatactgtgaaattctaagtacctcgaggtactttttactggaccggagtaaatctctaaatacattatgaacatttgtagcattgctgacaaggtggtgaatttgatgcaacagtggaggccgctggatcgatgaagatcaatggagaggtagactttttcaagaacttgctgcttgccagaatcaggggcttggaaagagaggacgaaccaagatgaaggcggtcaggacggtgaagaagaagctagctcaaggcgaggaggaagtggaatagcagtggcttatgtgccgtttttgcgacaacaatgtagtagtgtcttgaaaatgtctagttctgctgtttgttgggtgtgtttactttttggcccaatgtgggtaataatcttaggctgcgttcgttcgggtaacatcgaggagataacacctcgttttccacgcgcacgcttcctaaacaactaaacggtgtgttttttgcaaaaaaaaaatttatagaaaagttgctttaaaaaatcatattaatctatctttgaaatttaaaataattaatactcaattaatcatgagctaatggctcatctcgttttgcgttttcccaatctcctcgatcaccttctcctcaaactcacccttagttttttttattttttttagtgctttgtttgcaattgcgcgcaagttggtggccccaacgtcttacagcatcaccagctgtcccacgtcactcctctccttcccgtgtgttagatggaggatctcacgatcccattcggcacgttagatggaaaaaacaggagaattttgttggtagtttaatcgagcggctcacttttagtttttaataaaatttagactttcttttggagagtttttttttacttcctatttttcaattttggtttgattcaccacgttagatggaaaaaaagaagagaattttattttttgtttaacaaaacggaattgctaacttttttggacagattttgcatctccaaatcttacagattttaggacatcggatggactttgagattcgtgctccatgtcatctcctccaactccggcaaacctcttcttctctggcgccggcgaggaccctacgggttagggtcccggggtggggtggggtgggagtcttagatgcagggggaaggggaggagttcgccggctctagagggatggctggggnaggcggtagcccgncggtgggaggcggatcaggcgggcgacgaggcggcttcggcggcaccggagccgcagcgttggaggagggtggtgggccagcatcggtgacaggggcacctcgccgtcgacggctcgagaagaaaggaggggaggagggggtagggggagaaggctggtcgggggaaggggggcgtgggctcgccttcgccgttgacgccctctgccagccggtgaggctggcggcggtgcggtggggcggtggcagcgggggattgggcagagccgctcgcgaacgcgatgggaggggaacgagaggaggagaggcagggttaatgcatttgcacgaatcataaagcacatccaatggtccaaaatttgaaagatgaaaggtgggattttctgttaatagatgtatagacagctctatttttaatttaggaaaaaaaacaaggggagataatacgtactctcttagtgatgctcttaagttgtgcttttttttaagtaaaactggcgaagataaaacataactatcataatgaatgaatattcttatccgttataccattaagtacaacccggtcccttgatggtgaactagctatctcgatcgatccatatataacgatatggtacacatccccacgctgcaaaaaacggaaagctagctgctcaagcaagcatggcgcacgacgcaaaaatggaggatgcatctcacggttacgtctacctcgccatggctgtcgtggcgctgctcggcgtgctgctcaccaagcgcagccgcaaggcgacggcacagcggctgccttccgggccatggcagctgccggtcattggcagtcttcaccacctcgccggcaagctcccgcaccacgcgatgcgcgatcttgcgcgccggcacgggccggtcatgatgctccggctcggcgaggtgcccacccttgtggtgtcgtcgccggaggcggcgcaagaggtgatgaagacgcacgacgcggtgttcgccacgcgtgcgctgagcgccaccgtgcgagcggccaccatgggaggcagggacatcgcgttcgcgccgtacggggaccgctggcgcagcttccgaaagatcgccgccacgcagctcctctccgcgcgccgcgtcgcctccttcggcgccatccgcgagaaggaggtcgccaccatgctgcgcgcggtgcccgcgcccgcggcggacgggcgcgccgtgnaaatgcgagcggcgctgtgcgtggtcgtggccgactccaccgcgcgcgccatggtggggaagagttgccaggagcgcgacgcgttcctccgtgagatcgatcgttccatggagctcgtgagcgggttcaacccggaggacctgtggccgtcgtcgcgtctcgccggccgtctcagcggcgccgtgcgcaagatcgaggcgagcctccacacggtgttgggcatcctcgaccgcatcatccagaagcgcctgcaggagaagattggcggcgccggcgccgccgccgccagcgaggacattctggacgtgctgctgaggatacacaaggatggcggtgccggcggcctccaggtcccgctcgacatggacgacatcacattagtcatcactgtaagtgatcaactgccgaataaaatttgaaaatatacccatgttttttcataatttacgtttatatacacggggaggaggatttgcgcaaatatacctctcccgcttgttagtaacgcgggagcgaaacgaatgcgtggcgtggtagtgcgtgaccgaaaggcgcagcggttgcgcgcaacggtggcgcgggaccggctcaccacggcgcatattcgtttcgctcctgccttcctagcacgcaggagaggtatatttgcgtaaatcctcctcccaatatataaaaacgcaaattatgaaaaaaaaggtatatttttaaattttattcatcaactgccttcatgtgatttcttatgaagaacaggaacctgcaacttgccacggagcatgacactatgacatatggacagagggcttgcaatttcagaacgaaattttcaaaatttcagtaattttgccccccaccgacaagcacatatattgccgatttttttttcaatattttgtgaacttggtcaaaatttattcaaatttatgaaaaaatattatattttccaataatttcggcaaaaaaccccattttcagaaatttcggttgccgctgaaataccgaaattttcaatgaaagcgaaagtgtaaatcactgctatctaccgatggtttatttggtgccaagagaagtaaagcgtagaacattcactcaccagccttttcgcttttgtgcccggttgaagatacgggaactctaattaatcacttaagtagatgtccaaccttatgtcatgcaaaaagttaccccattcattttaaaatataaggcacaacgatccaatagaattagaaatcttgaatatgaaagagttaaataataataatttggtggagggaatatactaagttaattgtatgcatgcatgtcttatattataaaaaaaaagtagttatgtcttatagtatggaatggatggagtacaagaaatcacctatacttttgtctacaattttttttttcaaaaattggacagttgtaattataatatacaatcataatgtaattaaactataactacaactacattaaacttgtatgtaactttagaaaaagccctccataacatgatactccctccatttcaaaatataagacacaaccaccctcaacccaaagaccaagaaaccattattatcatctcctagtttagatcaccctaataaatataatgcatgtatccaatagaattagagatcttgagggtggatgatttaaaaaattaataatttaatggagaataggtcctagttaattgtatgcatgcatgcatgctttatattatggaacattaaaaaaaatagatgtgctttatattatggaatagagagagtactatcattatattctcacacgtgtgtgcgttgtgcctttttttctttcccacttacataaatcttgaaaaaaatccaacagttcaaaattacgtgaaagttacaaataaattacattatagttacatgtactatcattatattctaattacataattgtttctaaaagttgcatggtgaagatactaagacaccacgagcatgcaactacagaatgctcatgcttgtgcactcttcctcactattgtttcttccacatattcctatagtctattcaatgaccccccatctcttcatatgcaggacctcttcagcggcggcggcgaaacggtggcgacgctgctggtatgggcaatggcagagctgatccggaacccgatggccatgcagaaggcaacagcggaggtgcgacgtgccttcgcactgcccggcgttgtgtcggagggcgagggcgcgctcggcgagctccgatacctgcacctcgtcatcagggagacgtttcggttgcacccgccggggccactactgctcccgcgcgagtgctcggagccgtgccaggtgctcggctacgacgtgccgcgcggcacgcaggtgctggtcaacgtctgggcgataggccgtgatgagcggtgctggccggccgccgccggcggcggctcaccagaggagttctggccggagcggttcgaggatggcgccgaggcggtcgacttgaggggcaacaacttcgagctcttgccattcggcgccggccgccggatgtgccccggggtggcgttcgcgctcgccaacatcgagctcacgctcgccagcctgctcttccacttcgactgggaggtgcccggcatggccgaccctgccaagttggacatggccgaggcgttaggcatcacagcgcgccgcaagggcgacctcctgctacgccccgtcctgcgcatgcccgtgcccggcgtctagtcgacgcccgttgccagaatttcagccacctgctcagccttctttcttgtgttacatctcctaatcaccgttatacaagtcactagtaatgctaatatcgtaattatatatgtcaaacacaacaagccatgttgtagcttctctgttaaataagtggagaaataattgaaggaaaaagctgcggaattatgccgctctaatctgtgtcaagtattacggttctaaaaaaagaatttcattttactttctgaactattttttcagagcacttagccccaaaataattttccggctcattttctattccaaattattaaaatggctcaccttactaataacaatactccctctatacccgttaaggaagtcgttcaggataatgtttaagtcaaaccttggaaatataaatcttgaataacttttaaattgttgaatttgaaaatgtaaaagttataggaatagatttgttttgaaaaatactttcataaaagtatacatatatcacttttcaacaaatatttttatagaaacgagaagtcaaaattgtgttgtagagaccgtgtcgctgtccaaaacgactttcgttatgagtacgaagggagtacttctttcctttgtttatccagtgatcccatctcgcagcaatcaaagcaagcacagcagtgcaggaccagaggcacaacatagcaggcagccttcttacttcctccttgattagttctaagaaagattaggaacgtaggatttttcttgtttgtatgattttttcttgctatttaatttaatttaggtgttacaatgttacctaaaagaggctttttactgtccttgattggaggaggtaccatatcctagccatccattccactcaatctaacggcctaggaaggcttggtacctagcggtaccacatctcccgcaaaagcaggtacggaatgttgttgatggtgggagggcaattttgtactttcgcatgcaggaatcaagttggagcggagcaccatctgtccgatgcagtcgtctactcatcgactatcaaatcgaacagaaaccgtataggcgaacacggcgacgagcctgagacaaccaatgtggtggtcttccgggcggcagtgacctcgggggaggtgggccgatggggaacgccggcgacttcgtggttccctcccgtcagtgctcccgcttcctccctcctcccggttcgatcctgacggcgccgcattaattctagtccctcctacccattccaccagagcgaggacgggcatcgcaagggcgccggcagctgcaaggtcaaatagcgccagggcgattggcagctagggctacggtgaggccaccaggaaacttgaagcagacaaagcttttcactcgagaagctcatctagagaagccaatataaatccacgaatttcagaggcctcatggcaagaagttagaagtcctgcaaaccagacatttgtttgcaagctaattgcatcgttatgcgctgaaccacaactaattacagaaaggtttacaaaagagccttttcaagaacaatactccaactaaaacggaacaaggagcttgaagaacagtcatcatcagaaagttctgaatacatgtctgacataaattcctaacaaatcctatattccacagacaagatctgaataaccactgcgtacaacactaaagaaggttcagagttccacacttccacttcatttgagtttcacaaggttcactggttcagagttccaggaactgaacttggcattttcacaatactgaacactcgtacttcatgcgagctttgaagcacggcatatatactagcacaagacaaaccactatgcatgctatggacacgacatgactgtctaagtgtggagctctagtgctgtgcggagttgggcagggcacgatgaccaagagcaaagggggagatagccgacagatgaaggcaacggcgcactgtggctgcagcagaaaggacaaagaatcggagacggccaggggagggagaagtggcaccctaccgcggggaggacagagacgctagcagaagaagcggggaggctggctttatgaagcagcgacgccgtggatcgatcgtcggcggcgagatagatgggtggaggcggcgctatagatgggcggccgacggcgtcctggaggaaaggagaggccgcaccatccagggatgtgcgccggcgccaaagcaagtgaagacaaggatgcggagcggaggggaagaggacgaagaagaagacggagaagagacgatgttaggtgtaggagcggaggggtaccacacgcgcagacgcgctattccgatcgtatcctttgtgaacggacggatggatggagttggtgcctcccagtactagaacctcatggtacctactcaaggatggtaaaaatactctacctaaaaagcatttgtcaggtgctcacaaaaaatacaaaagaaaaggagacgagacgaacagtttattgattcgcataggcaggaaagcatgaatggcttggttatgtgcaacattgataagaatttcttggacaatattgatctcaaaactgtcgttagtgattttgctttaagaaatacctgaaaaagtttttttataagagacaagtgatatttgtgatctcctattaagaggtattcatactactttatttatgcaacgttttttagttatcaattatactatcgatattatttattatgtatgatttattgtatatcatgttagaaatgttacttctttctctgtaaaggatataagtagttatagtgtaaatattacaagaataagaatagtcttaagagcctatgataccgagtttgtgtagagccctcgaaattgtatagccagccgatggaaccgaggatgagacggcgcggccgacggcgctgcgatggggccggcgaagacgaggcttggccggagcggagaacaacgtcacgcggtgctagggggtgacgacggtgtagtcggctggcgcacgggcggcgtggccgaagacggttggaggtggtgcggcgggcggcggcggcgccactggttatcggcgggggcgcgcttagaaggagagatttaatttttggttttccattttaattaactgtgaatttggtttttggttgatttaaaattatttcttgtgctatgaaaattcaaataaaaattgagggaccaatttagagcatggagaattaaataaaaatattccaagccactttcaaatttgtcttggatgtattttagtgtttgatatttcttttagattttttagttatttctattattctttttagaaaggtggtttttaacttgggataaatttatccggatgtgacaaatactcaccaaataatgtgcaaaatagaaaacgtatatcccactaataaaaaaaatctactaccatagttagctatatcgttatttgcgtatatgcattacgagaacatattttgtgtaaacaagcttcacgtgcatactttatggacaccaactaacaaatatcataaaaaaactagaacaaattatgtatacattttcaatagtattacacctacatataaaatcttaagcttaaattcattttattttagccataaaaaatttggcagttctaagactacaagtctattattagaattttgtctttttattgccctatgtaaaataaatttaaagatgatactttatacatagatataatgctattgaaagtatatgttttctacatttttcggtgacatttattagttgatgtgcatgatgtgtacatgggaaggcttgtgtacattgatatgtatacttcagccaattaagagtaaattttacgaaagcatatttacttcgagcaaactatgacaaaactacgaatttaaggcgttgtatcacaaaaatatagatttagtgcagaagttctctcagaacaacttatttaagattgagtattataaaaataaatattaattagcaaaatgttataaaaaataaatagattgagtactataggtgtagtgctgatgtgaacacaaagctataatgtttgtagtccaaggtaatggaattgcaagggatttaaaccctatactttattttttttgataacttcaatattaaatatgcagtcttgtgatagtaggccttaaatatgtaattttacgataaacttgctgttaatatatgtagttttttgatgcaatgccttgaatatgtgtagttttgcgatagtttggtcaaaatatatgcagttttataaaatttactcactaattaatgatcttgtgtgtgacaatttttttaatatttgtgacgaaagcagatctcatcatagatggggctaaattacataatgaaaatgaagatgaagatgaagattaagttttttacacaaaacgaggtggtcttagcgtatgattgattgagttttaattattacaaacttaaaaaatagattaatatgatattttagagcaactttcatatagaaaattttcacacaaaacacatcgtttagaagtttgaaaagcgttccacgaaaatcttaatcttcattcaacttttgtgggagaaaataacgggaccatagtcctgtccgtggatgattatttttgtaactactagtgcttttaagtttgtatatgatcatatttatgtaaagacaattgatactgcactgcattgaccagcttatatgtgcatgagaaaaaaattatacaggttcaggcaataatagccctgtcctattgggtttgtacacgttagtatgtatggggtacggtacaatgtgtgatgagactaaattgtttagtacgtataaggtataagtgtgtggtgagactaaattgttttgtacacgtatggggtacaatgtgttagttcgtactgcactactgtagaaactattcttatatagttggtcaaagcatgtttttgcatggggtcaaccacactacacgacctctaagccccgttcttttttcattgacatgcaaattttttctcgattttcatcggcacgattttcaaactgctctactgaatggtgtgtttcgtatgatttttttcttgtaaaagttgatctaaaatactaaataaatctatttttcaagtttataataattaaaactcaattaatcttgtgctaattactttttttccattttgtggccttacttaatcttcatttattggacaccagtttaaggcatgtgaaaatcatgtattttcaccataataaacctaatcaagtgtggtcatataaatgtatatgtatctctagcgggtgtagggttagtagactaaactctaattgtcatgttattggctctaaataataatcaataaatatcattatacaaatcataaaattg

SEQ ID NO: 431 - DNA, 21082 bp, Oryza sativa
cctccccgttcccctctcctccccctccccgcctcctcctcctaccacgacctctatggtcagcagcggccggttggggtcggcggcggcggcaagtcgagagcggcggcgggcgagcgctgctgcgctggatcgggcaggagcggcggcggcaggccggtgggcgggagcagcggcggccggccgggtgagcaggagcgggagcgggcgctggatcgggcgggagcggcggcggctggccgggcgggcggggtcggcggcggcgcctcgcgctcccttccactagatccggcggcggcggtggagcaacggtggctggggaggcacagagctcttcggaatttgttttcttttttttaggatttgtagtatttttttgagaatttgtgatgtgatctgtgttgtgaatatgtgatatatttgtgattgtttttccagaatttgtgatgtaatttttttagaatttatgatgaatttgatctgtgattttggagatgtgatgtggggatgacttggggatttctctatttggggatgattaggtgatgtagtgattagtgaaatcaatatgagaaaaaaaacaattaaaaaaactgcgcgtcgccagttctagctctagcatttttagtcctggttgggaacactaaccgggactaaaaattgattttgacccggttatttgatctgggattaaagatactcatctttagtcccggattcatacttccggttgcaaaaccaggagtataaggggggagaaaagacactttctctaccagtgtaagggtgtgtttagttcctgaaaaaagttgaaagtttgaagaaagttaggagtttgaaaaacaagttgaaagtttatgtgtataggaaagtttttgatgtgatattatgtgatcgaaagttgggaataggacggaaactaaacacggcataataatgggtactattggtgctaccacaaatagttggactgaataagcggacctagctattttgactgaccgttgtccgatatatagttagcactaccaattatgatgacgcgacctgcctcactcctcagcctccgtcgctcaaccagcaaacggttatggagacctggcggagctacatcctacggagctccatatgtaattagtcactactagatacatgtatgctaaattcactactagtaaaaataaccatggttagttgggttggtatacctatttttagcaatccttaaattattttttctcttaaattacttgttcaatctataatataattacaccgctaaattttttgcaattaaatctttagaacaataccacatattgtagtatttcaataaaaataatatttagcttgttaatgtattttttaaatgttgcacatgttttatgtgaatgtttcaactagtatacgtatgatgtttcactagttaatttgcaaatgttgcatgccgtgttcttgcaatgttttggtaagcattttgtagggtttcaatagctacaacttaatattcatgtaaaaaaaatatttcaacaatattgtgctttttcaagtatattgtatctctcgtattacttctctagtttcgcttgttggtactcaatgtttcatatatgtgggggaaaagtatgaattacccctcccccgaactatcgcgctctaccgaattaccccccaatccacaaaatcggacattcttcatcttgtaaaccggacaaataacccctccggctcaatccgcggtggttttgatcctacatggcagtctagtcagcaattcatttataaaaaaataggtggccccacctgtcagtttgtctctcctctatctctttcccaatctctcactccctctctctcttctttagggcgacggcggaggcagcggcgaggcaacacgagcgcggtggcgggggaggcattgcaaggcgaggctacggcgaggtgagcgtggtggagaaggaggcgagcacgagcgcaggtgagtggcgcaggggcaggcggtggtctgcggcgcaggacatgaaggctggacgtcggctgccatagccacggccgaggaggaggcggagaaagaggaggagtgggtggaggcgggaggaagggatgaggagcggtgaggctcgcctcgccggtgtccatatacctccgggggaggagaggaagagggacggcagtggatgacgcccgcctcgcctaagacagcctcacttgagcccgcccagtcacgtaactagttcccactcccacggccgcccccttcttcatctttcttgccccatcctgagcccgacatggccgctgtggctagagcggtgctggaaggagaggggaggaggaggaggaggaggaggaggaggaatataggctgaagcgggaggaggcctagaaatcctccaccaccgccactggccactttccccattcaaagcctcatcactggccgccgcccttacctcgaaccccacctcctccagccagttgtcgccgacgttgcccccatcatcctcctcggcatggcccatcggccgccgcgccctccccacgagcgctgccgctcgccgcctccagtgtcctcctcggtgccgcccgtcgcctccaccgttctcctcggctcggcccaccggctgccgtgccctccccgtgacaccgccgtccaccaccgtcgtcgccgcacaaaatgcgagagagatgagagagagagagaaggatgaatcatggaagagagagagagagagagaaagggggtgagggggagagaagctgacatgtgggtcccaccgattattttttttaaaaaataccgatcagactaccacatgtacaccacgtgggacgaaaaccacttcagaacaattagggggcggagaggaaggcgagccaacgcggacgaacagggagcagtcgcgcgaagtgcttcccaaaaaccttattgccgccttctcccggtgcagtacgtcgaaggcagaggttccggagacctactctcccgatcgccggtgcacgccggcgagcgggatggagtagtctacgagtgacggcgcagcacagagtaggaggcaaaccctagattgatttcgcatgtgagcgggatagagtaatctacgagcgacggcgcagcacaaagtaggaggcaaaccctagattgattttgtcgacgggtggtacccgtagaccggatatagagggtattggggtacgttggtacaaggatctacgtaatacgatatcaagcaacaaaagacgaggattatactggttcaggccccttggtaggtaatagccctaatccagttgatatgggattatatggtggaaaacacaggttacaaagggaacaatggaacttgtcggatccggcgagatcgtagtcaagttggttcgactagatctcgatggcttggctccttgcaggctccggcttcgtaggctgtgtgggttgtgttggctctgagattcgatgccttaagccctcaccggggggtcccttttatatcacagatctggaggtctccaagtagaactaggagatatcagaccctattcgatacgttaatgacccagtcttgtccgagtaggattcttcccatccgtagattccgtgaaggatttccatagaatatacaggaagtatctgtatgcgcgcgggtataccataccgatatgttacatatatcgaagggtaaagggtatgcctaacccgtaaccctgacagtagcccccgacttctgcttaaaaatgggctcgtgtaaccattcacgacttcgggtgtcgagactgttgtcattcctggagcgaggaccgcggagacaggccgtagccgagcatgccattcaaagcccaacggtcatgagcgaattttaaattgaagtccaaaaaaccgccgcgcataacggacccagaaatttccggcgggcatctctctctgtccttggaattcgcaccgtcggtagtgcgcctatttaaaggaattttggagatccattttgaagtctgccaaccgtgttgaaaacattccacctgaaaacattccacctgtaagcgttcatcaacctaggccctttctccggcgatcttgaatcagcaatcaacctcggcaagtcatcttccaccagtgcgtcgctgaagaagcttcaggaatacggcgcccttcctggccatggaaccatggagagggaaacaggaggtactaatccccagcccatcttgggtcgcatggttgcgatcgaagattatgttctctgcagtcttctcactccaccttccgagtttcttctcctggttttgaatttctatggtctttctcttctccatttgaaccccaattccattgcctttcttagcatctttgcccatctttgcgaggcctacattggggtagagccttttcttgatctctttcgctcttactatgaactgcgttggatggaatccaacagggtatctggttgcgtcgggttccgacttcgggaaggcctgaagtcgcgttatatccccttccagtgcccttcttctcgcagcaaatggcggaataggtggttctaccttgagatcaaagattcgaaccccgtctttgttgttcccaaagaacaaccggacaagatttcttcttggaccgcaaagccccccttgaccccctctcttcagtcgtttatcgacatcatcgatgatctccgagtacggggcttgtcggggtatgaagtcgttgcagacttcgttaataagcggatccagtcgctccaggctcgggcctatccagcttataactattccggaccggaggacgcgaccagggtttctcctcggggtatctttctcacatttatcctgacatgcttatgttcgcgttcctatcgactcatcgaaatttggttctcgattcacaggtctaaacatcgaggccgtggagtgccgtgtcggccaggtgatgatcagcggtccgacaacggcgagcaacatccccacgcccctctgtgaaaagggggcggctgagcgtgatgatgctatcaacataagtgcatccgataagcatcgcggatttttccttcgagatcaccttatgacttgattaagcgtatgctcttcctctgactgacatcatcgagccactcatggaccatcaggtggcggcgtctctgaaagagaaggtcgccaaggaggcgtctgatgctgctgctgccaccactagtggtggcaatgttccgacaaaggggaggaagttctcctctgtaagcggacatcgtcgcaaggcgccgaccccctcggtaatttatcctatcgtcagattgtgcagccagaaggattttgccttactttgcattgaatgtctttcaggcctcggacacgtcacccccaccagcacgacgacaacatattgtgacgatcggcgagaagtaagtagatgaatttttagatttccgtgattctatacaagcgttgtgtgacccgtggtcgtcccgtagggaggcgcgggcaaaggctgcgcaagctaagtccggagggacttccagcgcgtcgcctgccgcggcctcgacggatgtcgtgcccgcagccgggagccgagaggcgacgcctagcggtccagtcagcgatcccgcggcaggtcatgatccaccagctgccatcctcacctgggaggagctccaagtcaagatgggcgcctcctcgaagcgggtgctcgcggcatcggctgcgagattgtggaggcgaggtcggaagcagcgctggcgaacgcgcgtgctgatcggctggtgcgcgagttggctgaagctcgtgaagacctcacgaagatgagggaattggtggccggcaacgagcgacaacggaaggggctcgaggaccgcatgtcggatctcgggaacaacctgtcggagatccggggctcgttgcgggtcacctacactggcctgcaccagctcgccggggagtgcggcatcaagtttacgatcccggtgaatcccgacgagttctcgctgacctcctcccttgcggaactggcgacggcgatgggggagatcccctccaagcatgcagccaggatcatggaggagacgtcgaacgggatctacaccggggcgtgtcatgtcctcgcgtgtgtaaagctgtcgcgtcctgaactcgatctgcgcgagatcttggatcatggggcggctagtgacacgcggagggaggtgatggaagaagtcggtgatttgggggagtctgttctccccctatttgaagagtaggacttcttgtacttccaaggcacaatttgtaaaacctgaattctgaccaccttcgtgcgggcaattatcatcctagtttacttttgtatgttgacctcgggaactcttgtcctttgtagagatgctgatgacgaggatgtccagcagcgcgggcagcccgagtcactggcgataattccggtactcgagtttgaaccacacgtgtcgcccgacaatgtggatcagacccttgatacggagacagggataacgacgacttccttaggttagtagtcccttcaccccttgatgccctcccgactagatcagccatgttctcgaaagaggcgtacagcttgacttagtggttatcaaattatgccgacctagagggtgcccttgctagccaagatcgtcgtatccaatactggaagatgaagtttgaagtggcggaactcgagagaaccatgctggccatgaagaaagagcaggctgtggaaacgctccgaggtcatgaggtgtggtttaactcgtacttgaagagttgctgcacatccatggccagagtctgtacagaacttcgagtggtccgcggagatcctgaggagtcggcggccgggtacatctcgtggcagaacggggcctgtgcccaactcgatggcatcggcaagcgtatcgacgaggccttgaagcaggagtgtcgtcgatcaagccgatacgccggagggcacgtgttggcttgcctacgagatcatcgcccgcgcttggacctcgaatttctccatgagggttttgctcgttctcggaggactccgacggagatagaccatctggcgaggtcgatgtcgccgttggccgagaagatcttccagtctatggactggcgttggccttcttggtagttttcgtaccctgtgacaaatatcttaggaaaaagatgtaatgtagaaaagatttgtgtaaaaactgtaagaagtattgtgtgaaatagtaaagaaatctatctttaacaaatgtctcttactctggatgtcgtgtgtaagagtgcgttctcagttaacgactttagtcagccgtttgagtcgcacactctccctagcccccagccttgtcgtcgaaggaattttctcggaggataaggctcttggacctttgacccgccttggttaaataagctctgatcctagcccccagccgtgaagttggaaagttgatttccgatttcacggcttggttaatacgcacggcgagaactcttacacgaccagatcttacatggtctttcgtctctacaggatctgacaagaccttatcggctctgggcgtccccagccgaagatcccttaggttcctcggaggccttgccaagacggcgtaaagggacataaggacaggtttcaacgctaggtgtcatcagggtaagggatcatcgggcgaaaacactttggttgtaatatgggcctaaaaataggcttcattgatactgtaagatgtcttacaggtatggatggtattgactcatacgtagaatttacgtagttggtcaatgttccaagaatttgctaactcgcgaccgtcgccgtctgcgattttgaatgcgcctagccgcaagacttgtgtgatcgtgtaaggtccttcccattttggtgagggtttgtttcgccctgcttggctttgaactcgtcggaggacgtagtcgccgatcgaaagtatgcgtgctcggatgtgcttctcgtggtaacggcggagggcctgttgatagctggctgctcggacggcaacccgttcacgatgctcctcgagaagatttacatcgatgtcccgctgttccccctggtcctcgtcggagtgcttctgtactcatgtactctgatgtcgtagctcgccggggagcatagcctcagagccgtacacgaggaagaagggtgtttccttgttagacgttgtcggtgtggtgcgtatggcccatagtactgatgggatttcttcaacccattttttgtcgtgtgacatgagtctgtcgtagacgtgggtttttatcccttgtagtactatgccgtttgccctctcgacttgtctgttgctttgagggtgagagaccgaggcgaagcatattttgacccccagcccgatgcagtaatcctggaaatcggcgctgatgaactgggagccgttgtcagttatgatgcggtgcggtagtccgtatctgcaaaatatccctttgatgaatttgatggcgttgtcggccttgatttcccccgtgggtactgcttcgatccatttggtgaacttgtcgatcgccacgaataggaatctgtagccgccctgccctcgtgggaatggcccaagtatatctagcccccagcacgagaacgaccaagttagagggatagtctggagcgcttgcgcgggtagctttgtgtgtttactgtggaattgacaggcttcgcatcgctggaccatgtcgcatgcatctttaagagcggttggccagaaaaagccttgtcgaaaagctttcccaaccaatgtccgaccggcggcgtgtgacccacatatgccttcatgtataccgaggaggaggtgtctgccgtcgtcggacgagacgcatttgagaagtaccccgtttggcgctttcttgtatagatcgttgccgaccatacagtagatctttgctttacgggttattttctcggcctctgtatcgtcctcgggcaactcctcgatgttgatgaatttgattagtgggatgcgccagtcgtctgtggtctcgatgtcgggggtgtccgggctaacttcgccgctaacctctttcactgatggcttcgtcaggatgtcgagaaaagtgccaggctcgagcgattctcgtctgaacgcacgttgtgctaggtcgtctggctcaatgttgtccttgcggtagacgtgtcggacctcgatcgcatcgaaccttttctctagcttcctgacttctgcaagatacttggataactcggggttagagcatttataatctttgtgcacctggttcgcgactagctcggagtcccctttgacgattagtcgcttgactccaagtgcagctgcagctcttatcccagcgagtagtccttcgtattctgctgtgttattggtcgccctgaagttgaggtggattgcatgcttgaattgatcttcagaaggagacgtcaagataaatcctgcccctgctccttggctgttgagtgcgccatcgaacgccattgtccatgtttcgttatcgacttggttgtctaacttgttatccggcatagtccaattggcaacgaaatcggcgagtatctgggacttgatggctgttcgtggcacaaagtggacatcaaactggctcagctcgactacccatttcgcaatgcggccgacaacatctttgtttctcacaactttgccaagagggaaaaaggagacaactgtgactctgtgggcttgaaagtagtggcgtagcttccttgatgtcatgatgaccgtgtaaagcagcttttggatctgtgggtatcttgtctttgcgtcgtggagagcttcgctaacgtaatagactggtcgttgtactttctctctctcgacaacaatgacggtgctaacggaatacggtgtggcggcaatatagaggaataattcttcattaggttggggagcaacaagtacagggggtttgataggtagcgcttgagtgcaacaaatgcctcgtcggcttcctgtgtccatacaaatttgtcttgtttcttcagcagagcgaagaaaggttgtcctcgttctcccatcctagcaacgaacctgctcagtgccgccatgcatccggttagcttttgtacctacttgagtcttgtgggcgacttcatgttctcgattgccttgatcttcttggggtttgcttctattcctctgccagaaacgaggaatccgagtagcttgcccgacggtactccgaacgtgcacttctctggattgagcatgaggcgatatcgtcggaggttgtcgaacgtttgccgcagattggcaatcaatgagtcgcatgtcttggttttgacaacgatgtcgtcgacgtatgcctcgacattgttgccaagctggtcgctaagtgcgccctggaccgtacgctggaaggtattccctacggttatcagtccgaacggcatcttaacgtagcaaaataccccaaacggcatgatgaatgctgtcttctcttcgtcctcttttgccatgttgatttggtggtagctagagtaagcgtcgaggaagctcaacaactcgcaaccggttgttgaatccaccagttgatctattcgagggagagggaagtgatccttggggcatgccttattgaggtcggtgaagtcaacacacattctccattttccattggccttccgcaccatgactggattggctagccactctggatgaagtacttctctgataaagccaactttgagaagtttgtcgagctcttctcgtatggcttgttttcggtctggtgcaaatctccgcagtctttgctttactggcttggcatcgggttgcaccatgagtttgtgctcaatcacctccctggggacccccggcatgtcggacggctgccaagcgaacacgtcagcattatcgcggaggaaggtgatgagcgtgagttcctatttctcgtttagtgtcgccccgatcttgacggtcttgtcggggttggcactggagagtggaacgatcttgatggtgccgtctggtttcggcgtcttgtttgtcttactcactttcttgggtggcgtagtcgtggcgagtgggctgggcgtttgctcgaccatgttgaggctccgcttgtcgcactgcaccgctagctttgcgttcccttgaatagtgattgttccattcagtcccggcatcttgagcacttgatacgcgtagtgagatgcggccatgaacttcgcaagtgcagttctcccgatgatggcattgtaagctgtgtcgaattcagcgacatcaaaggtgatctgctctgttcagaagttgttggcttggccgaaaatcacgggtaacgtaatcttgcccaatggtttggacgatgattggggagtaattccgtggaagggttgatcggttggtgtcaattcgctttgcggaattcctatcgcttccaaagtgctggcgaaaagaagattgattgagctgccaccgtcgatgaggactcgcgctaccttgatgttccgaatagtgggttcgaccacgatcggatatcgtcctgggatgatggcggtcttggggtggtcttcttccgagaactctatcttctgctcagaccacttcatcttgggtgcagccccctgccatgtcgaacaaacgtcacgttccactttcttgtattctcgctttgaggagtacgttgtggaagcgccaaagatgtgtgaaacgtggaggtcggagtctggatacgctggatccgattcgtgaggaacctcctcctcgttcttctcgaccacgcgtactcgcttgctttttcaaatgcgatgtgcttctcgagcgaatttttgaaaacaaggcaatcttccagggaatgtctgtccgtcttgtgtatggggcaccatgctttctttgtgtcgctactttgtgggtctgggcgcttgggagggttcacatattctgctgcgagaacttccacttgagctttccttttcccatttttgcgatttttctttttgcttgactcaaatccgtccgtggctggtttcttctctcccccggtcttcggcttatcgttcttgcgtcttagcgcatcatctgcgtgggcgcatcgctcaacaatctcgaacaatctccgagtggttgtgatgcgtcttgtcgccaactcctgtgtagtgtagcgatctctgacaccggatttgaaggcgcgaattacagaagcatcggtgatttcggggattgtatttctgcactcattgaagcgccgaagatattccctcaatgattcacccgagttctgagtcaacgcgtgtaggtcgtcttctatcgcgtggcgcttgtatgttccttggaaattggcgacgaactgttgccacaggtctgcccacgaagagattgagtagggaggaagatgcatcagccatgaacgtgcagaacctttcaacgcagttggtaaataattcgccaacgcgttgtcgtctgctccggcagcgtagagtactgtggagtagacttgaaggaactcctctgggtcggtgctcccatcatacttttctattactctaggtcggaatctctcaggccatcggacatcacgtagggaacgaccgaaagccctacacccagcgttgggggcggtgggttgtcggcggttgtgtgtccttcgtggatgtctgtctgacgatgaggaggacgaggatgatgacgatgacgacaggtcgcttgcttccagcgtacgattacgaggatgtcggcctggatctcgggaatcctgtcgtcgtctcccactattgtctcggcgccgatctccgtcatcatcgtcgttatggcgacggcctcgacctgtattgtctcgcacccgtcgttcgcgatcgttgtgatcgtggtggttgtcctggtctcggtcctcgtttgagcggtctctttgatttccgttatcatggcgccgtgaagagacatgacgccgagaacgattcacattgtctcgtgtgcgtcgtgcctctcggcggccgttgatgtgatctcggagatcgccggtgccgcgaggtggaggggtagctcgttggggtgattccctccgttccaggtcttcaccattgacatcgtcagttggtggctgctccgggtgtgctgcgatagcggcttcttcgaacgtgttgctgaggttggtcactgattcccgtagtcgttctatcaaacgctcgaggtcatcgttcagaatgggatcgtatggagtttccctcagtatagcttgaatggcccttatggtgctgggctggagtagtcaattgtcctcctgcttctgcgttggcgtgcgctgacgtgccaacgtcatcgatagccaatacctcccacgacacactcgttttcgatgacccatagtcttcgagaaggtgtaagactgatggttcgtgaggatcgatatcgattaccccaacaaatcgatctgaaattgaagtcgctccttgttccttgtcgttatccctgatggggacgtatgacttaggagacggatctttcatggcgccaagaaagaccttgcagcttgagaggccgtgattctttgtcttgtgaataggacaatagacatcacgagttggagaaacacgctgaattccacgctctttgcaggcgtgaatttcagcgcggacgttgaggaaaacccagcaggcttgcaaagtgtgttttctggttttgtggatagaacaccaggaccttgtggcttcggaagtcatctttgtcggctcgcggttcatgtcggaagaacaaggtttggccgcatcagaatccttctcgagctcggatgtcgtcgatgctctgttctccgtctcagcgggaggatttttcgacatgaagtcgtcttggtttgtagccactacgttctcgtttccggtcattgggggaccggttgagatcagcattgtggtgtaaaccgggaagacgatttcgccgacttgagtccacaccagcatcgttgaagcagggtgtacttggcagaggttggtgttgacgccgttgtcgacgaagctggatgacatagtagtagaaccttgagtaccaagtccccctacctggcgcgccactgtcgacgggtggtacccatagaccggatatagagggtattggggtacgttggtacaaggatctacgtaatacgacatcaagcaacaaaagacgaggattatactggttcaggccccttggtaggtaatagccctaatccagttgatatgggattatatggtggaaaacacaggttacaaagggaacaatggaacttgtcggatccggcgagatcgtagtcgagttggttcgactagatctcgatggcttggctccttgcaggctccggcttcataggctatgtgggttgtgttggctctgagattcgatgccttaagccctcaccgggggttcctttttatatcacagatctggaggtctccaagtagaactcggagatatcagaccctattcgatacgtcaatgacccagtcttgtccgagtaggattcttcccatccgtagattccgtgaaggatttccatagaatatacagaaagtatctgtatgcgcgcgggtataccataccgatatgtaacgtatatcgaagggtaaagggtatgcctaacccgtaaccctgacagatttcgcgtgtgttgcgtgaaggcggcggcttggtttatatagagataggtcgcctgatcagggcactcgcgtaaaccgaaccggataagtcgcgcataacctatccggactccacgccattttcacacaccggatttttgcactcgtgtaaaccggcggctcagtttatatagagataggtcgcctgatcagggcactcgcgtaaaccgaaccggataagtcgcgcctaacctatccggactccacaccgttttcacgcaccggatttttgcactcgtgtaaaccgaaccggataagtcgcgcgtaacctatccggactccacgccgttttcacgcaccggattttttggaaatagaaacaaaacaaattcgaattaggcgggcattttttggaaaaagaaacaaagcgcgtaaacctatccggactccacgcaccggatttttttgaaacagaaacaaaacaaatccattcgaattaggcgggcattttttggaaaaagaaacaaagcgcgtaaacctatccggactccacgcaccggatttttttgaaacagaaacaaaacaaatccaaatttcgaattaggcgggcattttttggaaaaagaaacaaagcgcgtaaacctatccggactccacgcaccggatttttttgaaacagaaacaaaacaaatccaaatttcccgcagaccattcgacgtgtacgtcgtgcacgcgggccacctgcccaggctaggcgagcgagcgtgcgcgcgtttttcccctcttctctccaccacacatgcttcaagtggctaggagggcatcctcccttttaagaaggtccccctctcctagaataagcaaggtggtactaaactccacatgcatgccatcccatgaggtgggcctttgtgattttctaaagaattaattttcggatgagccttagcccatctattaattccaacactattttgttcgtggtaaatacgagcctacacaccatatcaaaaagtgtcaaataaccagatttttttttacaatttggttatttctaaaaacttattttacaatggcccctttctaaactttactatgaaagtggacccatagctcgcgcctaaggctattggcactgaagttaaatgtctcaataccaatacccaacccttatgccagttggtttggcactgagcatccatatctcatagtatttttcttctctcctcccatccctcttcaaaattttttgattttctgctaaattttagaaatatcatgattcatttccgctaatttatttcaatttataagaaacctaatttgaaatgagggtatggacgctcccgtccaccaacctctaaatcctattggttttccaaggaaattttgacaaattaaaatatcaagattcattttccataatttgttatttataggaaacttaatctaagatgagagttcctttctcctttgcccaacctatatgttgattttttgtgtaaaataaagtgggaaaattgacaatgtagaatttttttaatttatttctagaatttcagtaagtagtttttttttgaaaaacaaaatggtgattcactgtagtaatacttgtgataaagagataatttatcgtcatactatcatgatggaaaaaaaattaaaaatgactacatggaatctatttaaatttttctggaggtcttagttagaacgtgtactgtggtaaattttatttaccaaggcaagagagtcaccgatggcttagcatgaacaattactccctccgtctcacgatataatgaattttaagtttttgcttgtactgtttgatcacttgtcttattcaaaaaatttgtgcaaataataaaaaacgaaaaagttgtgcttaaattactttaaataataaagtaagtaaaaaaataaataataatttcaatttttttaataaacgagtggtaagccctttttgggggtttggggcccccaaaaaagggcccaaaaaaaaaaacccttttaaaaaaatttcctcccttaaatatttaattgggtcccgggggggagtagttttttttttacaaacgtctcgagagggaggaaggagctagggtgatatattataaaagcatgtaagtagtgtaactcgtcctttagcggtacttcgtaatacgtacttgtactttcatttttgttaccataatcaaacctcctgttttgtactcattaattttagttgtaccaatgtacatttaattctttgtgaaaaacagaacacatctgattatgaaagactcttgtgtcttggtgctccatatagacgccattaaaaccaacacccaagaattgcgtatatatacgagtacatagagcctctcacttcccaacacagctgcagaagcatcgtcgtacaccacacacaaaaaatggcagatcttcacacctatctgtaccttggcctggcgctcgtttccctgctcgccgtgcaactcgccaggcgtaggcgctcgtcggcggcgcatggctctggcgcgctgcggctgccgccggggccatggcagctaccggtcataggcagcctgcaccacctcgtcggcaagctcccgcaccaagcgatgcgcgacctggcgcgtcgccacgggccggtcatgatgctccgcctgggcgaggtgcccacgctggtggtgtcgtcgccggaggcggcgcgcgaggtgaccaagacccacgacgtgtcgttcgcgacgcggccgctgagctccaccacgcgcgtgttcagcaacggcggcagggacatcgtgttcgccccgtacggggactactggcgccagctccggaagatcaccgtgacggagctcctcagcgcgcgccgcgtcgcctccttccgcgccatccgcgaggaggaggtcgccgccatgctgcgcgccgtgggcggctacgcggcggccgggtgcgccgtcgagatacggccgctgttggcggcgctcgtgtccgactccaccgtgcgcgccgtgatgggcgaccggttcccccaccgcgacgtgttcctccgcgagctcgaccgctccatcgagctcacggccgggttcaacccggcggacttgtggccatcgtcgcgcctcgccggctgtctcaccggcaccatacgccaggccaagaaatgctgggacacgatgtccagcgtcctcgaaagcaccatccaggagcacctccagaagaatggcagcagcggcggcggcgctggagccaccgacgaggacctcatcgatgttttgctaaggatacagaaggagggtgggctccagttcccgtttgacatggacgtcatcaagtctgtcatccatgtaagtgactacgccccccacgagttatcttagggcactgtttagcatagctccagcttcatctctcctgaagttggagcgcagccaaatagtttcagctccatcttaaaataggagcacagctaggtagagtgttcttaactcgataggtggagctggatttaaactgttccacaactccactttatacctaactcctacattaaatggaaaaattgaagctctatcagagcaagttcaatagtataactaactactaactccaattcatctatagccaatctaatagctaattcatacaatagttacatactacactattaatacctggtcccacatgtcatacgcacactgtatcttgggatccgtgctacagctggctataaatctgtagctcactgcctttctctcttcttatttatcttcataaaatatgtttgcagtacctgctcttaaacagacccttagatcattttccgtgtcatgttccaactgtcaacttgtcctccagcttgacactatggcatctggtcacatatggtttttaaccagaaagcagtacatagctttttagctggtaagcacggtcatcgctttgcttacgtcactacttcacaaaagtaaattgtgtcggatgggaaagccatatagctgccggatttttcactcggcatctaacagacgcactaatgaggagcgctatcgatagaccggcacctataaattgtacgatttgcgaaaagaaaagactcagctcaagtgagttgaaccgatgctccaaatccaacaaaaaaaatgaattgaaaggcacaataacacaagaatgctcataatagaatcaaacaagcattcatcatccaacatcccagaacaagcactagagcactagaacgggcgccgccgctcacccttgttgacgtcgaaggaaggagaagacagatgctgctcggggaccagcgcgggggccaaatccgatggaccccgaactcaggcctgctggacttggcatcggttccaccgccgtcaccgttgccactcgcgagggagaggatgtcgtcgtttctctcgagggagagggtgttgctgccgctcgcaaaggagaggatgttgccactactcgcgagggagagggtgccaccagtgctcgctggtggcgaggggaaaatgagagaacagtgggttagaggactcagcgtgaatggataagaatgagaggctcaacttagcttggtttttacggatacctgtgttttaattagccagcaactataatacattataggtgctggttcttttaaaaaatcaatatcaatagtattgctgctagtttttctctaaaaccagtacttatagttgttcaaaggtatcggttgtatacttttttggcccatggaggtgggaaatggtaataagtaccggttccaattgaatcggctactatgagccgagccctattagaagaagttctatagtagtgtgtataagctgttactgcttagaacaacaaaagataattatgataaaacttttatacatgagtttgttagtaaattaaaatcaaatattgaaagttaaactttaattaaaaaaaccacaaagagtgaaatgtaactcatatcaaatttcggctatagcttataagctgaaggttaaacgatgggagtgtacagagtgaagacatgatgaacatcataagaacactacaaaaccttagagttgggccagttggctctcttcgtgttcattgctgcgtcttcaaggtagaatggagtggacatcctctcggtttgtgcatatcgtatataaagtcacaaacttttttcttaaaaaaaataaaagatagatctatggtacatcaccccacaaacatgctaaaaaaatatatttatataggtgtcaaatttaaacttacatgtttattaagtgatataccacatacgttaaatttgaacttacatatttgtgggctgatatacaatatattgttctatcttatcaaatttgtaattaactttttagataacactgcaccgttttttaatagatgatgttaacttttgatatgacatatgtccatttgtcttattttcaaaagaaaaatattaatattatttattttgttctaacttattttattattatataaatttaagtagggcttgtatctaactgttattctaaatgttattttaaaatttaatcacatcatctatttgaagaaaacgaagaacgaaggtagtatatatataaaaacatcacctgtagaaactaatagagacctcccccagtccccctcttccggaaattcctactatctgatctcattcctctgcttcttttcagcgcttctccctcatctatgcctctaattgtctgatttttttgtatcttgtatctcgggtttattagagtgagcctacggtacgaatttgatcgccattgaaagccatgaagtccaatctgttcgttctttcgtgatggtcagctacgcagcttcaataaaaatatgggaaagtaaaatcatccatcgaggagatatcccctcgtttcgtgcatatcacctaaatagtcataaaaaatatgaaaaaaattgacaacatagattattatgaaatatatcactccacaaacatgcaagtttaaattcaacttctacaagttgtaacaaaaataacaaatatagctacgaatgtacgataactattttcagtttaatttgttatttttgttgcaacttatagtagttgaatttggtcttgcatgtttgtggagtcatatatttcgtattaatctatattgtcaatttttttaaaaaatttttaatataacatgcaaaaaaaaaaagaggggatgttcctcgagggatgaaaatccacgtgctaaaaatatggatcacatgcatgcagaatgtctttggcgccggcagcgagacgtcggcgacgacgctggggtgggcgatcgctgagctaatccggaacccgatggcgatgaagaaggcgacggccgaggtgaggcaagccttcgcagcggccggcgttgtgtcagaggccgcgctcagtgagctccgatacctgcacctcgtcatcaaggagacgctccgtctccacccaccggggccactgctgctgccgcgcgagtgccgggagcagtgcaaggtgctcggctacgacgtgccgcgcggcacacaggtgctggtcaacgtctgggcgatcggccg

SEQ ID NO: 432 - DNA, 14391 bp, Oryza sativa
ggaaaggaagggaaaggggagaggaaggatcagatagggaatgaaggggagaggaaggggatgaaggggagaggaagggatggagaggaaatattaatgagaggggagaggagatcgagaggagagcggataaagatggcgcgcacggctcgaggtgctctttcctcccggttggtataaacaaccgggactaaaaatagatctttagtcccagttgtttataccaacggggagtaaaaatagttgaggtatgtcttgaacccgacaatttcttgaatcgggagtaaaaatgatctttagtcccgggactaaagatcaaaaagtactcctcaacttttaaaccaggactaaagatgttttttagtcccggtttttattagaaccgggactgttgtgaaatttggctgaccgaccaaagatggtttctccaccagtgatagcataacgttctactagaaatcaaggaagaagaagggtaacaactcgcaaatccattttgcatctcactaatataatcacgaaaacagattcctctctctattcttgttcctttatactgctctcggagaaatcctccaacgccgacgtggagtcgccggtgaatgccgattggggattttttgggaacggttgcccgccaatgagcgtttcaccatgccgcatcggccacagacattgcaccgagccatggagaaaaaaaaaagaaagaagcaccaacaaacgagtagccgtggttgcttgccgcaccgccccgccgtcgcacggccgccggccctgtccatgccttgcagccacagggccgcgcagctgcatggctgactgaagcgctgctccagctgttgcatcgcacggccgctaccaacctcagacgggcgcatcgttgcgccgtgtccgtcgtcctccgccagacagcgccaccgacctcttccataatactactagtacggagctgtgtgttgtaaactaagtgactactaactctaattaaaatataagaaattatgtctatattgttatttgtataaatttctttatattttacgacagagataaagtagcagtatcagtaagagtggagtaaatgtgcgtgctttttgtgagtcttgtgacttgtgacctcatgatcctttgtcctaactccgttccagaaatatcatagttttgcactgtttatatccaacaattgaccatctgatttatttgaaaaaaatttacgattagtatttttattgttattagatgataaaacatgaataatactttatgtgtgactattttttatttttttatatatttttcaaataagacagtggttaaacgttgtacacagaaacacacaactgcattgaagaaagtagtataccaatactgcttctgtaatggctgtagaaactgacatgtgcgtcctgaaacaaaagataaatacgtacaacgtcccagggcttattaatcaaccaatcaatccatcaaccaatacttctaatgctgttatgtcaacatctgattggttcatgtggcacctcgatttgtaagataattttttttttgaacgaatcgactaggccaccaattttattgaatagagaagaaactgtataaaaagggagaatgtacaggaaacaaaccagggccacggtcctaactactggcaattacattgtcaaccaggcgatgagattttttgcgcccgccagcccctacgtttttgcttcctcctttatcttggctagcagagttggcgctggcaactccttgtgctggaaagtccttcggttcctttcattccatatctcccggttcacaagcaaggttagcgtgtgcttcccgtatgcttacggtggcctcccaccactcatactgtcaaagttacttgccaactagaaggtcttagatggtcgttgcctgtccactgcgcgatttcattccagattctccttatgtatctatattccgctagcaggtgcaaagccgtctcttgagtctggcgacataaagggcatgtggatccgttgggccagcctctggtggctagtctgtctgatgtccactctctgtattggagtatcagctaggcaaaggacttgcacttgtgcggcatccaaggcctccatattagggtgtcgaaatttgacgatgttgtacccaggagctgcaccttataagctgtggtggccgtgtattcgccatggttgtttagcttccaggtgatctggtcttcatgttccgtgaagtgtacattctgaacggcgctccaaatggtgatgagctggtcaatcagatccgttgtccatccttcgtttgttggaagagcaaggtcgtgcagccattgatctaccaaagcagcatgtttgagggtcctgctctttttcctagaggccgcgtggactagtggtgtgacatccttcaatctttgcccggagccaagccaactcccagaacttcactttcgctccatctccaatttgttttgtagttgctgtttcaaacaatagcttgtcagttttatcacaaggtgtttctgaccccacgcccaagccttttccggtgacttccattcatgccagagccatcgcaatcgaagggcccttgcgaatttttcgagactcaggatgccaagacctcccgaggcagtagagaggaaagtccacgtccaattcaccttgcacttccctcctgtgatggtttcgtttcccgcccacaagaactatcttctcttctctgtttgtccaagacttcaagggattccttagaagctttcaagtccgccagtatgaaaataggctggatttctaagataaattcaagttaccaggaaaagaaaaagtccaaaaccgtatccggaaacataggtggcacccccctcccccagatgcggcttccctgtacttcctacttccgtattcccgtccctgtttccgctacatggcgtacatccatttgcttttgtttcaccggtggccctacttccttcccatccatcggaaaaacaaaaatcgagtctccaacactctccctacagggtccagactgatcctcacatcgttcaggtctgaacaacttttgctgatttgctggttatcgggtgcatgctcatcacctggagaggtcctcttggattcttccttgctagtgttgcctgccctaaaccatcctgaacaaattactgtgcttttgcatcaatggcatgtgtggtatcaaagggacaaaacggaaaccttagctagcttgaggcaagaacaaaatcaatactgttatagaagatcattaattgataacaatttcaactagggcgatgcctctttccatccttttctttgtttcttatttttttcatacattctggtgcaaccgtgcaagtctgcgactctgtgagtatgtactctcttacaggcttccaccgatgaaaattgaaatgaactcctagcagattaactgctacacattcataaaaggacaaaacttccaaaaacctttgtctccatgttcatccatggatgataggaagcacccgagtaacagtttttggtgttacctgagcacatcttgaaacttgcagacataatcaaagctattgagatgcgccacacatccgattagcgaagaaagctgccaagaggaaatcacctgcggctacggggcatcattggaggtggaagtgtccaagcggaactaatccaatataacaatggagtaatgaaggctgaaaaaattatacgtttctgttttgatttggggaagaagaagggtggggccaccaggcaaacaagaagcgaataggagtaggccacgtagcaggaaaagggacgggaatacggaagtaggaacagggaagccgcacccacacacacactgcgtgacctacggcttgcttgggcacgaccgcacgagcagcagcttgggcagctgggtctgcatgggcctggtggcactttgaagtgctaaacgatccaattggcctaggagacagcacaaacaggaaggaagaaagaaaaagataatcaatttcaggttcagacacatactagaattttagcagcacaaataaatataattgaaatgaaaagtgtagttgtttttatcaaaatttatcggtttgttctaactttagcctcaattgtttcactctgttaaaaacctacaggtcattaacacgcgatactcccactaaattatccttttaaatgtgcgatcttcgcagaagggtaaatggaaaataaagaaatgatctatatatgctaaagggacaacgcgtcaatagacacgctaatttttgtagtatagtaatgattgcgaagaatccccacataatatatatctcactgcttatatggatcttatgatggagctagaaacatcgtgaaacctaaggcatgttggcagtaattctatcgagccattcacagagaaccactttattatgagaagcatcatgtaggatggggtaatgggtctcaactctctctttattccacagtgcatcactttgttacgagaaacctcgtgtagcatggggcaacgggtctcaactctctctttatcccacaatgcaaaggagttatacctgtggctttaacttttcatatcagcccctaacattttacattaaagttctcgtagtttgtcaatttagagaatacttcaaattttacacaaaacaccctcaaaatcggaaacatatataaaatccctccttcctcactttccccgttgcccttccagtgccaccgacgcctctcccgttcccatcccccaacggcgacccacgctcctcaccatacagtcgccaccggcacaccacccctcctatatatcctccttccccaactggcggccctattcccttgggcggcgtggactgcgggagacggcgagatcggcagcgtgggagcaagggacggcgggagctcttcaaagacccccactcatgtcctactccaactggtggctttcctcccttggccggatactgacgagctcctctccctctccgtcaagctgctgctgctgcagaccgaggtggttcggagcggggacgacgacgagcttggcggcgctgaacgggaacgaaaacaaggttagtttgccacctccttttcctctgtcgccaccatcctcccttctcctcactcgaccaccaccccactaagcagatccgacctcgggttcacaggatttagcgagcaccgctttggcgacgacgcagctcgtgatggtggcctcgctggcgacctccgccgccttgcacgaggtgtggaggcgtcgcacggggccacacctcacccaacacgctgctcgccctgtgcctcattccgccttgacaaatgtctatccaaattttgatgaagaaccggtggctttgtttggttccacggtcttcaggttgggagcgcagatgtgtgcgtggcatggaatccccgatgtggatggtcggggccgaacgtcaagcacgcgcactataaatggcattaggtatgcaattaaactttaatatttagtactctcttcattaaatttgattttcaaattaggtgggccgacacatcttaatattcaggaagttgtgatatgacggcttgctatcgagaggcacattgtctattaatgaaataataattagtcataaagacaagtgcttatgcccacttaagaatttaaatccggataaatagattccagaaacctagccggttaatttatactcattttacgattaacgttataaatgaccagaaataaacaagataacattcatttgtcctcacgaagattaactgcattttcgtcgcatccggattatggagctccatactgaaaacgacatcactacagattaagaaccaaatccccttcatccacgagccgtctcctccactacattttgtacgcaccaacactggcaaacactagccgagcgccccagcatcctgcctgcgcgacacagcaatggcagatggttacttctacctcggcttagctctcgtgtcgttgctcgtcgtgctgttcgccaggcgcaggcgatcggcggcggcggcacatggcgacgccgggctgcggttgccgccggggccatggcagctgccggtcatcggcagcctgcaccacctcgccggcaagctcccgcaccgcgcgatgcgcgacctggcgcgccgccacgggccggtcatgatgctacggctcggagaggtgcccacgctggtggtgtcgtcgcgggacgcggcgcgggaggtgatgcggacgcacgacgcggcgttcgcgtcgcggccgctgagcgccagcgtgcgcgcggccaccaaaggaggcagggacatagccttcgcgccgtacggggactactggcgccagctgaggaagatcgccgtcacggagctcctctcggcgcgacgcgtcctgtccttccgccccatccgcgaggaggaggtcgccgccacgctgcgcgcggtcgccgcggccgcggcggacgggcggaccgtggagctgcgggcggcgctgtgcgcgctcgtggccgactccaccgtgcgcgccgtggtgggcgagcggtgcgcgggcctcgacgtgttcctccgccagctcgaccgcgccatcgagctcgctgctgggctcaacgtggcggacctgtggccgtcgtcgcgtctcgccggccgtctcagcggcgccgtgcgccaggccgagaggtgtcgtgacacgatgttcggcgtcctcgacggcatcatccaggcgcacctggagaagactggcggcgccggcgaagacattctagacgtgctactgaggatacataaggagggcgggctggagttccctctcgacatggacgccgtcaaatgcgtcgtcgttgtgagtgactagcagcatttcttatgaacaatggtttcatggtgtctttccaagctgttcttttttctctgccatgatggccagctcgaatgctcgatcacgcagcttcatatcataaaaaaaaacgatgaaacacacgcaggatgtcatcagcggaggctgcgagacgtcggcgacgacgctggggtgggcgttcgcggagctaatccggaacccggcggcgatgaagaaggcgacggccgaggttcgccgtgacttcgaggcggccggcgccgtgtcagagagcgcgctcgccgtcggcgagctcccgtaccttcgcctcgtcgtcagggagacgctccggctgcacccgccgctgccgctgctgctcccgcgcgagtgccgggagccgtgccgggtgctcggctacgacgtgccgcgcggcgcgcaggtgctggtgaacgcctgggcgatcggccgcgacgagcggtactggcccggcggctcgccggaggagttccggccggagcggttcggcgacggcgaggcggccgccgcggtggacttcaagggcgccgacttcgagctcctgccgttcggcggcggccggcgaatgtgccccgggatggcgttcgggttcgcaaacgtggagctcccactcgccagcctgctcttccacatcgactgggaggcctccggtgtggctgacccgaccgagttcgacatgacagaggcgttcggcatcacggcgcgccgcaaggccaacctcctgctccgtccaatccttagagtgcccgtgccgggcgtctaggtcatcgacgtcgccggcccagccggcgctatatttacaaggataaaattcactgtgggagttcacttggatatatatatttttaggaaatcattagctgcactaaggaatccgatcgtctcagttagcatgcgagtttttttaaacatatttctcatataattccttctatattaccatcttaaaaaccgactgaaatacgaatatgtatttctaaaagcaaacgaacttaaaaaccgactcatacacggatgacgtaccaaaataccggcaaaaacatttttaatttttataatagtagagatagagatagagatagagaagagatatagactaaaactaaaacataaaattaaagttgactcaaacacgaatgacgaactgcggaaacatcttcaatttttataatcgactcaaacacggatgacggaccgcggaaacatcttcaatttttataatatataatagtagggacagagaagagataaatcatgtatcagttaaagtaacacaaataaacattactgttgatggctgttaagtatcgaattaacaccgttaataccagcataagaccataattgtaaacatccaacatagtggtagggcttatttataataatttccacaagtgttggtgtatatttatatgcaggtgacaaactaccaaggttgagaggaaatatacatgaaggaggatgagaatcaaactcgtatccgaacttaaggagttttggacccataaattaaacacctccatatgggccaaacattcataccaatgaattgagggccccaaaatgagtgtccaggacgaaaaccggagcgaacggagccgtcccgggttcggccgaacccttgagttcggctgaaccctagcagaggccgttcgccccagcccaagttcagttcggtagcaatccgcctcccaatgacagttatggccgttttcaccggtagaaaccgtcattagcttgaacgcttggcaacacaagagagatgatgctctttggatgcttggagcatctccacactcccaaggcacttcacctataaatacccctctcatcctcacttgtaaacacacaccaaatcataagctgaattataagaggctctagtatactttattgtatattagaatagggagagggtaaggtggaaggaatcggaggaatcccggagttgtcgataatctcctcctacttttgtatcttgttatttactctgctttaatagaaatatcattctgagtaattaagatttgcttagtgagaattacttcttggttagttcctaattagcatacgggatcattgtttactatagtctatttatttatagtgattgctttagtgtttgatcggcactagagtagttattaattgcgtagatgcggtgtctagataattaatctgcagttgttgctgcgtatcccatagtacgtttgaggtaggtgtagaggtggtgacagccctcaagagcacttaagtactccctgtccggttacgtagtagagcgacatctggtaacagcgggttgccagtgcctgaagtattgcgttaggattaaagttaagctttccttaaacactgtttctcattaggaaatcctctctaccctctgcccacattagctttgtgtccttggatgaacctaacgaggagataatcatacacgttctcttggatttgatacctttggaatactccgtaggggaagtgctacatcagtatatccgtgcgcttgcggattctagctgtgacattgagaaataccaacaattactaacatgataaacatctaaaattgtgaagtaaattaaataagagtgaaacaaaatcctagcctaagttttaggctaaattgatgcaaaaatcagaagatgagaagatcataagaccacaacttaaataatcttagtcatgaactcatgatgaggtaaggtgtggccgtatgcgagttggacgtgagggcaggtgacaatgttctccaggttggttagtgatagcccccgaccaacctgggtcataggttgtcgtgcaagtggtctagtctcttgagttggcctttggtcactagtgtttcatcaatcggatagggtatgtttggttcaaggttatggttggatgtaatatagccatctatattttagaggatgaagctaagttttttttaggatgggataagcttatttgattggtaggatgaggatggattggatgaaagcaataaacttaattataatatcttcctcgaaaaaatgcccgtgtgttgcaacgggaagaaaagatgagaaaattgaggagaatttgagaaagatttacattatgtaattaaattaaatacacatttcctggaatacttgattttttaagtaggtaggtgtttaaattaatttaaaagtaaagtaagtgtggaaataaaatgatatagctaaatttaatttttaatgaagttctccatgattaattacactctctggaattttcttgaaattttcagatctcaattgctaactttaataatacaaacatcatttaagaatttattttaaaaaaatctaaataaaaactctccattctctctacgccaatttcatcccgtttccttcctcggcctgcagcctagccggcccacttttctcccttctcctcccctcttcctcggcccgcaagtacgcatccggcccagcaaagcactacaagtctaatcagcctccctcgctccttcttttactgtcatgtgggccagtgctaccgggtcgtctcctacctccgtccgtattgccgcatctgcccgatgacgcctgaatccgcctcctccgtgaaatcagtccacatccatggagataattagaaattgagtgaggggttttgatccttatcttctcccctttctgttttcccaagaatcaaaacaaaaccacgtcgtatagatgttggaagagaaaccctagctttatagttcgagtctgtttctcttcaaatctgcgcatgcacgtgctgagatggagggaatcggacggacgaaaaaagtgtgactaaaggaaaaatacgaatattttagttaggtacagatatagaagtgctataataatagtaagtcatacaattaataatacaaattagcacttgtttacactagttttatcgtgctaattactaatcaatatcaaacatgtttaatatcattaatcataatttaacctacttagtaatcatacactaattagtattctagacaaggtggattatagattgccaaaaggcctgaggctagacaacctggcccaggcatggcatggcctggcccaacctttgggctgtgcttgggcctctgcctcagcatggtggaccatcccgatacgacatgttccaatgattagggaggcaaaatagatgagggagagaaatagacttattttagccatataaggcacagcccaaagagataaagaatgcaaaatagacttattccagccatataagacacggcccaaagatatgagggacataaaatagacttattccaaggaggagcacggtgggctttcgtaccttcgagccagctcggcacgacccgaatcttattggactgtgtttgggttgttggtgcagcccatgggtgggcatggcccggcccgacatgcaggtcaagtcgtgctgacccaactgatctcaggctcgggtctggtcatgccccggctggacagtccatttagccatccacatggtggatgtcttaatccggtaaaataagcctaatccctctatcgtgaatattgagagaatatttcatctttttagctgcctcattcaccctacccttcaaacaaacatcaccaaaaactagaagaccaactcccattcagctccggccattagccaattccaccaccggttctaaaagtcagttgctagataagatggccgtatcgtacggtaaagcgacagacacattcgagagtacatgcgcatatgaaatgtttccgtcggttcgtttggtacgtcatctgcctaccaagggcgaagctacataggaaaggggcgggggggggggggggggtttgcctggtacttcatttatttttaccgtacgtacacgcgtcaatcgaaactcaggtactcgtatagtaaagcaaacgagtggtacctccctccagttacctactactccctccgttcaaaaaaagacaaaccctggtttccgtgttcaatgtttgaccgtccgtcttatttaaaaaaattataaaaaaaatttaaaaaataagtcgcgcataaagtattaatcatgttttatcatctaacaataataaaaatactaattataaaaaaatttcatataagacggacagtcaaacgttagtaaggaaatctagggtttgcctttttcgtgaaggagagagtacttccgatttccagagcttcgaaccccgtcctctcgcccgcccgcgtccgatttgcagcgtgaaatagcacgtcccattcgttcgattgtgtgtgaagcagcaacagcggaatcgtttcttgctttcgttcagattcggcttctgtttcctatcgctttgtccagactaccagttgccgtccctggtagacttcagaatagtctgttatacttatctaaagaaagaatagtctgttatttgatatacttattaatatttttttggcttgtaatgtcacaatcatttctggtaatagagtcttccctttctaagggcttgtttaattggcaaaaaaattttcccctacatgtcacatcggatatattgatacacatttaaagtattaaacgtaatctaataacaaaataaattacagaatccaccggaaaactgcgagacaaatttattaagcctaattaattcgttattagcaaatgtttactgtagcattatattgttaaatcatggcgtaattatgcttaaaagattcgtctcgtaatttcctagcgaaccgtgtaatttattttcgtctacatttaatactctatatatgtgtctaaatattcgatgtgacagcgtgaaaaattttatttggaacctcaacatgccctaaaaagaaaacgagaagaaattcttaagccggcttccgccggccggccaaggtcagtcacatcactaagcacaaagctcaacaaccttgcagcgaaaatatgtagtactccacctgaatacctgattggtccagaccccaaatcactttggaggaggattccaattaggctgtgtttagttagatggcaaagtttggattttagttgaagttggagatgatgtgactgaaaagttatgtgtatgataggttgatgtgatgaaaaaggactgaagtttgaattcaaagtttgaatctaaacatagccttaatgttcttcaccaaaaggagacaggcaacttcgattgacaccttgatagtctcatgaacacaagaatacctcaggatcttgttgcatgcgtcattacatggtgacaaaaagaaaaaacacagatttatataggcatggttctttacaatattgcctctacacttgtaggagctgatggatcgaaatagggattgatatacgtgcccggcctcatttgttagttgctcgtactatagatgatgcggtactgcattgtactttctcaattctaaaataattccacacataccaataaaaaaaagactataatactcctgttttcctaaatttcatctactctaagtacatttatatatcataagttcacaaacttcaatagctcaaataaacttattttaaaacaaatgaaaagaactaaaaataaacttattatgagacgatgaaagtcctactgtatatccaattatccataaaactgtgcagcatacaaactgctatgagaataaaccgtacaaatatttatgggataatagttgtggtttaaaagaaaatgctaaaaagtaaagttaaaaaaatataaaatcaattctagaatcaaaatttaatattaaaatatatgcttgtggctgataactgacaagacagacagcaggccatgcgagaggtgtaccaccagatagtacacgctgaacgtgcatgagatctgaagggatctgataaacaattaattcaattattagtacttattagcgttacaattaagggacaagtacgaattaccctccaactatcacggtcgtccgaattaccccgaactataaaatcggacattcttcactcccaactataaataccggacgaattactccagtcatcattctctttataaaaaattatgggacccacctgtcatacactactctctcttctcaatactctctctctctcacttctccaggcgacggcggatgcggagaggcgagcgcggcggcgaggcagcggcgagcgcggcggagaggcgagagcggcggagaggcgagcgcggcggcgaggcagaggtgagcgcggcggagaggcgaaagcggcggagaggtgaggaggcggcggcggaggagaggcgaaagcggcggagaggcgaggcggcggcggaggagaggcgagagcggcggcggcagagaggcgagcgcggcggcggcggaggcgagcgcggcggagaggcgaggcggcggcggcggagaggtgagctcacgcgaggcgttccggccaccggggtgggagattccgacgacgacgaggactagatcgtgtcggtgtcggagtcgtacagctccatgatctccggtatggtgatgcggcggtcggggtcgggctggaggcgagagccgcggcgaggcaga

SEQ ID NO: 433 - DNA, 1713 bp, Oryza sativa
gttcttaatttggttcggccgccgcaccgacacgacaagtgggctagccgcagccgcctcttccgccgccaccgccgcctattctgtcgcctgcctcagtgcgccaaggagcgagagagagaggggaaggggtgaagagaaggggagaagaaaagggattgggctgacaagtgggtcccatattttattttatctattttggctgactagactgccacgtatgcgtccacgtaggaccaaaaccgccctgaatcgatctagggaactaattcatccggtttacaaagtttagggtcaaaaataactggtattgaagtttagggtggtaaatcggacaaccgcaattgttcacgagtgcaattcgtactttttcctacaattaaacagctacatgtccctctatagaatataaataaataaataatgtaattaactaacagtgcaaactatttcaaataacaacacctaaaaaagattcttcgttttaaatcgttatagttatgattcggttacttttttttagttttgaaccttttgaagttttaatttaaaaataaaatctccaaagttatttctaaaagtaaaccttaagctggtgtggcaagagtttcgccacgtcagacatgatggtgtggacaaaagtttcagatttaaaaataaaatttgagagatttcattttatatattaaaaattaaaaaggtttagaagataataaaagttctaattcagtgtctttgaaacaaaagaataaacatattctctccgttttattcaggtaggaatttgctcggtgtacaattagtacattaatttttagactgataagttgaatcataatatcagtatgcaattacactaaatttgatttttcttatttttgttttaaggccaacttaaacacaaagatataaaacacccgattgtccagttgcaaaaccgcatcttcgccatccagattacttggagctccacactgaaacgacgtcatccaacccgcggggtctttgcacgagccgtcgcctccattatatattttgtacacacctacagttgcaaacaatagcagcccaagcattctgcgcgacacagcaatggcagatgattacttctacctcggcttggctctcgcgtcgttgctcgtcgtgctgttcgccaggcgcaggcgctcggcggcgcatggcgacggcgggctgcggctgccgccagggccgtggcagctgccggtcatcggcagcctgcaccacctcgccggcaagctcccgcaccgcgcgatgcgcgacctggcgcgccgccacgggccggtcatgatgctccggctcggcgaggtgcccacgctggtggtgtcgtcgcgggacgcggcgcgggaggtgatgcgggcgcacgacgcggcgttcgcgtcgcggccgctgagcgccaccgtgcgcgtgctcaccagcggcggccgcggcatcatcttcgcgccgtacgggggcagctggcgccagctccggaagatcgccgtcacggagctcctcaccgcgcgccgcgtcgcctccttccgcgccatccgtgaggaggaggtggccgccatgctgcgggcggtggccgcggcggccgcggccgggcgcgccgtggagctgcgggcggcgctgtccgcgctcgtggccgagaccacggtgcgcgccgtgattggcgaccggtgcaaggaccgcgacgtgttcctccgcaagctg

SEQ ID NO: 434 - DNA, 1421 bp, Oryza sativa
ggagttcccggtcgacatgctcgccatcaaacaagtcatctttgtaagtaactatcagcagtaatattcatctatagcctcttattcaaaatttgatatatttaaagttgatatcattcgtattattcacagtaatttggaaacacaaaaaattataagttagtatgtttaaaaatctttaatgataaattaaatcacagtaaaataaatgataattacgtaaatttctaaataattaagacgaacggtaaatatattctaaaaagtcaacaatgttatatactccctccttccaaaagtttaagacctattttcattctattttcattctttgggttttccaaaaaatctaagtcttatttgtagtcattatgtgctaaattaaattattgatgagaatccaagaagctattttagtacttattaattggttgcatattcattggttttgtcacatggtgaatgagttaatgacttcttagtcttggtgaaaaaagaaatagtacttagaattttggatggagctagtattaagaactatagagtgtcattttactttcataaagcgacccgttctcctgagacttttttttttcacttagagcttagagaactcaacaactagttgtagtcggacagacatggagagaaaacaggggcacaaatgtcgtaatattactaaatgttaatataaatgttaatagagctatcctggagcaaacaaagacacgtttggaagtattttcggcattatagaaaaaatagcaatgcggacaatattttattgtttgcgaggacaaatagcaagtgcggataataaaaagggaacaaaattctacatataggagatatggtacatcatggaactcattttcaaatggaatctttatcaacggcaaatcgtccaccaactatcagtaatatactaataactgatcaacgtggacacattttttaccttgaactactaaaactggttagaatatactaacctaagaaacggtcaaatatcactccaaggcaacccaatcatttttgaaaactgttattttttagttcacaatttttatatacttgcacagaagtacagaacccagttagaaaaaatggtatatcaaaaattaaaagcatttgcaatgttagtaaaaatcgtgttgttagaatatcaaaagcatgagactacaaataaaacctggatgatttatcttggagagatgtttgaactggttttgatattgaagattgcaaaattaatgcccctttagttttatagttaagattttttttggattatgaatttatgatgtcctaatagaggtgccttcgagttatctggacaaataacacctctaaccgtacaagcaagtacaaataactagatattagtattatacaattactttgctacatgtataggtcag

SEQ ID NO: 435 - DNA, 226 bp, Oryza sativa
caggatttggcggattctattgggatctgggtgggtgtacgggacttttgtacttacgtttcatgttgcgctcttcctcttcattgggcacgggcacattcaaggctacattcgtatttaaaagatggggggatacaaatagaggataagatgttgctgggcgataaggtacgacctaaatggaatttagatagcaacaaatgcttcaaagcaaccgaaccgccgc

SEQ ID NO: 436 - DNA, 10145 bp, Oryza sativa
gtctgttttcaacaacacacattttaatgtgccgcaaaaaccattgccagcttgatgtgttctcgctttcaacaaatgcaaaagcaacaggaacgacatggctatccgcgtcgactccgatcgcggttagaattgtccctttgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccatcaaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatttgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcaacttgtccaccttccaacggagtttcttccaccacggcatgacttgactcccccgatcgatcaacacatgttgtcttctgcaccacgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcattcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactatattaccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctctcctcgctccctccggcgctcacggcgacgatgtggcgactctcggcggcggctggcgatgtggtcctcaaaacaaatcgaactcgcggcctaggtggacggggctttaaaccggcctgtcgaacgcccattgttcgacagggtcggtggagggccctgtcgaacgcccccggttcgacaggcctcgcggcgccgggtggtgggccctgtcgaactccctccgttcgataggtgagcgtgtcgaacgccagccgttcgacagggctttgtcgactgcccgtcgttcgataggtgccctatcgaattgcacccgttcgacagggacctactttcgtgattttccccggttggccactacttttgcgattttccataaaaataatattaattctcaaaaaaatttcagcccagtcgccagcgcgcagatagagccaaacgccctccacccatagcctgacaagtgggacccacgccaaaatgtccccacatgtcatggacgcctcttgcctggctaccaagtgttcccctgcttgggaatatgtcgctcggccgacctctcgtattattgatgcgacttgcagcccaaaacccccaaaaagccacagaagagagacaggggagaaaaccctaatctcaaggccgcggctgtgagcgctcctcccgtctctcccccaacccgccgccagccaccgagctcgccaccgtctccgttgcctcgccgtgctctaggtctggatgcctgctccccttcatccctcctcttctccgtctaaagccgtcgtgtttagcctccaggggcggctcgccgcggcatcttttttttttctttaaggtggtagtgcttacatggcgatgctctatgtgcctcttgtgcgtggataggttctcggatggaggccgaggcggcggcgaagagggcgcgggagagcggtgacgcggcggcggccggtgccggcgagcaggcgggtatctctgccgtcatccctggatggttctccgagattagccccatgtggcctggttcgttccgctctcttaccctctgtagccctgttttgccattacaatgccacaccctcttgctttgtaaattcgctcgacatggactacaggttcgcttttaatttatataaaaaaggtttatatagtttataaaggagtatattgtttctttccagaattaatgtgtccagttgaatctccgattgggcttcttgtatcatgggacggagcacatcgttagggaactgataaaattctttgccattttttttaaaatttttagcttggttgggtataggggtgggcattcggttttcccggttggtacagttcggtttgttcagctttcagaaagattggtttttaataatcgcaagccaaagtgtctgtgagaaaaaaaataaaccgcgccgaatagactgatctaccttggttttcttgttcggttttcccgaataaaccgagaaattggctactcatggtacggaggtgccgcaggccttgtgcgcgcactgcacggcgacgtttaggctggctgccgtgggaattagcgcatgatctagtggcctctaggggctggtatgatgctatcaatgggcttttgcatggatcgatggaccgtggacgttccacctttcatagacatgcatagatcaatttcctggtttcttcgatttttggagataaaagaccaagcaaattaccgaaggcctaacaagggaaaaaataaaccgaagaggaatccgatgaccgaaaaaaccggctcttcggtttggattggccttcggtttccggtgattttatgcccacccctagttgggtattgctttatgctgttcaaggcttcaagcaaccgtgcagagaaacagatttaccaccctaaaaattctaaatatattaattatgcaacttgcgaataagattttttttctggccacaacacgtgattttttgcgctctagtaatttttgaaataatgtttttgagcccatggcaggtgaggcacactcattgaaggtcgaaaaggtactattccaaggaaagtcggactaccaaaatgtgatggtgtttcaggtaaagatcttttattgcaccaatgctgctttttcttcgtcttcactcaaactggagtatgaacctgtgctgttattttgctttctagtcctccacgtacggcaaggtgcttgtgctggatggagtgattcaggtcactgagagggatgagtgtgcttaccaagagatgattacccacctccccctttgctctatcaaagatcccaagaaggtaatgcatctaatttgcagattgtatgttgtataagttgtaatcctgctggtgtataacgagatgaactcttataattatttgtggttaggacatgcatgtgtgaaatatattagacataatattattagaccttgtcgagaaaagtttgctcgtattcttttgttcatatcaaccatgcacttccaagtactgatgatgataatattttttactgcaacaaacaccaacttaatgacaaggaacttgacaacatgattttggactaattcagagccaaacactggcaacatgtttgctaccctattttaacatcaagttttgagtgaaaagttccatggaaacacaagcaccatgtgaattctagggattcctaggattttcctgcacaaacgttgtcatgacccgaggtcatgacgggataaacaccgccgggaagatagccgggcggcgtcggctcctggagaagggatgtagattcaggctagggagaagaacattattgggagggagagattagactaattgatattcattgcttaacttgagatgaatacaatccatcccttatatagagatgatatgacttgacccataagaaactaactcaaactaactctatctaatcctatcctatctcctaaccgactgctacagtactcgtggtactgtttatccgctaggacttggcctcgtgggcctcggcctctctgcccaacgcctatgacaaacgtgaatgcatttttacattaacagaatcttgtattgttcttagttttgctacttgtcagcattcctattaagttaattcttctggccagaacataataaagtaccatttagttcctttttcttgcatcttttttaaatcgacgtggccaaacagttaagctttgaacaacagcatgtttaggactattgaaattgaacattcgaatacgacataactgaatttatcgttattagtgcttatataacaatgcagtttcagtaaaattttgtaacacgaagtaataataagtggccatccaagtttgttaaaagaactaaaggagtataagttacataaaattaagcaaaagagggcactatgaatttgttatatatgtgaaatatcaccattctgcatttatccttcataattttgtattgagttttaatttgtaccccgtcccttcataactataagggatttaaggctcttttggagagattaaggttacgggaaaaagataatgcccgtcaagattcggtgaaaaaaataaatgaagggttgttggattggctgagtagcactcaaaatcctttatatttgttgacagagggagtaatatgctaagtctctaatctttggtgaacaggtgttagttattggaggtggagatggtggtgttttgcgtgaagtttcacgacattcctcggtggagcaaattgacatatgtgaaattgataagatggtggtagatgtaagaacttttgtttccctggctttctttgattgcatgcacgtatcaattgactattggtcgatattcatatcttggtgatgcaaaaatttgttgatttcagcaaatttgtgttaataatctttaggtattttccccatatccattgtctgtatgtttggtcactctcatgtaatttgcagaattacttggcaatttgcctggtaccagtcaatgtgtagagtgtcactcctgttgttatgacatgtgaattgaattaaaaaggatgtaggaacttggaattaaatatttcttttgctgctaagtacattgaatcttttagaacgctaaatactggacaatgtttctcaaattaattatagtgatgcaatgaaatactttagcgctgaaagtggaaattgtggtccagcagaaaatatttatcccatggtttaccatgtcgtgtatataactgctaagaaatactacctccgtttcaggttataagattttctagcattgcccatattcacatagatgttaatgaatctaggcacacatatatatctagattcatcaacatatatatgaatgtggccaatgctaaaaagtcttataatatgaaacggaggaagtactattgacaaccacaaattgctacacatcatttacaccataaatcccaataatgaagggtctctttgctaatggcatatcattgtgtatttaatgattatatggtctgaaaccaactttattatcttagccctgaagttgaaaggatgaattgcctttgatgctatgaacttttgattatctatgtactccctccatactcacaaaggaagtcgttttggacagcgacacggtctccaaaacacaactttgacttcttgtttctataaaaatatttattgaaaagcgatatatgtatacttttatgaaaatatttttcaagacaaatctattgatataatttttacatttttaaactcaacaactcgagagttattcatgatttatattcccaaagtttgacttaaatattgtcctaaacaacttcctttatgagtacggagggagtaactaatagttcaattttgaagttgtgtttatattagtttataatttatctcgatcttattaagtttccagttcccttggttaatcaaatgaataattaattgaaggggttaaagaatccaggaccaaataaatgaaaagatactgattcaaatataaactttatggtgcctggagcttcactgctacagtcatagacaatgttgtcatgttgtcgccattgttgataacatgccactgtcagccgatggcagtcagcgtatgccttctcctatgctgggagtgaccgaggatggagggataagagagaagcattggtctggatcaccctttcagttctcttcacactgctgctaatagatctgcctttggggtagctgcggccactggagatctgccaaggtacccaaggaaagaaagtgaagagataagtgagcctgagggacaggcaaagggagaggggcatgcctatcttcactgtaatcactgtgtcatggcagtgtgtgttgtggttgttgtccttgttagcaatgcatggcagttagagccagatttaggaaggagcaggaggagatggtgattgaaagatggacttgttgaatgttgggctgaaagtgggctgggtatatgtattgggccacttctttctctttctctattttattgttctgcctgctccctgtattgctctgggctccctaccctatagttcccttatgccatgggctaacctgattcactgtaatgttgtgatgacattgctcgtaagacatagttttctgtgtgatttcattaatttgaattgccagtatgaatagaaaacaactccccccccccacaagtttttgctgtttcatttgttttgtcttgctatgttaatcatctgttcaattatgcacacaggtctccaaacaattttttcctcatctggctgttggatttgaagacccccgtgtgtcattacacattggagatggtaacaactttagaacttgttataccatgtcaatgtcaatgtctgataagcaacttctcctatttttgcaacatatttgtgctttgattaattttttgttgacgagttcatgcaggcgtggcctttttgaaaaatgctccagagggtacttatgatgcagttattgtggattcctctgatccaataggtgatttgttaatcatgtgagtttttgtgtttgtcattgatctatatcatcaaaataatcctgcctaaccacttatccaggaccggctcaagagcttttcgagaagcctttcttccagtcagttgccagagctttgcgtcctggtggtgttgtatgtacccaggcagagagcatatggttgcatatgcatattattgaagatattgtagctaattgtcgccaagtttttaaaggctcagtgaattatgcttggacaacagtaccaacataccctaggtatgctaactgattatttacatgtggctgaattgatatttccttagttcctaagctaaccatgcttccaatgcagtggtgttattggttttatgctttgctccaccgaggggcctactgttgatttccagcatcctatttttaacattgaggataatgagttctcaacaaaatcgaaaggaccacttaagttctacaattccgaggtgtgttctttgctccgacatggtactgccgttgcatgtcattgtggtactgttatctgactgtatgttattgttgttcagatccactcagcatcattttgtttgccgtcttttgcgaagagagtcattggatccaaggccaactagatcaaagatcactgagcccaaggccaactggactggaatccctccgacaagagatttggttgtagcagaaagagcaatgaccccttttttcccatttaaataaaaattggagatgtaaacggttatccaagtgcttttgaattttgtctcagtatgagaacgttttgtatttggtaactgttttcccgcatctcccttaccatttaccaaaatgagtattgctgtagttttcatctgaggtgcttcttgaattcttgcagtcagtctcattttcagctcgagtgagacggtggtttctttgaagggcttagtgctttgttttgggggtttggggggacatggatcctctacctttggctagtaaagtaccatccaaactaattgaatggacagatttgcttatagggagatagagaaggatatggtgtcatcaacagcttcacttaactatttaacgatatttcgacagttagtggtttgggcgttgagtatttgaaaacaattactccctctagataatatgtgctatattatgaaacggaggtagcaggtttctttttgggattggcaacctatattttttttttaaaaaatagaattgctggtttcgggaagtaaagaactaacattttagtgttcatgttttgcgtgaggattcataggggaaagggtaatccatctgaacccattattgccaaagaaataaagtaattcaaccatacactgcatggtggttttaaacttttaattgtttcttatatttctatgttctctgctcatgtgttgccttcaattatgagcgattggcgctatatgttaaataagccgttctaggttcattatgaacagatcgtggaaacaattagcgattggcgaatcccatcaactgaagaatctcattgcactagcagtctagcacgtacataacgagtaatgagatatagggtttacgattctgagatggcattccgttccgggcgccggcggaatgacggttttcgtgaaatccggtggaaagccagtagattccaaataaatttcataaaccaaaatttgaatacaaattccgagtttaccgatatgtttgtaaaaaccggtcggttttgacgaaattccgagcgaaatcatcgaaatttcaataggcaactagagaaagagacaaactaaaaaccgttcggtttgtggcgaaaaccgaacatgttttgtcgataaaccaatgaaaaaaccaaatttgttttagtcaataaaatgtaggaaaaacacgtgataattgaaaaaattcgtaaaaatgccatttcctttaaatttgataacctaccattgataaccaaattttctttttttttaaaccgttattcttttctttcctattgtaaagttcaggaaatacatgggatacacctttttttggaaaaattatatcccattaggctctatgatatcatactatttataggattttatttgattttttcctattttatcaattcaaatttgaatttggatgaaacccatcgaaattccaaacggcttctactttcgagccacgccgaaacctcgggtttccgcggaattcg

SEQ ID NO: 437 - DNA, 4340 bp, Oryza sativa
atcaaataaaatcctataaatagtatgatattcatagagcctattgggatataaattttccaaaaaaggtgtattccgtgtattttgtattcaaattttggtttatgaaatttgttcagaatctaccggctttccatcagattttgcgaaaatcgtcattccgctagcgcccggaacggaaggtaatcttggaatcataaaccctgatgagtctactttggctcttgtttggcagcagagtcaacaccgccatctagctgctctaatgcattggataagctggcttttgagcgcatcttccaaatctttctatcacagcagtgaacatgtcgaggtcatcgttcgggttgagcatcgaccgtctacaagattccaatcagcagggttgtagtttgtgctcttcagattcaacgaagacttccatgtcaatctttgtttgagtccagtgaagataaaaaatctacgactaaacatcaaaacttgaaaaagccaaaaccgtagagacagtagggattgccggtaggtcaagcggtgagcacatcagaagagggcccttgatgtacttgtcgcggcattgccgtgggtccccgacgacctcatcctccactattgtgttgttcgatttggaagtttgctttgaaatttcagttttctccttttgaaaggatggctcgatgccttgtgcaaaatcttacaaggcaatgtaacaaggaactgagtttcctgattgtgaatctggtcttaacttttaatatatacttaaaaaaaaagaagaagagagaagacatgctttgtcacaacttcatcacaggtcattaggattagcaattaggtttgtctcaacaaagatatccttatactgtaaataattcatttttatacagaaatttaaaggtaatataactcttgtacagaaacttctttacatgcaaattgaagtactacatctgcttttaaaacgagtaatttaggtttttttaaagccaacagtatataactttgactacttagttctttagcataaaatattctaaataagttttaatactcaaatttaactcatgttgacttcacgtatttttaaatggtattttagactgaagggaaaacacatattttaaaatagattttttagaccaaagggtttggagtaacggagagaaagacaaacctatagcctttgtaaggcgggtcggtagctgtgtggcgccatcggcacatctataagaagctgatgaagagcaacgggtggatccacagcacaccggacggcatggtgacgccccccacctctgttgtctgcttgttggtgtagctgaggtaggatccagtccctcgtggcgaacggggttgcactggcgagcagcacagccaggttccacagccccacggcgcgcgtgacatgtgagagaagtggtcgaagccgaagttgtagtagagcttgacccacagcacgttgagccagtggtagaggatgcaacccacctaatagatctagagctggcacactggctttagagacctgccgtcctttggcttacacaacatgtacaacacatacaaattaacaaagggtaattggatccatatcattgtaaatttgtcgatttgaaaaaatatcactgtttttcgtgatatcgggtcataccactaaaattttgcaaaatttgaaccgtttcattgtcatcaagatttccattagtgcatgcatttgatggtacatttccgtcagcgccttcatttcttctccatctctagcgcgtgtagcaaatctctagtgtacttgggctcttggatggcagcacagagaggacttattgatggtggctcatggacttgaggactaggggcggtgacttgtgggcttctttgcctacctacgttgacacccgtccccgcgctccccgccatgctccccaactgcaacgagtaaggcagaggagacacgcagccgtggcaacgtcgcattggagagagagagagagagagagagagagagagagagagagagagagtagtgaggggcttgattcagcggcggcagcggcaagcttagcacccgacggagggagatggagctagaaaggagcggcgccggtagcggccttcaaatccgacgagcttaacaccctggtggagccggaggagatctttggttgtggcctctatatccgacgggcttgaccccacggtcccctgttgctatagcagacgacaccacagtggaggcgaggttgtgaacggagattcgcgtcgcctcttattcttcccctgccaccgtgccatgctctagagctcggccggtgctcgtttcctgttgaagctgacgagggtgttgatagaaatagtgatggagtatcatggtttgaattttgcaaaattttagtagcatatacccgatattgcgaatagtagtagcattttttcaaatcaacaaatttgcaatggcttggatccaattaatcctacaataattctgtcaataacatatttataattggactagtccttaaaaaaggggatattccctcccattccctatagtgtaaaattgctatggaaatcggataatatagagacgtgatattcttgatgacctgcgcaccggccgagtggtcgacaaagtgcactggtggttcgtaatgcataaaggaaatatcaaaagcgggtaacactacataagtgacactaaaactaaaacaaggtcccaaataagatatgagttactccgaagaattatcatcaactgcaacatcattatctgaaacttcagtctcatgatcatcatcggaagcaaggaactcatgttcagaggaagtcaattccttgtcactttcatcaaggattggcgctgctgtcctggaagtggaagcacgatttgacatcgctccatgtgaccttttcgcacgttttgctgattccctggtttgttttctaggtgatctctttgtgccaggactggtgtttcagctgtataaccccaagtttgagttcttgccacattttgtgagccttcagattcatcttgaagccaaccttcaacattacaagtgtcattgtcttcgcatgcttccattgtagcatcttctttctgcgctgaaccatccttcttcttcattcttgagttgagttgtacaaaaacaatgtcatttagcctttgaacaattagcttgtttcttttctttgtttgagtctaaagagagacatggaaggaggtcactagtctaattcatttaaaagggggaaggagctgaaatataatacatgaagattaagaaaatgagaggaaaatgttacccattcaaatgcactccaatttctttcacaacctgaagagctgcatgtcaagtttagaatttttgtagcaaacccttgcaaatatggtgcttttgatccccagacattccaccagtgagcttgaaacaaaacaatgtaccagatagtacatggttgctagataatgaatgtacttgcagacattaagcataaaagcatttaaagttaccaggattaaatgaatcattgtttttctctctctgcctcttagctcctggatttccaaaagttccagaagcttcagagtatgccaacatttcagctcctgtgatcttgtcttgattttgatcatctggataaaaacgctgaataaacttgtgaacactgccagatattttttctgaactaatgaagccatttctgttgctataaaagtagtaaggattgagataatatgccattaggtgaagttcactatccaacttgccatccatgtaaaaatcaatggcattaataacaggaatgcaaagctcaagctcatttcgaagcaactgagctagctcaatccttgcatccatcagaccaccatgaatgaatcctatagctggccttttatcaccatcaacaaagcgaagaagcttaaccagtgaacggaaaacattaatggctaactctacattatcccaaaatttttcatcagatacaacaactgaacttatccttttagcttgtgcagtttttgagatcttgagagcattgaacctgggcagcagtaaaatgtttataaaaatatataaaataaaattccagtatagctgtaagagtttgaattcatacctgttacctatgaacattcgtttttaactttgatttcaacttgtgaaagctgctcaatgtgagaaatattgtggcaaaacgtgtcgctccaggcctcacgatctacctcttctcagtatatgagcgcatcaaatcaagagttatgtgatggttatagatgaaagaggtaattttcttggccttatccactactctttgcatgcgttgatccttgcaaatcttttcta

SEQ ID NO: 438 - DNA, 73722 bp, Oryza sativa
agggttttcgactccgctctctcttcggtctcagtggttctggagtccatccattcggagggccatctgtggtctttagctggcgtcgccgcttttggggatttgttgggagtgtagcatggcttggtcccttctgttgcgtggagtatgttttaagccgccgtagtttctctaagcttcagatttttttcatttgctttttctcccttcccctggcataagccggtctggctgattgcatcgtgtaactaaactctttttcttctaatatattgatgtgcaatccttttacgcgttcgcgaaaaaaaatgcagcacatgaggtccattaaatacaaggatatttctctgtaaaaacccgacctgctgcaaggtttgctgaagcattatcagtaacaacatgaaacacattttcttcaccaacatctttgattccactctcaaaacatgttctgcagtatgagtatctgctgagccatcaatagctcgaaggaaaatagtgcccatctcactattgacacacaaattcattaggctcctacctctcttatctgtccatccatttgtcataattgtgcatcccatttttttccaccactctctgtgagtctctagcatctctttgtcttcttaacttgcctatgtagcactggtttcctccattcatacatgctaggaggcttgtaaccaagaccatactgtccagcctcacaaaaagctagaaaaactggatctgttaaagaatttaaacaaaataccacacttacactgaagtgtgggatttcgtttaattctgtaacagatccatcttttctaacaattggaagaatagttattaatattatcataacatacagagcaattcaagtgatcactatgtttttttaaactggcagtagatgatctaaatgaataaatctggatcaactgctgattaggaaattaaatacgaatacgcattgacaagaaaacgtaacatggtgcgcttggtttaacaacaagaaatttgtttccccaagtttccttctcctttcagcctgacaagaaatagataattgtaggaggcaagaccaacacctatataagggccaaggccggttcgattaataccaatccccaatcccaacaatctctataatcgaatcgttcttttacctttattttttagtcatgttttctactttatcctagtttagtctatctttgtcggtttgcgccataaaccgtccgccgtcgctgagagtgtaatacccctttgtaggtttgtcccgtaaatcttccgtttgcccacgagacgggtggttatcctttgttgcacctagatcggcttcgctagccggtctagtttgcaaaatccatcttgatttggtcgttggctagatcggggtggttggcgactccatatcaccgcaaggcgtttaggtgtcctgatcgtgattgtcttcttgccaaaaaaaaagagttgccaacaccatgcacattaaaaagcacatacaggtgctccacaaacagcaagcaataagcttcaccacaaaatgactatggcaagagttgctgttgaatacataaaccagggcagcatcggaagcccttttgcagccaggctgcactaaattttattgacaaaatttgctacagaaaatccagattttgtggcctttcatgtaggatacttagaaaacttgtggttgttgggcacccgaaaaactgataattaattatgggataccgtgaccattgttttattattttctctccaaacgaagatggaaatgggcagatgtttgtaggcaccgtggacgtcggcaccgctacgcaaattctattgttttggagaagtgatcagggggatggagagcggcttgggtatggttcaaacaagacccaattagggtacaagcacccccctcccccgcggggtcggggggattgccttttccacatggtttttaccttcattaggatcaaaaataattaaacaatgatcgcgatgtccggtagctaattactatttttttggaatgtccaatagcgttatcacgtttctaaggtgtcatatgataaagaccacaaactttttgtgttatagcagattttgctaattttgttcccttggaaacggccgaacagttttgaacgtctgtttggatgtggtccttcagttatttggtatttgaacagttgaggtactaaaatgcaaacatgcccgaagtttgaattagacagccgttggagcccttcgacccctccttgtctgggcgctcggccccacgcggtctcccccatttcaaaatagcggatcgcgattcgcgaacacgaagacgacgcaaaagcttaaaaaagcatcctcccaccgcgcgctgctgccttttaaaagagcagctctttccccacttggaggagcacatgctgtcccgttgcttagctcagctcgacagccagtgaagtgaggagacgagaagagcggtcgccatgggcgaggcggtgctggtgtccaatcatgggtgcagcggaggcggaggaagagttggagtccgagtcaagggagcgggaggaggaggacccggcgaggggaaggcggaggggcaacatgggcaggtgctcgccctgctactcgccgcgctacgcaggtcggtggtgctcccgtgccagatggccgacgctgacgacccggcagcagtcgcgtgggggatggagatcgggtggcccaccgacgtccggcacgtcgctcacgtcaccttcgaccgcctcaacggcttcctcgggcttcccggcgagttcgagctcgagatcccgggccacgtccccagcgccaggtcagtactagtatacgttgtatgcctggcctggcgcgcgcgctggcgaaatctaagcctgcaatgattcctccggttaatgtctctcggcgttggatttaccggttaatgttcttcttgattccgtgcagtgcgagcgttttcggcgtgtcacctgagtcgatgcagtgctgcttcgacgacaacgggaactcggtgcccaagattctgttactcatgcaggagaggctgtacgcgcaggatggcctcaaggttgtatgaacaacaaatcagagtctctctcactggaattctccattaatccatttttctttggagaaatttcagttcggagctaggcgtctcgatgtgagctaagttagtaaatttaattttgttcgttatctaggcagaagggatcttccgtatcacccctgagaacagccaggaggagaatgtcagggagcagcttaacaggggccttgtgcccgacgacatcgatgtgcattgcttggcaagtttgattaaggtaataaatcctagtgtcattttagttcttcagtgcccattaattattaggaaaaagaatgtacccacatagggcagttttcttttctcgacaaggttaaatacctggatattaatggagattggtccggtaaataacttcctaagtaataataatatttgcaaagtaagatgctattaaagaatgatccttagttaaatgttattaaagaattatttaaagtcgaactaagatgtaagtccgaagatttatttaactgaaactgtagtcatttaatttttttccctctatgcgcgttcgaatttcaataagaaattgttatctccgtaggaataaattacaaagaacttctgattgggatgcagtctacataatctttaaacagccttcctgatcagaaacgctggcaccatggaaatgatgagattactaatgttcagtaccctaagcattttcaactaagtaatgggactgatctaaaacacacacactaaggattaacatttagtattatttagtttgatgttttaagtacgtatgctgcacaattttgttcaggcctggttcagagaactccctgagggtgtactggatagcctctcacctgagcaagttcttcactgcaacacagaggaggaatgtgttgagctcgtacggcttcttcctccgacacaggctgcacttcttaactgggttgtagaattcatggctgatgttgtcgaggaagaggagtcaaacaagatgaatgcccgaaatgtcgctatggtctttgcacccaatatgacgcaggtaatttttcttaccataagaatttttttacgtgatcaattgtatgctgatgcaagtgcgctaagatgagatagttcacttgcattcagatgtcagatcctcttactgctctgatgcatgctgttcaagtgatgaatcttctcaagacattgattctcaagacgcttagagaacgtgagcatgatgaaagcgaatactcagcaatttcatctcagtcatcttcatctgatgaacttgatgagatgcatcatcatgttgaacaaggtggtgacagtggtagtgacactgacaattttggagatgatggttctcaaagccaaaaagatgttgccaaggtccttcaacaaaatgttgtcaatgaacagccgattggtgcatccaggaggcacacgtcaattgatttccggttgccttacattagctacggcagcgacgatgatgtgtcgcccaatgatattgaagaatgtttcttaaggaggttagaatggaatgcagtgagcaaagatgcttctgagattggcagcatcactgttcggtccaaccaagaggcagggcaactaagcttctccgaagaaaatgatgggtattacagtacagattatcaatctaggaacatactcctaaaagattctgttggtatccaaagcactctaccgagggaaaccgaaagcagggctgaaattacaaatgacgaggtacaagacggcgctgaagtggaggtaactctcgagcaataatcagaccttcaaaggatggaggtcttacgtttcgttatcatcgtccatgtgttttaatatgatcttgtactatgattcaagccggtcaacacagggttgatgaaccttatcctagtagtaatattcttcggatgctctatagttctctgcctttgagctgtttaatgtatttgtgtgatttcattaactcgggattttactaacctggacctatcacaacttatttgtcatttcactctgtttggttaagcaaaaagtgattcatgtgacaagttgaaagcgtaatcaacaaaagcttagcatgaatatttaatcgggattgctactccctccatttaataattataaaacgccataacttttttccaagttaaatatctataactttgaccaaatttatagaaaaatatagcaatatttttttaaaaaaataaacatactattaaaactaggagggtagctccttatttaatgttgcttgattgtttattatgaatacttgtgccgatgactatgtgacatcctagcctaattaggatgaagtcagtgtgccccatgtgagtagtgtgtgcatgtttagtaccaccttactagtttagcatgagtggaactaacttataagacatcttccctcctaccatatcactcccaggttaacccttttacatgaagcgaggacgaaagtgtaagtgtgatatgtgtaagtgggcccgcctgtcggatgggctggctacgcggttctggagggatgtctgttatagactatttcttaaaatattattttactctattatgaacttttttgtcctcgacagttggtggtggtgcggacaaatcgacggtggggagggaggtctgttatagactatttcttaaaatactctctccatctactttttatagtcatatttccgaatctgaaaaatttatttttgataggcatatttttcaatccaacaacttatcatctaatgactttctcggatttaatgcgtgactctccattcttccacatatgattggctacatgggcatcgagaaatataaatattaatgaatcgcttttttacgaggaatgactagtagcatgtttaaatagatgataaacagaattacttatcattggtctgtgtgccaagatgaaatatgactatcaaaagtagatggagggagtattattttactctattatgaactttttctgtccttgaaggtcggtggtggtgcggacaaatcgacggtgggttttggaggcgcctgtctgttgtggcgtggagacggcggtgtggccccagaggtagagacgcagaaccacccccgaggtagagacatggagtagatcagcgatgcgcatggcgatggtagtgggcagctctggtcggcagttgcctatatcggtgatgcttgggcagcggtcgcgcggaggagatcggcaaggtcgttggcttcggcggtcctcgacatggaggcgcggagtagcaccatggagacgacggtgtggcctccgaggtagagacgcggaactgcccccgaggtagagacgcggagtagatcagcgatgcgcgtggcgatggtagggggcagctctggtcggcagttgcctatattcgtgatgcttgggcagcggccgcgcggaggagatcagcgaggtcgttggcttcgacggtcctcgacatggaggcgcggagtagcaccggatgtgggtggcgtgggaaagaatatgggagggggtacaccgctactagacagagaataaaggttgcatgtcggagtaatcggaagcgttagatccaaatacgacgataatcctgaccttgtatgaagtatgtaggatgtaagactattgttggtgaaatatagataaaaacaaaaagcttaaaaatgaaaaaagaaataatgaatgaaaaaatagaaaaaaaatacggggaaaatttcggaaaagtaggaaataaaatgaggaaatatacaagaaaaaaaaggaaaaataataggggcaataagaaaaaaaaatgaggaatatgtagggaatattagaaaaaaaatctatatctatatatataactaataaaaaaataagtactgcttccccgtatattttcgtctattttctttttctcgcctttttttttattttttccagtatttttcatcttttttaattattttttacctcaaaataagtaacgtttgatatattttcattcgtattcttatttttgcctttttttgttttttttccgctttttttcatctgttttattattatttctttcctcgcggtcttttacgattgcctttttttcatctttttttacatcgctatttttttgtccgttttgttttttagttgtttttcctttttttccattcgctttttgttgctattttttaggtcacgcggtaaggatccagtttttctatatgtcttgttttttacatcgccggccacgccaccgccacgtcgatatatctcctcatgcgtgtctgttgatgtgaaaaatacacactggcctagaagatccgcttaacttcagtgcaggtccaaaatcttgcctttaggttcgtgagcgtgccagttgatttgatcctgcaatcaacgagaaagaaagacaagaaaaaaaccacggttaaatccataatcgatagccgatcggctggtcgtcgatgacatatcatttatcctcaagccgatgtcatatttgaatcgatcggtagtcatgagtaaataagataagactaaatatactcgatcggctgtagatattgacaacatataatcctaacttcaatacatatttaaactaagtgattgggatagatcggtcgccatgccgagacagtataaatcacttaagtcgaaatatatagtaaagtactgattatatagatgtttatagcatagctgatcaaatagatatagcatgtatcggctaatactccgataccactctatattaagatatcaagacaaacagaatatattaaacaagaagcctaatataacttaatgcaataagatctcaatataaagggcaaatctagcatattaaataagcatatgagatataaagtagctaaatcaggtaagatcggctgaaaccccaatactatctctctcgataatcataaaacaagccagatatcacaattataagtaaaactcaacagatcaaactcaaccgatgcagcattaagcataaagataattgtgggatctaaacaagatgatgaaaacctctaagagatggtggatacacgatataatctaacttaataacgaaacataacgctatcggtcacttcctgacaataagaactagccgataacaagttatataacgcaactaacaaagattgtaatgtgtatatgataactcgataaattacgtaaacatgattagagtgtcataaagatggaagcactaatccggagaacgcaagccgccatgacaagtttacctcgagttgaagatcgaatcgatgcagctcaacccgaaagcaaaaactcgtcgaaatagaacgaaagtaaatagggtggcgatgcaccgaaattgttattgaatgtgtgttaattgattactacatgggttcgggtcatatttatacccaagattacaaaatatgtccttgccggacacgactcttatctctaacaaactctaagataccataattctttgtggcagacttttgcccaaacatatctctaaggaaattataaaaatatcctaattaatagatacaattgcctttccgagagctttatctccatcgtggcaatccttgtgaaacacgttgatagattctagaagaaacagccccaaagccatcgccactggaatcggttgtatcaaccccatcagctatatctgctatccttcatccgatcatcttcaaccgattcagactctagccgatgtcttgacagccgatgcgcacgctgttatttgaatctaactctttgccgaatccgcttcgatcccaatgccgaacctggttcatgtcttaccaaatttggtcgttaaaacatgccccccaagtccgctatatttgtaatgtggcagatttgctcaatttccccttccgattaaaactaggtttccattaccgactctgttttggccgttaccgcgctcccttttaaatagtaaccaccgctttgcacttttcacggcgtcagcttccgttttaaccactctagtgaaaactttccccgatctcctccttgagctctccgacgacaacttcgaagtttccggcgacccaaaggcgattctccgcaactccaatcttcatcactagcaatgtcgacctctaccagtccaccaagcgcatcggccaccgaatatgtcgaggtaagtactgtcacgccctgaaaatcgcctaatttaataattcattctctaatgcatttttagaaattattttaaaagcttacaagttaaactctaataatctaggaaaaatcgcaacataaaactaagttggataaaatttcattaaatactttacttgtttatctattttttagattttttctgggaattatttgagtaaggaaagtatttttaataaatgaaacatcatttcacaaattattttaattgaaaaagtttttaaatcttcccctaagccgttgggctgttttcagcccaactctcttccctcgcgcgagtgctgtgtggcccaagtcggcccagccgagcttcccccttctctttctttctttgttttattttcagccggcccaagaccgaaagtctactatgcctccctatgcactgttcttcttcaacctctgtcagccgacccgagaccgaattggctcggtttttcccctccaattccggcctttcctcacgtgcatttctaaaattagttgaggagatttgtttcctttatcctcttctatccctttccccaaaaatccgattttatccctttgagttcgatgcgaatttggattcgttttcgagtttatctctccaaactaaccgtcggattttccggctcaaatcctctcgtttggagtccgatctccctcacccatgcctatataaagcatcccctagtcgtcctcttccgtttgcctcaagtccaagccgccgccgcggaaaccctagcgccgacgccaccgtagccgcttcagccgccgctatgatcgtcaccgccgccttccgtcaccactgtcagattcgccaggtggaggagcatcccgtccgccccttcgcagccgccgaagaccgctggagagtcgccgccgtcgtcaagccgagccatgtcgccgtcggagttcgtcgccggtcattttctctcatcgattgtcgtcgccgtcaccaccggtgggttcctctcgtcgtgctcgttgtgatggtgctctctgtttgcgccgttgtgccttcgttcgccggcggttgtgtggtccagaaccatacccggcagggatgtcatcctgacatcataaatattttatttaaatcttaataattttctgtattaggtgaaaaactgattaaacttcggaatatcataactaaatcatcgtaactcagattcaagtggttcaagttgctaaattcatctaaaatcgagatctacatgttaaaaatatccacatatactgtttatgcttgtttttttaactgttttgttgattttgtttatttgctttagtttccgatgttccgtaggagagcgtttacgttgaggaaggttcagaagcatttgaagaagctcaaggcaagtcacacagatcccaaacaaccctttgagcatgatgaacccgtttaaagctaatattttatttcaacttatgcattattttcgaatgtcatcaggtggggagccttttccaattaattatggccaaagatgactttattttcctatgggttataaattgattggcttgaaccttatatattggtttggttcagctaaatgctatatatataattgtttagccatgcctagaaacattagctcattaatgggatgaatcacactacattattatttatggttatatataatggtagctcacgatggttaatcgtgttatgataattaattgataattaaaacccgattaaaggtgggttatgagcacatggttttgatggtcgtgctcatgacaattaaggaccagttcgcgagctactgttgtgaaacattaaccgtgccaaccacaagccagtgtgggcaacagcttgatgaggacatccctagcagccactcttccccacctcctaataaacgtgcatctgatatagtgggtccaattacaaggagcagagccaaacaattagagaaggaaattcactctcaggtgaacgctaaccttgtgttaactaatcaaattactttggatgagcctatgcttttgagtacttgttttaatgttcttaggaatgatggagtgcacgaacggacatgggatgatgatggtttctaccctccaaatatatggactaaggagcctggacgtgcatagcaaagaggaaccattcagctgctatacatagtaaataaaaccttcaaattgttgtttcgcatgtggagctgcatgcaaatgaagtccaaacatcaagagagctccactaggccatgaatgcaaggattattgtgacttcctactgcatgttttcatttatgtttttaaagactccactagtgctatatatagccatgtaatagatgacaaggggactttttggctgccaatttagaaatacaaactatttgagttcttctttccatgtgagtctcgagaggcttgcaaatttgttctttcaattcccgagggaattgtagaacgccgaactacggttcacctagtttgtgccttcacatctttatggtgtgattgcgtgggctggcttcgtcggtacgtggaagggtgattgtctcgatagttcgtcgcgtgtgcagactctcggcgatagttatcaagttcgtggatcctttgagaagatcgggccacaacttctcgtcacacgtgatccatagacgtgtgcacgtcacagctttaccttttgaatagcatggttcattacggggtgccagactgagaagcggcgagaggtccgtgggggtcgctgggatgtccatgcctctagttgtagaggaggtgattatgatccaggtatggtgcactgtggtgagttgtgttgtgtgttgtgcgaagggtactgtcacagttcctttccgaggtaccgtggttgtattgaggcgcatggtgacatgtcgtggagctgtgtcttgtgggtacagtggtacatatctggccagagtaaaactattcaaatagccgtgtgcgcggttatgggcgagtctaacaatgtttttcgtgattagtttcacactactcattaatggtgataacctgtgatatttaaattgactcctggtttggaatggtatattcctagtatggaggtttgatttgtacaaccggggttggttgttcagatgaggttgggcctatgcaacacgggtgtgttgtatggtgtttatttaatattgcttaattactcaactgttttactattctctcaaatgttcattaaatgttgtttatgcaaataagctatactatgtcatcctttgttatcctgtgcacttccatatttgctgtgtggcttgttgagtatgtcatatgctcattcttgcaatattcattcatcagaggaggagtacttcactgaaggtgatgatcaggaggattaggctttgttcgggtcaagttgcttgtggagtggagccgccatagctatttagtcttttgtttattgttccgctgcgtagaattttattcttttgagaggaactatccacctttgtaataacttattattttgcgagtattaattagctgtttaataatactctattatcaatttgttattgtgtgcctcggctgattcctggacgaggatttaacacacatgtaagcgtttggaattttggatagaaatttcgggcgtgacaagtaccattggctaaatccctttctttactgcacaagattggttcttcttccgctcaatcctcgatttctcttcttctgtagcatctcacccaccaagttgcgtttccttgtataactgatgaattccagtttttccttggcctaatcggcaatctagaccccacagaatttatcaatggagaaaccaaccaaattccctttagatttgctaacctagatctgagctgctggaagaacaccttcaaatcctggccgttggccgaaaaaagcttggcctgcttggtataagaggatatcggctaccaaatcaacccactgggaagaaatcggcatatcccaagccttggccttaactgcagcggatatggcaagagatgagcctatgatggcagccacttcttacttctggtccagagccatgaataccttccttttctcccaagggccgatgaccccaaccctgttagattccatcatgatcaccgggctagatgtcacttcatcggctaacttgtctagtttggatacccaactcacccacgagttcaagactagaagcataggcggttggacaagttatgttgcgaagaacatgggaactgggccagtctctccaagggaacatgcagctttccttatgatgtggctcgaaaaattcttgttctgcggtccaagctgtggtcctaccgcaaactggcagcgtgtagccgagaacttggtagaaaagaagcacttcccccttggaaaatacttgctaggctatctatatcagactctcaataccgcaattaacaagatagcctctggagaattattcggtacagggggtccatggtggttactgcggatctggctaaatttgcacaccaggatggttgtcaatcggccaccattagtcgatgcaagatctccaagatttgagccgatcatcgatgatgatggagaaacgagcaccacgcgccgatgtatgtcttttggagaagcagcatcggtcagcattacatccaggctatcggctaagcccttcggagagtggttcaacaacttttatgatgggttccccaagaatagtagaatttggtttgcatatgaaggacatggcatttttgagctactaggcgattttcggtttgatgaaatcaactctaaaaaatatgacaaatccagagaagtattctcagcagctatcagcccttgcatcattcctgtcggtattcaccagggcaaaaacatccaaatgacctacgaattttatcatccgacaagtgctgcaaggcaattcggcatgggtcaactgccaatcagcctattctttgctgacaaaatccaaagtagaggagaaatcacatcattgctcatgatggatcggctgctaaatctaccaagaccacctttgggcagcatcaacaatatcaattttaggatgctgagaggtgcagcttttgaccgatgatggatagagtggaagaaacatttattccatcaaccggcttccatgtacttgacaaatcttttccctaaagctgtccctcaagtaagaatcatttcttttgtcaattttgttaactgcaaaccgatgtatcagttttaaccttatgtaaattcttcttttgcagacaacagaatcttctcctcctcatcacagcaacagcggtgtagacatccaatatgctccaggactcctgccaacggtggtggactaacacctctagttatcggctacaatgccccctaagacctccacattgctgcatggcctgcctcgtgtgccgattgctcctgctgctggaaagaaaagagcaaaatcggctgctgcaccatcggctgcaaagaagaaggccaggaaacaaaagactgctgccgacgatctaccagccattgatccagatgtagctgaattcctggaagatgaagcaatggcagaagaggtggacgaagcagctgaacacattagtgaaacaagggagcatactcctccaactgattcacctagtccttagagaacaccatcacctccaatacgtcccacttaccagccaagggtatgcatctcctcttatccatcgccctcatactttaaagctggtttctgactttgtactttgcagaagaagaaggtggcttccaagaaacctcaggggacatctccaccggttaacttccttaatcatgtcaactttcttttttattctctaagtaaccgatgctgacttgtacttatgttttcagcctcctcgacctccaactcttgtctctgaatcaagtgaaaacactccatcggctgtgggaagtcaccatgtagaagaagaagaagtagcatcaccagctcctgcatgctatccctgtaagtatatactttaggtctgtcttcttacaatttctaacccataatattaaatatattctatttcaggttttagccgatatgttctcttttgacattaggccattcttggatgaagaggaagaaacaacaagccaagctctggtgcccttagccgatgataccaagtcaactttattggatatctcaaaaaggcatgaaggctctctggaaaccttggtgacaagctgcggatccatccttgacagactcaacgaaattcatgacaagatcccggatgaactagctaatgccatcactccaacagcataccttgagcaacatcggcttaagcttgaaaaagctcaaaagaggattgccgatcggcgtgagagaagagatcttgaagcaaccatccaagccaatagagcatccatcaacgaagaaaaagctaagctggatgaattggaggctggtccaagtgcaactcaagctaacattgatcggctgaataaccggaagatagaactcctagccgaaccggaacaacgcaatgcacaacttgctcttgaacaagaaaagcttgccgatttgccaaaagccatcgaagatcagaaatccaagctgaaagcatctgtaaagcatctaactgaactgaccaagtctttgaagccgatctctagcactgatgcagccgatgccaagacaatagatgaagtagatcaaattaggcaaagggcaatatcggccatccaaagatacgtgtctggatgagctaagtcttgtaatttaattctgaaacttaacttttgggatgtaataacttttctcttgtgaagcttgctcttgaattttgctttggaaatccagacttctcatatatacttgccccccccctaattttgcaatgttgaaggcattgataaaattataatttggactaagggcgatatatcaaatatcggccatcattcattggcaaaacacaaccgattatgataagaaaaaaaagcactaaaggcgatataatctatatcgaccatcatatatcggcagaacacaaccgattatgataagaaaaaaaccattaagggtgatataccttatatcggccatctcatggcgatgtcaacacttagccgatcatgaattgatccaaacacttggataatatttcttcaagtattttccattaaatgctcgtccataaacttcaccatcaagtccttgtaacatataagcccctttggacacaactttgtatatttgaaacgttccttcccaattcggtgaccacttgccgaatttattattgcgagttcctatcggcaaaatcagcttccaaactagctccccttcagaaaaagacttgggcaccacttttttgttataatgccgagcaactcgttctttatctttagtcacctttgtaagggctctcagtctggattggactagagcttctgtctcatctaccataagattataatactcatcggctggtaaatcatcctgtagatctattctccttgagccgattgtagtttcccatggtaaaactgcctcatgtccataaacaagcttataagctggtaaatcatcctgtagatctattctccttgagccgattgtagtttctgataggaccataatgctttagccaatcgtgtgtgccattgccgaggaaaatcagatatctttcttttgatcaacttaatcaagctcttattagatgcgtcggcttggccattagcttgtgcataatagggtgaagaattcaataatttgatacccatgctatcggcaaactgaacaaattcatcagatacaaagattgatccctgatcggttgtaatagtctgagaaatcccaaattggtagatgatatgctcctttacaaactgaattgcatcccagaatcaactttcttcaaaggaactgcttccacccatttggtaaaataatcggttgccaccaatataaacttatgtcccttgcttgaaggtggattgatctgaccgatcatatcaattccccatcctctgaatggctatggtttgataataggattcatagtcgatgctggtgctctctgaattgctccaaatttctgacaatcctgacatcctttgtaatatctgaagcaatcctctaacattgtcggccaaaaatatctcgtgcgccgaagcaaccacttcatcttgtgtgccgattgatgagtaccacatataccttcatgtacttcacccatcacaaccttagcttgatcggcactcaaacacttaaacaataccccatcaatcgtccaataataaaactcatcatccaacaatgtatacttcaaggccttataacgcaactttcgtgaagccgattgagatggattctgtaaatattgaaaaacatcatacctccaatcattggccatgattgcagccgcctctatcttaatatccttcatcatcggcttgtatcctgatgcccccagagccaggtcattagcttcaacgttctactcccgagggacatgcttcaaagttaccagccgaaaactattcatcaattcccggcacttctcattgtagatcatcaatacatcattcttgcattcgtattcccctaccaattgactgatcactaacaaagaattccccatgatctccacagcatcggcttcaacctccttaagcaactgcaaccccttgagaactgcttcgtacttagcctgattgttagttgtataaggtttgatagtatagacaaactcaaaacttgcccaccgaggggaaattttaaccaagctaatactacagccatgagtacaaactgatccattgaagaacaaagtccaaggaacaatgtcaaccgagccgattgaatcatcacgatgttccacaataaaatcggctatagcctgccccttgattgccttgggtgattcatatctaaggtcaaattctgtcactttccaactctttctttgagaaccggagccatcaacatatatttgatcacattggctttgcataccacggtataacaaataatgccttaacttggtgcaagagaaatacaaacacaagcataacttttccatgggagaataccttgtctctgcatccaagagccgacggcttaaatagaaaatagatctctccttgccttcgagttcctggatcaaaactgagccgattgacttctcgccagctgacaaattcaatctgaaaggtactcccttttgtggtggaattaacaccagaggggaacttaaatatgccttaatattgtccaaagctttctgctgctctgccccccaagtaaattcttgatcggctttcaaacttagcaaaggtgtaaaaagttccaatctcccagataagttagaaataaaccttctaataaaatttaccttgcggatcaacttctgtaactgtttcttgtcctctggaggttgaattttcttgatggcatcaatactcctctgagttacttcaatccccctctcataaacaagaaaacccaaaaacagaccagccgatacaccaaaagcgcactttgtgggattcatcttcaggccatatttccttgttctctcaaaaactttcctcaaatcggatatgtggtcctctacctcttttgacttaacaaccacatcatcaatgtaaacttcaaccaacaagccgatcaaatcatggaatatataattcatggccctctgatatgtagccccagcactcttcaagccaaaagtcatcacaacccattcaaataaaccgattgcaccaggacacctgaaagtagtcttatgaatatcttcttctgccataaaaatttgattgtaacctgcattgccatccataaaactaataatcttatgtcctgaagcagcatcaaccaattgatcggcaatcggcattgggtacccatccttaggggtagccttatttaaatctcaaaaatcaatgcacaccctaagcttgccgttcttcttgatgaccggggctatattagaaatccactcagcatatcggcacggtctaatgaaactagcatcatataagcgagtaacctcagccttgatagcgtcatacatattggctttacacctccttggaggttgctgatgtggtttaaatcctggcttaataggcagccgatgttcaacaatcgatcggctgagtcctgacatctcataatattcccaagcaaagcaatctctatattcttttaatagctctatcaacttggttctgaattctgcagataaattcttactgataaatgttggccttggcctatcccctggaccaatatcaacttcttccaaatcatcggccgacctgtccttgcttgtcatcgagatcatctaccgtgtccttggtgtagaaatttgaaccctccacgacgccctcaaagtaataatttgggctcttcatcttcaattcgctgtatatcacaatcgaacactttcagaaaatctccatcccaaacttttccagacaggcaatcaataccatccatctcccaaagagctaaatcggcattggcaacattaactgacctgtcggctggcacgatctcaatcttgtcaccttgccattgaatcaagcactgttgcatagttgaaggaatgcaacaatttgtacgaatccaatcccttccaagcaataggctgtaggatcccttcctatctatgacaaaaaagttgtaggaacagttttgttgccgattgtcaactccacatttaaaactcccttggtctccgatggattaccaccaaaatccttgagaatcatgtttgtcttgatgagatcatctgtattcttgcccggtttcctaaatgtagcgtacgacatcaaattcacagtagccccaccatcgaccatcatcttggacatcggcttcccattgacaaacccattgacatataatggcttaaggtgccgattctctgtcccttctggcttctcaaagattgcttgctccggcgccaaatcaacctagcagagacctcttctacatcgtcgacataggcttgtttggcttcgaattctgcaggcagcataaagaccatgtttaccgatgtggatgcagtagccttgcccttgagtaatctcttcgccttgtcgacttcaacttcatcggctgttgtaactttacttttgacgcgccattctttcttggtctttttcagccaatggttgatctcctgttgcacctcctgaaaacctccctgttcctcatccgttgaacccttctcttctgatttttggtaaaaataccagaaggacaccattgtgattttctatcttcgtcttcatcttgatcacgatcatgatgcactggacccaacctctgatgaacatgcaccctttttgacccagctgattgcctctactgtaggatcggcttgtactccccgcattatcactgcatccggggcaatcttcaattgatggcagtctcatcccctcgttccagcagaacctgaaaaactcacaatcccaatgagggtcgaaaccatcgttatcttcataatacctctgctcctgcttctcatgtctcttcaaatatttgttaatgattttagttgacttgaactgtggattccgataattgtttccatcggctgctcttccagacgtgtgcaccatgttaatctgcttcttggagtcatcaaacttaattttgcccccctcaatagccaattggatctgctgtatgaaaaccttgcagtcattagtagcatgagagctagaattatgccacttgcaatattttcttttccccaactcctcagccgacggaatcacatgaccgacaggaagttaaatctgtttctcccgaagcagcaaatcgaaaatcttgtcagccttagtgatgtcaaaatcatatctttcttctttcctagaactcttcacccatggacatgctataatccttttgcttcgggcctactcggctgctgctacctcggagtcatcttcttcttcagagtcatacatataaggatacacatgattgaccttcttgaaattcttcttagcctccgcgaacctttgctcatgcagggtcaccttttgtgcaagatgggacaagctctcaaagtcttgggacgaaaacttctccttgatcggagctatcaaaccctgaaaagccagatcggctaactgagaatcggtcaaagccaaactgtagcacctattcctcatctctctgaatctttgaatgtaatcttgtacagtttcatcatgcctttgtctaattgctgtcaagtcagaaagcttcatctcatgaattccactgtaaaagtagctatgaaactgtttctccaaatcggcccaactattaacagaattataaggtagcgaagaaaaccacgtaaatgccgatccagacaaggacaaagggaacaatctaacccttaaagcatcatcagccgatgcctctctacattgagccaaaaatcggctgacatgcttataagttgaaacattgtcttgtcctgaaaattttgagaaatctgggaccttgtatcggttaggcagtggaatcctttcaaaccactcaggataaggatgccgatacaaatttccagtgtcttttggcttaagcccaaactgctccctcatcacatctgcaatcatgtctgcccaaggcttctgctggggtactccttgcatctgctgctgtatcggatcaaactgattgagctggggaacaaactggggctgaggtgatccccctatttgatattggatctgaggtgactgaggtggatactggagattgaaattaccaccaagataattctgaggaggctgttgcacaatatacatatgctgttcaggtgcaaactgggctccaacaggtagattttgctaagcagtaggtgttctctgtcctgttggtatctgctgcaccgtctgctgcctaatcggctgtacaacctgctgcttggtcggtgtcgactgtactggctcgatagtcggctgagttggcgcgaacatcgcagcaatctgctcctgagttagccgattggcgttctgccaacatgttgtggttgcttcccggtcaagacttgaggattaaccacctgcctttgtgctgagaatggtgcaactggtgctggagacgaaaccgctgccatcggctaaaccgatggtgcattggtagtatgttgctggttgcctgtcaccaaattcctgtatggtgggaagacgccacctggtagaaagactggccaagtgttttgatgctcagctatcgtgccatcaaccacagatttaatcatatttgttaaagtattgacaagcacccctgattggttgatcaaggcatgttgaacagcatagtcaacctggtcttggaaattgttgcacctcaaaggctcctcttgctcctcatcatcatcttcatcaacatcctcgactgtaccatcttgaagtccctcacctttattacctgagccatccgcagcactttttgtccccttggtgttatcaccttgggatgagcttgttccaggttcatcggcagcaaccaccttcaccttatacttctgaatgactgttccctggcggatttcattgaatgagttcatgaattgctcctgagcgctcttcatcacttgctcaaactgcttcttctgttctggtgataacttatctatatgggacaatgttcgcagtctcgacttcagatgatggttgagtagtccttggaggttttggatgcttggtccccggaggatttggaggcttggaccatggagggtttggagccttgcctgtcgatgccggtgattgtttttctgccatgagaaaaagttgtcgcaactcggtcccactgggcgtgccaaaagcgtgttgatgtgaaaaacacacactggcctggaagatctacttaacttcagtgcaggtccaaaatcttgcctttaggttcgtgaacgtgccaattgatttgatcctacaatcagcaagaaagaaagacaagaaaaaaaacggttaaatccataatcgataaccgatcgactagtcgccgatgacatatcatttatcttcaagccgatgtcatatttgaatcgatcggtagtcatgagtaaataagataagactaaatctactcgatcggctatagatattgacaacatataatccttacttcaatacatatttaaactaaatgattgggataaattggtcgccatgccgagatagtataaatcacttaagtcgaaatataaagtaaagtactgattatatagatgtttatagcatagctgatcaaatagatctagcatgtatcggctaatactccgataccactctatattaaaatatcaagacaaacagaatattgaaacaagaagcctaatataacttaatgcaataagatcttaatataaagggcatatctagcatattaattaagcatatgagatataaagtagctaaatcaagtaagatcggttgaaaccccgatactatctctctcgataatcataaaacaagccagatatcacaattataagtaaaactcaacagattgaactcaactgatgcagcattaagcataaagataatcgtgggatctaaacaagatgatgaaaacctctaagtgatggtggatacacgatataatctaacttaataaccaaacataacactatcggtcacttcctgacaataagaactacccgataacaagttatataacgcaactaacaaagactgtaacgtgtatatgataactcgacgaattacataaacatgattagagtgtcataaagatggaagcactaatcctgagaacgcaagccgccatgataagtttacatctagttgaagatcgaatcgatgcagctcaatccgaaagtaagaactcgtcgaaatagaacgaaagtaaacagggtggcgatgcgccgaaattgttattgaacgtgtgttaattgattacatgggttcgggtcctatttatacccgagattacaaaatatgtccttgccggacacgactcttatatctaacaaattctaagataccataactctttgcggcagacttttgcccaaacatatctctaaggaaattataaaaatatcctaattaatagatacaattgcctttccgagagctttatctccatcgtggcaatccttgtgaagcatgttgatagattctagaaacagccccaaagccatcgccactggaatcggctgtatcaaccccatcggctgtatcggctgtccttgatccgatcatcttcagccgattcagactgaaaaatcgattccccgctgctacctcatcattttccgcttgatcttcctttccaaggctttaattgaatggatttaatctccatctatccatcgccatttttatccgagttttgcggtccgattttgataaaaaaaaaggaaagaggaaatcaagtagataaaaaaccctaaaccaattttggaagatcgagaaagattcgactagatttaatggggaggatcagctcgacatcgtacgaggaagggactatcttccgaaggttgaagacgacaatgggttgtgcgagttggacctacaactccacgtttgggctggcccgaagagtgaaaggccgagcgtagtgaggtagcgaaccgggatcgggctggaaaggaatgaatgaatgagctttcggtccaaaaccaaacgagtataatgtatagctatcaaaaacgtttttacccgttgcaacgcacggacattttcctagtctgtactattataaaaattgaagatgtttccgcggtccatcatccgtgtttgagtcggttataaaaattaaagatatttctgcggttcgtcatctatgtttgagttggttttaattttatgttttggttttaatctatatctcttttctatctctatctcaactattataaaaattgaagatgtttttgtcggtattttgtacgtcatccgtgtatgagtcggtttttaagtttatttgcttttgaaaatacatatccgtatttgagtcggtttttaagatcgctcacttttggtaatacagaaggaatcatataagaaatctgtttaaaaaaactcacatgctaacttgagacgatctgactcttaactgcagctcatgattttctatatatatatccaagcgaactcccacagtgaatttcatcttaactaaaccatataacaataataagattaaaatagacttcacctgttgcaacgcacgggcattttttctagtaagaataaaatataaaaattgaagatatttttgccggtactttggtacgtcatccgtgcatgagttggttttcaagtttgttctttttggaaatacagttccgtatttaagtcggtttttaagttcgttcgcttttggaaatataaaaagaatcgtataacaaacctcttttaaaaaaactcgcatgctaacttgaaatgaccggactcctaattgcagatcatgattttctgagaaaaatatagagtcggtttttaagttcgtttagtttttaaaatatagaaggaatcgcataagaaatctctttaaaaaaaacttgcatgctaccttgaaacgatcagagtcctaattgcagcgcatgattttcttaaaaaaatatatatccaaacgagttcttacaatagatttcaccttaactaaaatgtataacaataataagattaaaataactttcatctgttgcaacgcacggacttttttttttttggttagaataaaatgtatgggtcagccgggccgtgtctcgtgcttgggtcgtgtcgtgccggcccatgggttgtggtagccgtgccggccagcccagtcctagagtacggccgtgccccggccgggtcttggtccggcccatttgacagctatactctaaccctaagtaggtcgccttggaggcgctccccctgcagggccttctcccacgcggccgcgccatcacgtccgccgctccctgtcttccgtcccctccaacacaccatggcgccgccgcagcagctggtgctcgcggcctcttccaccgacgccggcgttgccgcgtgggacctccgcacgggcgccgaggccatccgccaccgcacctgcgcctcccgcccccgcgctctcaccgtcgtcgccggccgcttcctcgccgcctcccaggcccccgccggcaactcagcacccatccactactaccactgggacaaggtaaatcactcgaccttaacccacggtcctttaaactcacaaaaccctatctcggaggcggagcttcatgtcctttgttggtcccctgcagccccaggtggccgtcaagagcttcccggttgagccgatacgcgcgctcatcgctgatccggaggggagctacctcatcggcggtgggatctctggcgacatattcttttgggaggtcagagcatttgctattgatttcttcttctatggtaaaacactcgctagttttggggaacaaacagttgtcattgctgctttttgtgcactttgtgtactgtttcggaaggttatggtcgtgtttagttgttttggcaattttttttgacgtatacggacacacatttgaagtattaaacgtagactaataacaaaacaaattacatattctccctgtaaattgcgagatgaatctattaagtctaattaatctgtcattagcaaatgtttactgtagcaccacattgtcaaatcatggcgtaattatgctcaaaagattcatctcgtaatttacctgcaaactgtgtaattggtttttttcgtacacatttaatgctctatgcatgtgttcaaacatttgatgtgacggaaaagttggaagtttgaagggaactaaccacagcctatacacccatggttgtttaggtatattgagtaattttatttaatcatcagtttagttttcataaaaaaataacctttattgtacaataattcagtcttgtcgtactgtggtggttatgttggagatgcctgttctgtttgggcatttgaattttggcattcagtgagatgcaactatgctattttctgaagaacatacatatttgggaaactcgtgtagttcatacagggtgtgtttggttgcccggacacatgagagatgcagtgaatatcttgtttggttaggtgtgctcgcgatcgaggatgagcagatgcaattcggccccaagagccaggcctaagagatgcaggttttcacctttcgcttctcagccaggtctggctcatgtggccgcggatgcaagcgagcacgtgcgggtgcagacagtgcaagcagggcgcatccctcaccccatctcccatttgcatcgacttgcctcacctcccaagtcgcatcatcgttgccctcctcttctcgtcgtcatctagcccatccgctccttttctcgtttggattcggtgtctacgaccgtgcacacgccgaatacggcagccccaactgctcaggtgccagatctggccaatgcggcggctcgagcagcaaggcatgggctcaatgacgagggtgacgatggacctccaacttccaacatgcctctgctgctgtcctctgtcaccaagttcgtctcatcgtcgctgagcttttctccaccctcaacaagctcatcttctccccttctacctggagccggaggccactagcacttgtctgtcagatccggtgttgggctgctgatttgatggcagtgacacagcagccgtcgaatccaactgaggcagcgagctagcgactgtcgatacaaaccgagcagccggcgtttccactagaggccaccaagatgttgtggccactttcccattccctttccttttttgtttattcctttattcgttttgttgttttcataggctcatacagataaatagattcatatatgtatacatacagtaaaataatgaagtaaagatgctacagtatatagtagtaatttgtttcaagcaaaaataggatgatttttttggcatacaaattttattgcaactttgtgtttttaatctttttaaagaaagcagcctcaacatgcaagcaaaggggtaactgcactcaaaattcataggcaaaatttgctacaggacactcaaagtttgtgcaatttgctgtgagatatccaaagaacgtgtatcttcttgtcgacagactgcaaaaatgtggtaattagctgttcaacactcgagacattattttattatatttgataaaaacgcggagagagatttaaaaaggacaagtttgcccttgcctgctctttctccaccacggcgcgcgagcgcttcttgggccggcgaggcggcgccatgccacggatggcgatgaagtccacgaccatctcctccctggtgagcgcaacggagaagctcctgttcctcgcgatcaccggggacaacgcatgcgggtgcagcgtctgtcctcctcccgccgcagccgccttccccccccccccccccccggcgcagcttcgacgcattgggcgccacggtggcggagcggcgggtgcggaggttccatggccgcgacggtttgtcctcttcctcctgatgaggcacgccgcgcacagtgcggcgccatcgacgccatgcttctctgctgcgcgggtgggcacgtacgcgcatgcctctgctcgctctgccatgttgcgctctctgcccgcaccctcactgtcgctgccgtggacgcccacgccgtgtagcagcctgatgtcgagaaccggaaggtggactagcgggaggcggcgctagaagcggagatctcctgtccctgctccttttccttctccggcaacagggtgtgtggctgcttcaggggcgccgccccttcccccgcccaccgtctacctcctctgctgcgctcacccaccgccactccaccctttgccgctggcggcctcccaggctcgttgaagaagagaatagaagagaggagaagaaagaaaagagagctgaagcaggaagaagaacaatgtccaggggcattttggtactttctacgttctttctctcgacgttttcactggaaataataaaataatgcctcgggtgtccagtagctaattaccatatttttgcagtgtccataggaagatatacgttctttgagtgtctcacagtaaaggccacaaactttgagtgtcctatagcataatttgccaaattcatacaaccaaccaaacaaaatccctagcatacatgcattaatattcaactaaccaaacaacatcgcacacgatccagacataactgataatcaaacaaaccctgttgcatcaacttgcatgtggctagccaggctaaactccaccaggatggggcatacgggtcaggctaagggcatacaagcaaccaaacacacccatatagtgcatttacgcccggggcaatttttggtgttgctagtaaattgacctagacttataagcttatgacatgttatggatcttatgtttgcttcgctacttttccccctaaaatatgccttctgtttctgtttcaacttttctgtcaggcagcttcttagagttcagattttgcctaatctatttgtgctttcatacctttcttgaaattttgcacttttttcacctggtgtgcaagtacaatcatctgtgttgttttcttgtgttgaaatgttgcctctttatatttggtatctgtcttcacaggacacaaagtgtgctaaattctatctggtcctcttttagtgaattatattcctatttgtttgattttggcattttgcatagaaatttaacatttccactccatgttcctaattcatccagtaactctgtctttgataataaaattcgttctttcttacaccccattctctatggtggttgtgtgtgtaggtggctagtggggagttgcttgtccagtggcatgcacattatcgtgctgttaggtgccttgcactctatgactttttgcttatctcggggtctgaagacggtagcatcaaagtttgggatctcctcacgtatgtgattatggtaatactgaccacactgattgcttgtttggtttacttaatttgtgttgtttactgcaggatgcttgatgagcaatcaagattggaggcaaagacacaacacatatacagctttaatcagcacgcacttcctgtaaccgatgttgcttgctgtcatggagcaattgctgtatcatcttcagaggatcacacctgtaaagtatgcaatctacttgtactttgtctttgagctgtatattttgtagaattgtacttgactatatggtctagtcatttttattagcatttaactttttgttccccctctttcctagatttggagtctatccgagggtagaatgctaagaagcatttcatttccttctattactgattcagtggcgttagacccaaggagtcatattttctacgctggtggtcgagatggaaagatatatgttactgctatgggaattgatgtcacctctcctagtagtgatgattcaactattaatggggctttggatgaccataggtttgcctactccttgctttcattagcacctcttatttatcctgtgatgtaaacagcttcaatatacaagttagagtttgatatcttgtagtagtagagtggttataaacctatcttacctgttcatgctttaactttggttgtatccatcctagctcgaccagtttgtttttaatgaaaacattttttttttcatattgctgtggaaagtgattaattaatacgcctgaaaatgatttttgttgatgcaaattttcttgtctatttagttaatagctttagaaaacaaatgcatcttggagggcgcactgtttgtctaacatactaaacaactgggggtacagaaatggcagtaactactaactagagaagaaaaggtgatacaattcgtggtgtgtgaactcaaacttgtaaagaaaagcagttaggatcacctgatcgtggagagcgtgtcctgtttgaaccattcttctgccagtgggttgtatttcatctttgattgcacttcggctgtgtttagttggtggcaaagtttggattttggttgaaattggagatgatgtgactgaaaagttgtgtgtgtatgacaggttgatgtgatggaaaaggactgaagtttggatccaaagtttggatctaaacacagccttcttgtttgtatctgaccttattctgtagtatcatttttggtttaacaactactgtggtattatttttgtctaaccttctttaatgtgtgttctattttattgatccagcaaggcagtaaccagcttagcatcgagtactgatggacttatattgatctctggatctgaggatggtaatgttcgagtttgggatacaagaactcagcaagtaatccgaaaattcaaacattcccaaggttcatagattgttcacacacacccttctttaaagtagtgcaagagttttaacactcctttatctgcatcgctgttgttacttaggttacttgatagttgtcacctctcaaaagcaggaacatttatctaggagaaacagaagaagcttatattgaatgctgtcacctccaatagattgataggaatctcattggctggttttcaagcactcgctgtagatttaattctattcattgctcataccatgggaagaaagttattaatgcatatgtatgcgcatgttgttcctgcacatactggttttcttgaatattttagctagactgaaacatattcagtactcccttcgtcccaatttaagcttttcttgaatattttagctagactgaaacatattcagtactccctttgtcccaatttatgcgcaacctagtacagatgtaacatatcctaggactacgaatctggacatgcagctgtccagattcgtagtcttaggatatgtcacgtttgtactaggatgcacttgtattgggacggaggaagtgcatccaatgttaagtacgatattcaatgtcatacttataaggttaaacaattgtttctttaggaactcttgcacataatggaggataaatagaactctttaggaaaccttgtttataattcagttgtagtttgcttcctgatattctaactcacttcagagtcccccttcctctttctgaaggagaacctgagtgaatcttaaaacagtgcttatcaataaataacgggaaatatgtactctgtattatgaaattaatttggctcaaggtccgagtgagtagtgacaaaccaaaatctcaagcccacagtttaatacaagaccaaatggatgaccaaatcaaaatgttagtttttattcagatgctattcatgatttgttaagttcatgttgacaaacctgttgatatatgcccttcctacacacaaaggctcatgagtgaaagtatagaaacccatggaccatggaatacatacagtggcatgatgggtacgagtcttctctttgtcattatgacatgtctgcccttgtgagtatggtgcagcagctggctaccgtaaccaatagtggatgttgtcaatctcgctaccccacacccacccacctcccatctccaaaagaaaaacaatagtaagtaatgagagagcagggatacagtgggtttattccatgcatagtctgaaacctgtctggagcagcaaagcataataccaccattaaattattggattgaacagtgtttctccaattattggatggacacaaatggtgttcacaatgcaacttgtgctacttcactgatctgcacccttgtttttaaaggtggagtgatgaagtggatgctctgttgatacttgtctttaaagatgttcactgcatggttaaaaattgttttgtaattgtcatagtttggaaatatgaaatcttaactacactgaaagaaaaatagagttagccttttgtacttttttttttgtaatttcctattgacgttacattcttttgagcttttcataacttgtctactaggtccagtgacgaatgttctcttagtaacgcctaaacgagtaaatcttccaccactacaatcactacggaaagtttgctcagcaaatggaggatctgaatcacgggctgtaattgtgccccaacctgaaaatgatgtccaaatttttggaaacttcagttccgactttctggagcgctgcctggatgcacttcaggtcagctgattttgtattgctgttgacacaggggcccaaatttcttttacctttcagttctatctgaactcttagtgtccattctgctttgatctagcagcctggcagttcgtccagattgtttgaatctggggccagtgctctgtatggtgcaccaaaacaacagggtgtagaatggaggagtaaatacttggagttacaggacctctttgtgcgtgaggttcttgatcagatgccgtctccaaagaatacatgatatgcaactgattattatggtcattgctgtcaattaggtgagaaatgttatatttttatctgctgttttactctaggtagcagttcagatttttttttaaaaaaaatgcaccttgagctcaaaagttatcagtaagattaacttgtcaaatagtttatttttcacccaagttcagtacttgtggagttctagttcaacgtaagcaaaacatcgtacctctttccatgtattgtactttctacgtgtgttctcatgctcatcttttggcacggaaactcatgtttttatgtacattatgcaggagattgtcatcagttttagccagcacatgagttggtttctaaccgactagaaaaccttggaagctctaattcatcagcgaagtgtaacatcaatttttgcaatttatgagtggaggggtgaacagggggctttgcatcccccatgagttcattgaaactattgtagctgagcaaattttatactaattagcacttccggcctcagctcctcaaaagtgtactttgtgcttctctggttccaccactaaatttatgtgtactttgtgtctttgtattgagccttatggtaggtaacatgttacagaaaaacatctgaaatacaaagtaacttgaaaaggagcgagacgcaagtgggttatggagtaatatctttgtatcttgctacagagtaattatattcgatggaaactactttgtgtggatcatactgtctggtctgcacaacataacgcccaaaggctggatgccatgccacccctccctcaggaacaacatagggagctaatctgaattactttggagaaaagtttaatctcccttaactactcattatatgcttatgatggtagttaattcctgcatcgtcattttgagaaaattttccttgagcatctttgaggaaattttcctcgagcggttcaagagaactgcattggaccggtggtctcttttggcaggaatagtatgaggtattttcataatctttagaacgatcacccttaaattagaaatggaattttaaagggtgaatttcctcttcctccggttctcaaggttagggtgagcattcaatggtcgaatctttggatgtagaggatatatgctctgatttggcgtttgatgctcctcatgtgtatactcaatttcctagacagtttcgcaatgaacgaaagaggtgttctcctgggtacgattcaagagttctcttccttccgatgtcgttttgtgtgcgaacgaacctccgacggaactatcgagatacatggcaaactccctgtctaaatctaagcagtgttgtaacaacacatgatcggataaaggtaagtctaggctggcttgagttaacaaggagaaccaagcccaagctgtagctgagaacatccatatgcagagagactacacgggtttacgggaaaaaatcaagacaaaacttgctttttaattactctcgttcactattcaattttctgacgtatgggtgtaccattgcttcgcaaagggaaaacatttccacttgaaggtgtcttgcgccatgtccgcgattgtcaagcatgaacacaattgctcaaactcacgcagatgatggtaggagttttcgctttcacgccttaagaaggattgttcccgaaccatagctatataaacgtaaaaactatttcgagaggcctctcgatctggcgctatcgtgcgacgccgggaaaaccgtccatcccgcgtgagttgacgtggcctccatccgcgcgtcctcgtcccagccaacccaccacgagtcatcatcctcatccattcgcgtccgagaaaaagagagagagaatgagagagacagacgtggcagaggtttgctcccatcacactgaaaatatatataataatagtctattaagtaaataggaaccacctatacatcaaataaatttttctcttcaactactcgttcgatctatgatccgattataccgttgtattcataacaattaaatctttataacaagatctcacatgattatattttgatgaaaaaaatataaattactttttataatatatctaaattacttttagatttcactaaattacttcttagacatataaaagtaaatttacttactttgaaagtaatttacatatattataaaagtaacttaatataaaacggaagtaacttggtcatggcattagaagtaaattcgttgtaaggataaaattatgactctatctagaaattaaatttaatcagtacagatcagcacatgtaagtttaacaatttttaaaagtaacttcaatgttaattggaagtaacttttgcatggttcggaagtaactctctataaatctgtttaatcgccgattgttttttttccttttatttttgtttttcatgtagaatgagaaaagaagataaaccctttgatggattataaataacattgatggaataactaatgagaattaatcatgtataagatgtaatagttacttcctgataacatggaagttactttctaacatgtaataaatatgtaataaataattttaaattaataaaatgtttgaatatattcaatatggatctcattttgtcacatattttgagtggagtacaatgatgcaaatagatcttaaaaacaatatgtaatttaaaatatataagttattaaagagattaagaaaagatacatattgttgcctttttcaagttcaaagtagacaccggatggagaggctactactagctgtgtagtcacgtcctatgaaaaaaaagcatgcattaaagttactttctttttgttataagttacttctataatatatataaattacttttaggctttattaaatttacttttatatgtctaagaagtgatacggcctggccaaggccattcacatgtaatgtgattgttgcacatcaatgcaaggttaacgctatgcttaactacaaatcttattgttttcatcgagcaaggctgctacttggcttgtatgattgtaggttaaagcatatcgttgtgcttaaagatagagacttgactcggattgccaccactacaccatggataagttcaccaaggaggataaaatggagcagcaagatcggaccagtgcaaaagcaagatcagctcagaacggaccagtccagtgcaaaacgggccagtgaaataaacactcataactttttattctcaaaagttatgaaggtgaatgagcatattatagaaagcttattgagtctagtttcacacccaacaaaccgttcgtcatttgaatttcccactaaagagttatggccagattagtggacactgctctgaaggccaacagtctgcaagacgttcaacttcccatgcaaaactgtatcaatcgacaatatttcgtagtgcattatgcacatggtgtgaaaacttatcaagttacctttccaatgcaattgaccgcatgtcatttggactttccaataaggagtaatgggtaaaacatggaagactgctcagaagccaaatagatctcgggaattcacttattgtgacttttgagctaacctatgtccagtaaactcccaagacttttcattcccatctaggggggttgttcctagtataaatatcccttatgttttatcatttgggagctttttgataatcgaaatataaacccctttgttcagctgtgtgctaacaaacaccgagagaccgagatctctacccctttgctcttgtgatttcctcgtgggattacataggcggctgcttcatcggcacccaatccatgctcctgatacttcgtgtgcaggctgcgtaggatggttctttgagagtgtgattgggcgaatccttggttcaggctgccgtatagagacggtggttggctccttgtgcgtgtcgtcaggttgcactagttatccggctactcgcagctagttatcttgtctgattttcagctagttatcttgttcaagatcctacgtcgtgaagatcgggacaacatctgtatcaagaagtaacttagtgaaatctaaaagtaatttagatatcttataaaattaatttacaatttttcatcataatataatcatgtgagatcttgttataaagatttaattgttacaaacacaacgatgtaatcagatcatagatcggatgagtagtttaagagaaaattttatttgaagtataggtggataggatctctcatagatgaagtggtagctagtttagacaaaccagctaccactagttgtgtagtcacgtccatatataaaaccaggacatagtttatagccagatgaacggattggttttgaagaataaggtggctcacagaactcgccctttggagcagaagggttttgaatagataggtgcaccatgatagataagaagggaaatgaataaaagaaaagaaaagaaaagatacgatgattaaccaggttcggaaatgatacaacaaccgttccccggcaatggtgccagaaatgtttgttggtaattgttacaatcactgattaatccgcaagcgcatggataccgttgtagtacttcaacttagattattccaaggatatcgaattatatgtacatctaggaacatgattctattcaaggataccaactaactaattatatgcttaggctagagaggattcgtatgctttaattaattagactaaagttaaagataaaaccctatcaattgctttgggcaccggctctcacctggtctgtagctctatgatgtatctaaacatggtgggatacaaaggacggacaaaactatcatcactgctgcctacctcacttttcatggagcacacaacaaacgaagataaccgctaacctagacaccatgcctaaggtattgattacaactctagccttacacaggaatttccttcttcatccagagtcctagtactaaagtgctcaatataataaatactaagcgacaaacccacaacgatgggaatatatctcacttaattaagtaaattaaatactgaaaggaaatctcgaatacttactttatgaaagaagcatcagccgacgtacgagaaagtggagagtgctgatagctccggcactcctctggaccttccccttactctctacctattttctccacactactaaaatgatgcttaaaatatgaaagtgagttgtaccccactttgttgtgtaaattgaaagtgagagtttctcctccttttatagattcatatggcagttggaatgacgcttatggaggttggttaacccataaccatcattgagaggtgatccagagcctatacatgtaaagtggacatgagcgggtgttgatgtgaaaacacggcggcctgggagatctgcttaactctagtgcaggtccaaggctagcctcgagtgtgtcaagggcgtgccagctgatttgatcctgcaatcagcaagaaacgagaaaagtaaaagggtggcgatgcaccgaagttgtattggagttgctcccgtattacaatgctatggggatcatatttataccccgagtacaaacttacttcattatggacacgactcaaacctttctaaacgtaagatacaaacaagaccatatacgacggtctcttgccaaatctctaacaaaccaactcaatatcctaatcaatagatataattgccttaatcgagctctatctcttattggcaatgacggttatcccaatctaggcccatgtcgtgcctaagtcatattatatcggcagcataggccatcggctgcatcggccatcagcttcatcaagcatcgacccacttaatactctgtttcagccgatatggtatccagccgatgtgcagtccgactctaagtttggttcgattcaacaccaaatccgtttcgatatccctccttttccgaatgtgatgccaaattctgttgttaacacatgccccccaattccgctatattatataatgcggcggaattcgctctggtcgaacccgcgaaactctagggttttatattttgactgttgatcttataagcaaaggcccactgtttcaaatccctctttctctagttaagtctttcacaacttcctctattgcacaatctctattatcttcagcgattcctccggtgacccaaactcccggtgacaaacccctttgcttcattagctcaaacttctaacaatggcaaccacttccgacatccccgaggtaaattccttttgtcatcaatatctttcgtgtaaagctctttcttggatcttagggtttcttgcccttttggttttttttagcacctcagatgccagatcttgattcctgtccttcatgccgaaactcgttggtcctatgggtgatccaaatcccacaatatttatcagcgccgagacgaacaaaatcccattcaaagaatcaaaaccagagttcgaccattggccaaatgtttttaggtcctggccctcaaagcttgacgaatgggaagattagtttaaaaggatatcaactgccaaacgatcatcttggaaaaggatggggatagaacagtgtcttcagctcttcctagccaatatgccgaagaacgaatctttattatcggccactacatatttctggtctaacaccatcaatgccatcatcttcggacatgggccgatgacacccacccttttggatattaaaatgttaacgggcttagacatcacctcattggctaatcccatcagcttgaaaaacaagagcgaatacaaaattaaaaccaaggctggaggtggttggtcaggatatatcaaaagatgtagagccattggaccaattacagatgaggaacatatctctttccttaacttatggttggagagattcattttctgtggcacaacttgtggccctacagccaattttcttcatctggctcaagctattcatgaggagaagtcaatccctctaggtaaattccttctcaaggccgcttatcagattttgggtcaagcaacagtccgtttgctaatgggttccccagtgaaacatggaggtccttggtggttcatccaattgtggttaaatctttatgccgtcaacttaatcaaccatcggaccctccaagagcttaaatttccttaattcaaagaaggtaaagacgaaagaccttgcatatcttttggtgaagccgcttatacctttgctggctctaacttattggctgaattctttgaattctggttcaagcatttttatgatggtttcttaaccgacacagtaatgtggtacatctatgaggactttgaagactttgaatgaccaaaggacttgagaatggacgacttgaacaatgaattttatcctggacgacttgaacaatgaattttatcctgagaacaaaaagatcttcatatcggctatttcaccatgcatccttcctactggagtatcacaaggccaatccactcaaaactcatatgagttttaccacccaatggtagcagcaagacagttctgactaggccaactccctttgaacctttatttctcaaccaaaatccggctagagacacaatatcatcggcggaacttatggacaaggtcttgagtattgaaggtccacctttaggcccaatcgattcaattgtcccaacttcaataatatagcctgatttatgaatacttgtgggcagaatggaaaaaacatatcttctatcagccaactgctttttatctcacaatcatcaatacttccatcggtcctcaggtaagcctgaaacccatcttcctcttcttctactcaagtattgaatctgatgattggttatataatttcaacctatctttaccttccaggatatcgatcagcctccaccaaatgtcagcaaaagcggtcagctgattgtatatgcagctgtcaaaacccttctggataatgagttgattctggctccataaactattggtttaaattctccattggctgattctttacttccataccaggcagtgatagaaactatgccggttgttccaaaatctaaacaaatcacaaagaaagtgacctaagtatccccttcaaagaaaaggaaaaccagagctgatgacaagccatcggatgaggaagagacaaccgatgttaatcctacagttttgccttgatcggttgacgtagcaccccgtcatcggcgggtagcttgaaaagtcatggtaccttattcctcctttaaatatctccgattcctcatttttccttttaccaatgtctaggatgaagacgatgggacaaaatcttcaatccgagccaaattactcatttcagatgatttaaaagcaaatttgctagatttggtcaatcggctcaatgtatctcttgatgcattagttgtagattgtgagccagtttggtctaaattcaatgctatccaagctcttatttctaaagacctagctgatgttatctctccagcagcacatcttgatcaatataacttaaaactccaacgggcacaacaaaggttgatagatctgcaggaaaggcaatccttggaagcgaccgtcacctccagccgacagcagattttggattacaaaagcaagctggacaaattaatcgttggtccagaatcttctcaaaaaaagcttgacaagctcaaacaaaaggaatccgaactcctagcacaactggagcagattcggcaagagatggcatcggagcaacaatcaaatatcattgaatttaaaagctatcgaagagcaaagataaaaataaaggcatcgatcaaatatcttgcaggcctgacaagagcaatgaagccgatcccagggaccgatgccgaagaccgcagaactattgaataaatcaacaaccttcgtcttcgtgctattgaagctatccacaacttcctgggaatgtaactggcttgaaaaagtccattaaactctgaatatttacttgcagtttgtaatatatctgtgtatcggccatctaaccaaaaaaatccttttgcttctcaatattgaaaaagttttttaaacccacatattttctgtctgatatctggatatatgcccccaattttgtaatatgaggagttatgttacaaaattgctctaaggacgataattcatatcggccatcaatagacgatgtatcaaacatcggccacatcatacatcagctaaacaaccgattattaattaatccaaacacttggataatatttcttcagatattttccattaagtgcttttccataaaactctgcatcaaaaccttcaagcagataggcattcttaggcacatatcgatggatacgaaaaggaccttcccaattaggtgaccatttgttgaaattattatcccttgttcctatcggcaattattatttgtgctctgagaattccactaaaacttgattacacattttaggcctcgagaaaaaatatatataaaaaattctccaagcctcctttgatttttaggttgtatatttttaaggttggagggttgacacccatttttactttttctaggaataatttaaatgatgctttttacggtgaattcgggatgtgacaaggagcaagaaggaatataaaaaggcgacaatctttagtccctaaagatctaaataatctttagtcctggttggtattaccaacctaaataataggtatctttagttctagttggtattacaaactgggactaaagatcccctgccccctgacaggccttgtcaggggatggaccaggaataaagatgatcttcacatagtcccattggagttttttagtcccagttcttattggaaccagggtaatgtggttttcggtcgacccagcaaagattggttctccagtagtgcttgctttaacccttccagagttgattcgaagttctcgccaaaaccaggagttcaatcatataagccctcaagtctagactaattagaaggtttgagcctatagcaaaatagtagagtcggttcattgtatagcttctgctgcaatagttagccacaattatgtaaatgctcttgtattttatgcaataaaatctcttttggagcccttgtttaaatgtatggaatggtgatccagatattattgaacatgtattaatctattcatctagggcttgatacagacatgcagacaagttagttaccgaaagctaattttgggacccgacatttgtatataactaagatgtaacttttagagaaaaccgtcttacatcagcggtaacacactcttagcattaacgagggtacagccgtacagggttcatcaatgaaaaggaaaaagatgtgcatgcaaattaaagaccgtgtctacccctgtgtctgccgtgccatcgcgcgcgctgagcccgctgctcttcgcccgcgaacgtcaaagaaacgaaagcatgcacgaatcatgaggttaatctaacggctgaaaaattgacaaatttgaagcgaaaattaacaatctatcatttatagcaaaaccgtaaaccgaattaatcgtgcgtgcatcttcggtgcaattgcaaagaatcatatgcgcataacacaaatcgtgacaaactaaactgctttacatgactagtgcacatggaaaagttgcacacgtgcacgctacaccaaatgaaaggcttggccaacaacaatatataattaattagcatcactgcacaagtaaagcaagccttgtagctagctaggcgattgcacgtacgttaattggtggactggccgccatatccgatccctttgcgcgtggtcgggaagacgaggaagacggtggtggacaggaagccggcgccgaggggaaggttggtgagcagctgcttcacgttgtcgccggcctcggggaagtagcagctctgcacggcggtgctgctgaacgccacggtcatgaagaccaacgccgtgaacaccgcgtgcacgtagtccacccaccgtatcctcagcctgcggaggtccttgaacacctccctccgccgccgctggtcgtcgtcgtcgccgtcgctgctgctgccagcgtcgtagttgaacacgaggaaacccttggccgtcgccacgccgtagtagagcttcccgtctccaccgacgaagctgtcggtgaaggagaagaagatgcaggagaggacgcacaggtagaggagcgccgcggtgaggtaccggttggacgtgaggcacgcgccgcggttggtgaacgacggtgacagcgactggaacgccagcaccgtgcccgtcggcaggagcttcgcgaggttcgctacactggacagcgtcttgtccatggccgtcgtcggcggcggtggtggagaggaggaggacccggccttcaccggccgctgcggggtgggggtggtgctgccgccgccgccacggaaggggctcgacgtgccggggctatcccggatcccatcgctcgtggcagtggcggtggcggcgacggtggcctgctgtccaatcggtatctggacatcgccgcccgtcgtcgtcgtagctgccgtggccatcgttgcggttgtacgtgagtttatttgcgagctaaggataaacactagtactaccgtactactactaataatgatgctttacttcagaaaaaaaacagcgtaatactttctagttataaatatttgacgcttatgaaaagattaagtcaaaattaaaaaatttcgacaatcaattttatttgcaacaactttatgacatattatgataatactttcgagataaatcatataactatttttttcagaagaactaaatatttgtgattattgatggttggaacttcccaagtttgaccaaatttcctatcctaagcaccagatatttatttatgattgtaaggagcatgtatataatagtaattgtcaaagttatatattctgagtatatagaataaattgagcatataccatttctcctcactgttgttccttctttcttttggtcaaccccgagtttctttgatttgtattctcaggattttttttaatgcaatggcaggattagcttgcttccaagaaaacgtttatgccgtaatctggatcatatgactaactagagtataacacacaccgcattccttcgttttttttaaaaaaaagtcaattaatttgcgttgatgtcctgtacacttctttgattgatcaatttttctaggagatcgatcaattcgttatacgtcagcgttagacctggccaaatgggccgtgccaagccgggccggcccgagcacggcagtactgtagccggcccatgcccggcacggcacgccagcctgtgggccgtgccggcacggcccgttatcccgtgccgtgtttgggccgatgcctcagcccgtgggctggcacggcacggcacgtttactgtagcatgccggcacggcacggcccaggcatggcacggcccaccggcccatttatttttcctacgattttctaatttttcccatatatttctcatattttttattttttttccacattttatcctatttgtaccatatattttatgatatatttcctaaattttcctcacatttatcctatatttatcattttttcctttatattatgttttttctgccttttttctttttttcccctcaaatttcaatttttatgggccacatgtactagtgggccggctaccagcccacgtgccactacagtagccgtgccggcccggcacggcccagcaccttcttgggccgtgcttgggccgtggccttggcacgtgggccggcacggcacggcccgctacaggagccgtgcctaacgggctgtgccctagtgggccgtgccgtcggcatgccgtgccgtgctgggccgggccgcccgtttggcctgctatagtcagcgttcggagagcgacgtgctatgacgacgatgaacagcgcctgcagaggggacacgacaagagttaattaaggccttagtttccaacttttccttcaaaccttcaactttttcatcacatcaaaaactttcttactcacaccaactttcaacttttttctttaaactttcaatttcagttaaactttcaatttcggtgtgaaactaaacacagcctaagaaagaatagaggacgttgaccaattaatagccggccatgaattgattgaattctgagcacaaattactctatcattcccacaatatagcaatatagcaacgtaggactaccaagattggagactataccgagtgtgagctgaaaaattacggggtgtttatctagcaccaggtaacttgcggggtgtttaggtggaacactacgtaactaatgttgttacggagcgtacctattgaacacccgggaacaactaaagattaggacgtgactccccgtcgggcgcctgatgggagccgattaaaatcgggccctgatgtcagcgcccgatttacgtgtaaaaactattttaaactgatttttctcttaaattacttatccaaagcttgatccgattgcaccattaaatcgttgcaattaaatctttaaagcaagaccacacatggatatattccgacgaaattatttttagcttattattgaattatttttaaatgttgcacgatgttccaccaggtatatcggaattgtttcactaagtagattgaaaatgtttcactcgtttaaatcgagtgttctttcaccttatataaaaacaatgttttagcaaatagtgaaagattgtttcagttcactgcaacatttgatccatacataatgaaacatagtgaaagaagtgctttaaaaagcaccttttttcctttatttccaaattattacaaatatcaattaattgagtgtttggattcttggagttatcgtgtcattagtctagggtttacccttttaaccataggtattctttgtggagcagtatgggctaatgaggcgtggggatcctactggaattgggatcctatagaaacttgggcatttattacttggaccatatttgcaatttatttacatagtagaacaaatccaaattggaagggtacgaagtcagcatttgtagcttccataggatttcttataatttggatctgttattttggtatcaatctattaggaataggtttacatagttatggttcatttacattacccatctaaatgattacataacataaaaccttaatgaaatggaaaaaacttccatttttgtgtttgatttgagaaccccttgaacgccttctcaaagggttctcaaaaattcgagatagatctaattagactcttttacttttttctgaattttttagtatttccactatggaatatagagcggactagtagaagaaaaaaaaatcctatttaggataataattggataacagagcctctaccctgtcaacggatagcgagagaacaaaatctggataaataccgattcctattactggtaaaaagatacagattaaaagaaagagttctcgcgggccggaatcctcaaaattttcgtttggaacatgaaatagcttgtatccatagaacatctgtcgtaacatagataataaataaataggagttaatatcattccaattgccattacaaaagtaattagcatttttggcattaacagaaattttggactagtaattagtccaaaaaatactactaattccgcaacaaaaccactcattcctggtaaggcaagagaagccattgaaaagctactaaacatggtaaaaatttttggcattgggatagttacccctcccagttcttcgagataaacaaggcgcattctatcacaagccgttcccgctaagaaaaaaagtgtagccccaataaatccatgggataatatttgtaaaatagctccattgagtccaatgttggttatggaaccaattcctataataatgaaacccatgtgagagacggaggagtaggctattctttttttgaaattgcgttggccaagagaagttgaagctgcatagattatttgcatcgctcctattattactaaccaaggggaaaatagataatgagcatgaggtaacaattccatattgatccgaatcaatccgtatgctcccatctttaataggattcccgctaaaagcatacatgtactgtaatgcgcttccccatgggtatctggtaaccacgtatgtaggggtataatcggcaatttgacagcataagcaataaagaagccaaaataaaagagtatttccaatgttgcagggtatgattgattaattaatctttccaaatctaatcttggttcgttggaaccgtataagcccatacctagaactccgattaagaaaaaaatggaaccacctgcagtatacaaaataaactttgtagctgaatagagacgcctcttcccccccccccacatggataaaagtaagtaaacaggaattaattctaactcccacatgataaaaaaaagtaaaaggtctcgcgaagaaaataatcctatttgaccgctatacattgctagcatcaggaaatagaataatcgggaattccgggtaactggccaagctgctaaagtagctaaagtagtcataaatcctgtcaataaaatagatcctaatgaaagtccatcgattcccaatctccagtggaaattgaagacatctatccatttagaatcctcttttaattggattaagggatcctccaattggaaatgataacagaatgcataagtcattagaaggaattctaataaacaaatagacatagtataccacctaacgattttgtttcccctatgaggtaaaaagaaaattaatgaactcgcaaatatcggcaaaacaacaagtattgttaaccaaggaaaagaactcatgataaagtgataaagacaagatacgttttgaccagaaaagcccgtgctcgattattttgagcacaggcttcttcggtaaagaggaatcagacgattcaagtggaattttttgtaacgtatcaataagatagagccatgctgcgggttgtctcaggtcctaaataaacgcggacacttaaaaaatctgttgggcaggcggattcgcatctcttacaacccacacaatcttcggttcttggcgcggaagcaatttgcttggctttacatccatcccaaggtatcatttctaatacatctgttggacaagctcgtacacattgagtgcatcctatacatgtatcataaatttttacggaatgtgacattggatctataaattttccttttcaacataaaaattttcgatctggtcaaaatgaaattagtactatatcaatcaaatgtattgtagacaccagacgaagcaatggtttatccaaacttcaacaaataatgcaatatatttcttaatccgtttgtgagaaagcatgaaaagagccaagagactttaattttgggcttcaacaatcataattatacgaattgtatatacgaattcgaattagccaataaattggctatcgtcttttcaatataaattattgcaatattcaaattgcaatatcaatgaattgcaaaaattcaactaagtaaaaaagaatactatggaataacctactcaaaaaatagatattctcaaataataaatagtattcatgttaatatttcatattattattatatgtgtccctttgtttagaagattctatgtctaattattcaaaaaattagattgattgatacgagttgatttcctattacgatggatggaagaaagaatggataatccaatagctgcttcagcagccgcaagggctataacaaaaattgcgaaaatgtctccttttaattggcggctatcaaatagatcagaaaatgttacgagatttagattaattgaattcagtataagttcaaggcatattagagctctaaccatgtttcggcttgtgatcaatccatagataccaatcgaaaataaatagacactcaaaaaaagtacatgctcaaacatcattaactaactccttatcaatctcgattcatttcaatatggggacaagaattgaaccgattgaattaattagaatagaacaattacacaacaaaagagaaaagaaggtatttgttggcagtagatgggttttactaaatcaaaattgtggttctttagtgatttattttagatttgaaattcttataattttgactcattctaagtatttcttattgccgagccatagtaattgcacctattaaagaaactagaagaattatggaaatgagttcaaatggaagataaaaatcggttgctaaatgaatcccaatttgttgaacgttatttatgagaccctgttctactatttggtttgatcttgtagtccaaagaattccataccatgacgtatctgggatagtagtcattagtgaaaaaggaatagttatacaaacgagtgaagtgaacccatctccaatagtccaaaaattcttatctttagaccattctgagccatttacgaacattacggcaaatatgatcaagacatttatagctcccacataaataagaagttgtgccacagctacaaagtaggaattgaataaggatatacaaacaagaactaatcctagcgaaaaagcagaaaaagttgggttggtaagtaataccacccctagaccccctagtagaagaacaaatcccccaaatagcacaagaatttcatgtattggcccaggtaaatccattatggataagaagaaattaatagtataaattttttcatgaactgactaaaactaaaagattcaaggaagaaaaaagggattaggaaatttttttgtatattgtatataagttctttctatagttagaaatcacatcacgaaaatctactctggaacaaattctaggtgaaacatttttcggtggaacaaaaaataaaacgatttcccttaataggggtttctaaaatatgtgggttttttttgtttgcaatggaatattttagctcactgcaacattagatttatacataatgaaacattgtgagtatactatatgcaatattttttgtggaacaaaaaaataaaccaaattcttttaatatagggttttcaaaatatatagttgatttgttgcaggtagggacagatattatggtggggccaacaatatcactgtgcgcgggaacggggccacggggggagcacccgatttttttttctcccccgtcggtcgaccgacgaatagcattatcgtaaagagtacggtgtgttttgaggttaaactaggcaatgtggggcccgcaccaatcttcccagaacttttcgttggcgcgaacggtatttcgttagcagcaacgtggcgcgaacgggaacggaaatcacggtgggctacagtgctatgtgggataggaactcggtaattctaactaaactaacggagcagtcaatggttggggccacatgtcaatcaaatagcagaaaattctccattaagcccaccgttcctggggcagaatgttacataaaaaaagaaagaaaaaacaaccaatatagtcttattaccgttcacaccaagagctagtttaatccaaagttccccacgttcataaaaaaatcaaattattcacggttgaacaaaataatcgccaagcttaaataaaaacaaatattttcgtagctacctactccctccgtcgcagaatatagcaacctaagaccagatgtgatgtaccatagtactacgaatctagacagggggtatgtccagattcgtagtcctaggatacgtcacatccgatcttagttttctatattctgagacggagggagtacctatataaaatcatatcttataacatgaagatataaataacaaaagcacacattaaaaaaatagaaacaagaaaagaaagttatagccatagttgagtgataaataagaaaaaagcatagtactggcaaacaaggttttccctagaacgtattgctaggtgacgataatggcaaccgaaaaagtttgtgaatatacatttgttttaataatttacgtttatatatatgtaggggaaggattagcacacatatattcgtcctgcaacgaggatgtgggtacgccaccagccggatcattcttgcagcacgggtgagcggaaccgccacgttcccataggtcggaagtgcagcaccacgacggtcccgcgcctcgaaagcatgtcaatgcagtggccaactagaacgcgtgagaccgatacggtcccacagcttggaaacgcggcaccgcgtttgtcccgtagctgggaaacgcggcaccacgtcggtcccacgccccagacgcgcaacatcgcgaaccggccaagcggtggcgtgagccagccacgcgcgaccgaccaacagttgtagcgacgcaagcacgccggtcttgcatgaccagcaagcgggtccgcacgatgagcttggctggctaaagggactgacgcggtgccgcgcgcccacgctggggttgcgtcgcccgtcggtcccatgtttttttgcaccacaccatatacgcgatcctgcgtttcttataatttgaataaaaacgaaacttgttgccttataccatgttttacaatatttctttcataatcatgaaaattttgtaggttcgatgatgtatcgtactgtaaagtgaatcttaattatttcaaaacacaacactatgctaaacctgatgcaaaatgaaacatatgcattttacccgatgtaaagtgtaattcactcataatttaaataaacttatgtttttcttgtttgcttggtcattcaaccctggcttttcaaccattaacaatttatttggctctaaaattagagaagtcttatacccgagtcttttctgattttttttctaagtaagatatagattttacctcagtttctattagcatatgtttcaaactgctaaacgatgtattttatgaaaaaaattctctaaaaatctttctttagaatatcagataaatctactttttaagtttaaaataattaatacttaattaatcatgctttctcgctttgcttgactgtacttgatgtcatttgcagcatgttccaacaaggatgcagtctaaacttactttctaaaagtatggaaagtatattctaacattaactttagagtgaaattatttttagaataaaaattttctttactcgagaaaagtataaatatcttactccacaggtatattttgttgcgtggttatctatctttggcttacattccattgcttcaattatgtaaaaaaccatgtagagcaaaataatgataaattgcttgatgtgcttgtaaaacgaaaatcccccgccccaaatttctaatttgctgtggcgcgtgcgggaatacaatttcccctccttatctcttccacccagccaggccaggttcacagtccacagtcaacactacactccacagccaggcaaagcaccgacgcacgcgccccttctcttccctctccgtggcggcatggcggcgtgccccctcctcccgctgctccagctctagccctccctccacaacatcctggacatggatcctctacctttggctcgccggagcaatggggccaccagactgccagcgatgagtccgggggcatccagatccagcgccacctcacccatggcagctgctccggtgcgacgatggccaggggccgcgctgccctcctcatccctccactggtcaattccttcccacaagctcctttgtcccagatctataatatctggattattccccaagttatgtggttcattcaagacttttctaattggggattttttttttaggttagtgaagaagttgggtgaagaaggacccgggcaagacttacatgctagctgcctctccatggtatgatctctctcttccccacctctctgtctctttcttccctcctgcacgcatggagaagggtccttgtggatttgatttgtgaagagaagcattttacttttcacctggacagccgcaaagggctttttgctggaatatgatttttttccctctaaatatagaactacggagcttttttggtttcaggcggagaacttggagcttctaactggtagctcggatttgatttctagtgtagctagtgactaagacatactccatccgtttcacgatgtaagtcattctagcattttccacatacatattgatgttaatgaatatagatatatatatatctatttagattcattaatatcaatatgaatgtagtatcaatatgaatgtaggaaatgctagaatgacttacattgtgaaacggaggaagtacttatattcaacttgtcatgtactttttgatagcacctttcttcagtgttcatttgttttcagggtttaaaccgatctctgacaatgaaactatttttttcatccttcataatgataaattgtagctatttacaagaggaatcagattatcgaattctccactttattagagcccctgttagtgagaagaaacaattttggatgagattgtcacttatgtactatccttgcagaaccaagtggagataaaattcttgttttatctatatgatgcaattcctttccttgaggattgcttccatgagccacccagtacaacacaactaaaatcatatggagtatgaaccaactgtgcatatatctgtagtttgatttagagatgcctaaaattttcttgtgtgaatttattattcttttttttttcagaagattggagccatgttccaagaagtcattccaaaattgcaatgtctgttccagtactgaaccaatccagctcggctccatttcaagccatcataggcatcacctcaaagacattctactcactgcaaagccagggagccatttctttctctcaagttggcatgcgttcctttttcttagttaaatcataaattaacaggcccaacttaattatcatggaataagccacagcaattttacccacctaaggtcactctgtgcattcatttcaggacaatgacaagcattgggatagacaaggcagtagattctcaatcaattggtgctgtctagtaggtgaagagtgacaccgaagcaggtactacaagcaaagttcccttgtctactatgatgtctgaatattgaatttactattgtatattctctcaattgattcttctcataccattggatttctgattacatgatttacaattttggtgctagcaaattgatgagtatgtttatacaaatcccattaaaatgttgatagtaagataaaattttgatagatgagcaagaattgtttgagttaggatcataatcatttttatcctaaattacattatataccaggaatcatgaagttctataagagaagtttgatttcaattttacattttcccctattttgaacatgtgcaatcatttatttggatttcagtgcaatacatgagcacttggctagtataaaaaaagaacttaaatgagcacttgaccagtcacttgggtgtagggatggatgccgagccagctcggctcggctcggctcgacttgctctagctcgtttagataacgagctggctcggctcggctcattatctaaacgagcagaaaacgcagctcggctcggctcggtcagtagctcgagctagctcgtttcggctcgcgagctggagagggcaagatatcagacatcaagattagaagagctaggacaacggaacgtgagccgacgagcggcctgcagcggcgaggacgagcacgacggtcgacggcaaggcagacaggcagaccgcagcggcgagttcgagtgcgatgaccgacgacacaaaaatctgcggtgccaaggtgacagcgcacgcgacggccaagctggggcaacgccgcgacgaccgacggtgctgcagccctcagcgcagattggcagatggtcgcgacagggaggtggcgatggcgcaagcactagagaccgggaaggaaggggcagcgcggcgtggctgcgaggtgcatgctgggcgatgagcggcagactggcggcggataggcagagtgaaaaggagagatcgagactctcgagaggcaggtagggtttgtggtatagtattagtactttacatgctctgatgggcctcgtggtcttgtgtgggctttgtggcctcgtggccttgtgggcttgtggactgggattgctgttgcctgctgggttgtcaaatctcgttacggctcgcgagccagctcgagctggctcgttatctctaacgagctaaaaggctagctcggctcgttaggaaaatgaaacgagtcgagccgagcttgtcgcaagtcgagcgagctaacgagctacgaattttcgtccacccctacttgggtgcatagcgcttcttggcatgtgccatcaataaatgtttccaatattaattactgttgttatacctgaattttgtaacaaacctagacaattcttgaagaaagcatgaataagttcaggtagtttttttttcttattggcatagatcatttaaataaacttgttgctaatgctatttcatataaatgtgctatcactgttttagatacatgtacataaaatgttgttttgaaataaagctcgcctacgtaattaatcttacctcttttgtgcaatctcaggatttgcaagtcaactggctcatcttcatattatttgaggtgttgtcggactgcctgcaatgccattcgtcaactcttttctcgtttccctacctccttggttatctaaccttaagaagtaatattcaaatttcatctcagttgtagatgtctatgagattggcattgctattgtaattcacattagattgttgtcaaatcgattaattgaacgtggatgtcaatgcattggaatccattcttccattgtatgtgtgatcgcctatgatgtgttattaagctcctactattctggtgtaagcaaataatataaatgtatcagcaaacccattttagttttgccctcaagtagagttcctgtgtgtcaacttacagtgtcctaaactgaacacacgttaacaacggcactgttgctgtgtgtttcttggaaagttaacgtgtgtcatgctatgtcgacacccgggaacaagagaaggtttaccgtgtgtgtccgattgaaaaacacactgtaactttctctgcactacgcaactgtgccgtcaccgttgcctatggaattctgttggacagtggagtgaaaatgttaccgagtgcctagagcacccggaaattctcactctgttacggagtgtatgtacctaggacacacgccaactatgcacgggaaggagaaatcactcctgggcgaagattactgagtgtgggactaggtaactctgttacggagtgtttttcatgcattggcaagtgtttttgacactcgggagtctccccgtctccagtatataactcctatgtattgaatagtatagggagaaaggatattgtttttattggacacgttgagcttcaggggggcggtatatattggagtacatggcgaggagataagaaaggattacagaaatggaaggagtccatacaaataaattctatcctaatatgactctaactgccatatactctaacataccctcgccgtccaagcgtgagcaatgcaaacactttgactggagaagaaaccgacaagagtgcttaatacggatgatagctcgttgtgccatagtcgatgtagatgaagcgaagggtgcgagggatccatggtcaatgaagccatgcatagagtagtcatggtcaatgtagccaaagtcggggagccaatgatgtcgaggttgcctagccgcagggcgcgcatggggcgccgtagagtatgtggtcatgggcgagaagcctagaacgcagtactgaagatgatgacggtgatgcgttcgtggaagtcattgaggaagatgacgccgaagagttgatgttgtcgaaccgtataggacgagacgtcatgccgggtttgctagacccggggacaactcgggacgaatgcacgctacgatgttgccaataccacgcgggcgagataggagactaccatgaatcatacaccaatgtcggaggagactagtagagaagacctccatgacggttgcggcgcgagaacgacgtggagggggggattgtcagagcaacacacgattgccagagaagagcgaagtgtagtcgagaaagatacggtgacattggcaatgaggcaagttggacaaagacaaaggcgaagtagtgggaccaacgacttgaaacggtgatgtcggtagccatgaagacgtagctagaccactggcctagagcggtgacggtggcaacttaaaaatgcagcgatgatgctcgaagcagtcgaagaagatcccgatggctgaagatgaccagtgcggacgatgagggtgtcgatacacgggcggtgaggaagacgacgaaagcagcaaggctgtggtccgaagggacgacacagatgagcttcatgtcaatgcagcggtgtaaactccaccagcggtgaggccgcgctgaggaaggcgtctctcagcgttccaacaaccagtggaggtggaccacgggtgtaggatcaaggaggccgactagaggggggtgaataggcggttttaaaactttttgctaaaaccgagttttgtatgcggaagcgtaaatcagaacggttttgcacaattcaaaacctaaatcaactagtctcaagtaagtgcacaaagaaactagcatatgttaaggtttgcaagcctagggtgataatagcacaaataagctctagtatgtaaacttgctcaaatgtaaatgcaacaaataaatgagacaagagacaagggatttttcaccgaggttcggaaactcgccggtttcctaatccccgttgacgcgagcccaactccactgctcaaccacgaagccaccgcacgcccccttcgtcaaggggtgggcacgccggcccacggagaggactactcaagcctcgattactagggtagttcttccttcactccgaaggtggtgaactccaaaccacttacaaccggcgccgggcctcctccacaatctcctcggagaggtcaccgggcaacacctccgcaagccgtctaggaggtggcaacctccaagagtaacaagtctaggatgcttgccgaggatgatcaagtgccacagtagctctaacaatgaagcaatgcacttggattggcttaactcactctccaacacctcactagataaactaagtgcacaagggtgtgagagctcttgggttcaagataatgcaatggagtgccaaaaacctacccttgctgctggggaatgggtatatatatacccccaaccaccaaaactagccgttggagtcgaaatccccaactctgtgctctgccggtcagaccgccatagagtggccggtcagaccagactactttgtaacggctagaaaactagccgttacagggcaatcattgagcccactcaacctggctggtctgaccgtagtgtagtggccggtcagaccgtccatggctcggtcagaccgccgtcggctcggtctgaccggttgcggctctggtggttctgtatagccactaaaaaccagaccagtgcaacagaccagtggggacggtcagaccggccttaccacgccggtcagaccggctaacatccttggtcagaccgtcctatggcccacggtcagaccgtaggtcacttttcagcacaaccaacagttagtaaaacggcgatatctcttgactcggatctcagaatttgacgttcttggactctatgtaaagcttattcaaatagccatccaacccatgaaaaattcatccaagaaacacaacttttatcagggagaaagggctcacactccaaagaatactccacccgacataaccacatgaggctacccaaacctataggatttgcccacttctctctttgtttaggacttgagaaaactcaccacacttggctagacaagcccaccaaatacacctacatgcatatgaactaatatggcgcaagatcatccatatgctcgcttcatagacccctcttgatagtacggcgtctatctagcaaatccggtctacaccaaacaccaagaccgggaaaagactaagaaaagattcttagctccattatacctttgccttgcgccatccaacttggggtcaatgcttgagccaagatcaacacttgtgaccatccggttgaaccatgtttatgccgaggtctttaccattctttgtcaagactttattctcatcacaagcttgacttcattcttgccaatatgacgatgtccttggcttggtgaccattaacccatggtgtcattcattagccgcatcgtagtgggacctattccttttcacatctcaaagttgaacattagtctcaacaaatcggttgtcatccttcacttgatgaccaactggttgcatatgaaagatatggatatgtttgttgagtattcattaacatcacaagtgtcatatactcgtatgcaagctcaagtgcaaagatccgatataaataataggtgaatgttggtatttaatacggtcacagagaaaatccgcaagcgcacggatataccgatatggcacttcccctacggagtattccaagggtatcgaatccaagggaacgtgtgtggtcaaatctttctccggttcatccaaggacaccaagcaaaggataggacaggatagagaggattcactagtgagaaacagtgtctaaggaaagcttaacttcaatcccaacgcaatacttcaggcactggcaacccgctgttcccagatgtcgctctactatgtacccggacagggaggacttaagtgatctcgagggctgtcaccacctctacacccacctcaaacgtactgtgggatacgcaacaattattggataacaattacctaaacaccacgtctaagcaattaatatctactttagtgtttataactcaccaaagcaatcactatgttttagttaattatagtgaacaataatcccgtatgctatttaggaactaaccatgagataattctcacaagataaatctaaattactcaagaagaatattatattgaattcagagtaataaacagaataaaagaaataggagaagattaccgacaactccagaattcttccgacttcttccactctactctctttctattctagtatacaatatagtacaatagagcctcttataattcagctcaagcttggaaatgtgtgtgtgaagtgagggagtgatgtctttatatagaggtaggtatgacggttggcgaagggaaaatgtccgaaatgccccacaaccgccattagggagtgatctggagcgtccacgccaaaccccagcctggatggctgagattgtggttcggccgaacctgggctaggcccatctggcctggctcttggcccatcttctcccctggacctcctctatccatttctcggagttttgggttgatttactggtgtttggatgaagttcacaacccttccttatatggatacgtgaatctcctcactgtagtctgattttcctcccaacatcggggtttgtcgtctgcatacaaatatataccaacacttatggaatatgtgagattaagcacctatcactatgttggatgttttattatccgaactttatgcagatgttggcggtatagaatcggcatttaacagccgccaacaaaaccccccacacttagcccttggctcgtccctgagtaaaggttagtgtagaatgaatttctttaagatatgaatcaagcatataaatcattcacaaccatacctgtacctgtgaactttataagtggctatcttaccatcttgagtaattgataaatggaatgatcttgattccagtccttcttgcttctctgccagactcatgggatttttatgactttctctcttgtctctcaaagatgtatattttctttggatcctcaccaaggcaaaatgtgccagaacttatccctattctaaggctaatatgtggagcttggtagggataaattgtgacgtacctgcatcatatatattgcaaatccaaaaagatagactcaagaagataatcaatcatattcctagatcaagggtctttatttatggtggaaaatgaaaaagtaaaatatttttgtggaatgatggagtaaagaaaatgattctccctttttcctatactttctctccaattggttctcttggcatggttatggaaggggcttggctatattttctttgctcaatgttttgagagcaaactttatttccttctctctttttttcacagccatgcctttccctccttttctcattttctttttgccgagaacttttctaggagaagaaagcatagttcaatgtaggagtttatttgaatggatatttttttttgtggaaagccaacttccagtgtagaagcttagcttaattttatatgtggacatgaaggtggaattgaccccttgatcatgagagtatgaaagatatctaacacaagtcacacaaatttgacaaagctcaatataatgtcaagcagtcatatgcatactaaggtttatcaatgatatacctgcatatggccttggtatgtataaggtaaaatcaattggaggattgagcctttaaaaacaattttatttttgaaaacaaatccccaagagtcataacaaagttgcaaggattcctttcatcttaatcatctcacataaagcaatcacttagatgtataaggttccctaatcatggatggttgttcacaagcacaagttcagctgagaataatgaatatacacgatcaatcatatgaagaatttcattagttggaaattttatctttcacttatgcttcaaccagttgttttctgaattttcagctctagtactataccatggtggagatatacagataaaagacgtgctcacctgtttaccattgaaagttgagagggtttggggccagacttggttcggccgaaccactctggtgcccaatccttctgcaaattgctgcagagtttggtgccttctaggtgttcaaatattcagcaattttcagattatgtgcacgtcagaagctgggatatctcccccacacttattcaaaatctgaactttattaagcatgaaacaaaacaaactttggcaaacattggggttaacaccattgtgccacattattcatagcaagtgcttacatgattggaaaaataaaaccaagcacctactactattttattcatgggaaaggaaacatctaattagcataatatatatttttcttccccatatctatgaatgcacgcttgattttagcgcacaaaccatgactaagggtatcgaaattattcctaatttcagcaagctctacccctagctccgcgttgcgatccctaagctctatgttctccttgcggagtttcttcacttgcgcagcgagcttatggatcgagggctccggtgatttcacctcattttcttggaattggccgggagccctcacaattggagggggcgtcaagtgacgcttcaccttcataggtggatggctacgggattccgctgccccctccttctctgatgccatcaaaggccggagtaaacccttaccatacctaccgcgggagttcgcactccctgaatgcggaatcgctcctccttcggagtggatggagtagcggtgggtgtggtgtacttgtgagcacctcatccactgccttggtgaacagggtgcccacataacactcggtgggaggcggcgcggccttcccgtcatcttgaaaaaggcgacatgcctttaagagaccgagctctcccatcgtcagccgttgagcaggcgaatccccccgaatttttgtccttgtgacatggcgaggggagagggatcgcgctgccgaacagggggccgaacggggccgagaagggtttggccgaacccctggtttggtcgaaccagggagctcgtcgacgggctccagattttcaggggagcccggcactgctgcgaggggctgcacccacagtgcattcaccccttccactgtgtaattttccaccgggatgagttgattcgccggtgttggctctccggtgaggttgtccggttacggttcgttgcggaattagttcattttgagcatttgcaacgaccgtcatttctcctttttcggcacaacctggactgggctaacccactcactgtatggtacgggataaataatcccggcatgcaggagtttcaagacctctttctttacaacctctcgcattgcattattgagccatcgttgaggttccctggagggagtactctcggggtcaataggaatacgatgggtgcaaagcgcgggattaatccccctaaggtcctgaagcgagtagccaagaacagaacgatgcttttctaacacggtgagaagacgttgagtctcgtcttcagagagcttgtcactgattatgagacaggggcctgtcacgcccagaaattcccgaatagaatttcaagcagaatgtgcattaaattccccgtccaggaccggccggggtacacaaacgacaatgttgacattcagatccacgtcttacaaacatcataaaagtcttacaaaaaatgcagcggaaagaaagaaagacaacaggagctaagccttgacttgaactgcagcgggaacaccactccacaggcatcctcgacggcacggacaaagcctactcctcggagaaaccttcatctgacccgaactcgaactctggggttgggaaaagtagagcaagactgagtactacccactgtactcagcaagtcataccggaataggggtatgatgcagggaatcatcaaaggagagctgaagtggttcatttgcataaagcgagcatttataagcagaaattgaaagatttaaacggttgtaataattaattaatattaatcatccgctgtccaacgctaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacatctgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggagagctacactacaagcccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaaacggtgtcactaatccaacaacaccattggaaccaacagtctaaacattaataggattttccccaatgtgaactagctgaactaagcatggctaagcaatccccagtcctaactctaatcatgttagaaccccaagttgacaaagaaacaaggtacaacaatcgcatggctatgacaataggtaaacaacccatagtaacattataaaacaatgcaatatttgaaagaaaacaatagagcatttgcaatataggatcaacatgttcaagtgacaagcatgacttgccttgctctgctgctggaggaacctcggcgactatttcgaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactataacagaaatccttaaataatttattgcgcaatattttccagggctgacgtcagcacaggggaagcggcgccgacatgcgggccccaccggtcagcggctcagggggggaaagaaagggcggcggcacgcggctcggcttggctcaaggccggccgaccgaccgcggcgacggcgatggcgcgcgcgcgaacgcgttgccggcgacggcaaccggcggcgaaagcgacggcgcaaaaggcgacgcgaaggcggctgcgctaagcggcggctaggaaggggagggaatgggcggcgataaaggcggccgccgactcggctcggcatcaaagccgaccggccggccaggtctagcggcgacggcatgcggccgacgacggcggcgaccggcggcacgggaggcggcggcggtggtcgaaggcgatggcgcgcgacttgaagcggcggcgcggcactaggaggagaggaaggggaaaagaggggagggatgcctcaccgagggtggccggcgcggaggaagacgatggcgaacggcgacggcgagccacgggaggatgacggcaaccggcggacgagcttcggggtgccctaaggaaggagaagagagggattagagagagggagatgaaccacggcgaccggtattcacggccgaaagcggcggtagcggttgaactcaccggagcgcgaggggatgcgaatttcggcgacgaaactcgacggggaaagggcggtcggggtggggcttagccttgcgaacccgacggcgaagacggcgtggtgcggcggcgaccctagcggcggctaacggcggcgggagtagcggaaacggcggcggcaagaggttgcacggcgcgggagcgatgggaggcacaggagagttcggcgaaatggggaaaaagcgagagggggtgacggagaagattaaatagggagagagagaaccggacgtggccgggagaggcgggaatcgccggccgacgtgggggagtgggggaggagagagaggcgggattcgaaaatcgaatcccggccatctcgggcgcgggcgcgagcgggagagagaggggagtgggcgcgggaaacgcgcacgcgcggacgtggtcgacaaggcccgaaggaggcggaaacgtgggcgcggcggcggttgcgggcgcggcggcgcgccgggagcggcgggaggtgggggaaggacccgacaggtgggtcccacctgtcggcgaccccgggagaggagggcggcggggcggcctagctgggcctcggcctgcggccggcccagcagggaggagggggaggaaggaaagaatgggccggcggcccattcgaaaaaaaaaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcttgatttgcaccggtattttcttagggtcatttataaattaaatttaggcttgggaggagaacttcggggtgtgacagggcctctctatcattatgtaggaaggcatatcataggcttggaggtagaggtttaagctcaagcggaggtcgaggtggcggttccatgattggcaggtcgagagtctcaccgggatctgcttcttccttgatgaagtctgggacctcatcttccagaagggcttcaggagactcatgaggagggactgcggtaacctcttccgctgactcaatttctgggagagaatcggtcaaggtgatccttgcccgcgagaatggaattgaaaattcattctctcccagtgttattttgaggctacctaatcggggtgtgttaataagaagttgctcaatgggaagcccgattagaatgtcgaaatcttgaatttcaaagacgtggaaatccaagatcgcctccatgtcttcaaagcagacaggcacatcttgcacaatcccaaacccttcgatgatatttccgttcggatgcttgaagaatttgtttgtcggggacactgccttatcgcttaaataagcgagtgcaaaagactcagagacgaggttggccccgacagatggactgtagagaataccgacatcgttcccttctagatggcatggaatgattcggggagccgtatttatctgaattacttcggatgaaagctctacctcccttagccattcattgctcattatggatgtcaactcggacagtttctcacaggaacccgagttccataggatcgggaggtgacaaaggaacgggtggtttcctcttgctaaaatagttcagggtattgccgtagtcttcgtcaaaactgtccctgaacataattacggtacaatccggagtctgaatttcttcattcccgacggacggctacacaggaaccttctcatcaatcgagctagcagaagtggatggttcagcaagtggctcgattgttagaagttcctctatcttggacacggatgcctccagctggggttcattggactgcatcatgaaggaagtattttctagaatgcgatccaaaatcgtttttccttctgacggcgttttgtgcatgaatgatcctccagcagttatgtccagatagaatgcagactccttatccaaacccgtatggaaatgttggagaagcacatactcgggtaaggacagggttggtccggactgcactaaattagtgaatctggaccaagctgcaccgattgattcattttcgatttgcttaaaactgagaatttctactcgaagggcagtgatacaagtaactgggaagaaggcaagacagaatctgtcttgcagcttttcctagctaccgtttacacatccaacggtagaggtataccattgctttgctctctcttgaagagagaacgagaacaatttccaccgcacagtttcttgtctcatgccacgaatcttaaggcacgagcagacttgttcaaagtctcgcagatgatggtagggattttctagatcaaagccagaaaaaggattttccctaaccatactaattagttcgggacgaatttcatagccagttgtataaatgggctccgatgaaggaggtggctcgtagaattcgccccgaggagcagatagctcaaaaagaggttgctccaaggtcgagaagagtttgacaggaatacttctctagaatagcaggggtgaaggtagaataaaaaatgaaaaaggataaaggatgaactgggttcgaaaatgatcagcaaccgttccccggcaacggcgccagaaatgcttgttggtatttaatacggtcacaaataaaatccgcaagcgcacggatataccgatgtagcacttcccctacggagtattccaagggtatcgaatccaagggaacgtgtgtggtcagatcttcctctggttcatccaaggacaccaagcaaaggataggccaggatagagaggattcactagtgagaaacagtgtctagggaaagcttaacttcaattccaacgcaatacttcaggcactggcaacccactgtttccagatgtcgctctactacgtactcgaacagggaggacttaagtgatctcgagggctgtcaccacctctacacccacctcaaacgtactgtgggatacgcagcaattactggataacaattacctaaacaccacgtctaagcaattaatatctactttagtgtttataactcatcaaagcaatcactatattttagttaattatagtgaacaataatcctatatgctatttaggaactaaccaagagataattctcacaagataaatctaaattactcaagaagaatattatattgaattcagagtaataaacagaataaaagaaataggagaagattagcgacaactccggaattcttccaactcctactctactctcttcctattctagtatacaatatagtacaatagagcctcttataattcagctcaagcttggaagtgtgtgtgtgaagtgagggactgatgtctttatataggggtagatatgacggttggcgaaggggaaatgtccgaaatgccccgtaaccgccattagggaatgatctggagcgtccacgccaaacctgatgaggacataacttgctcagatataaccatgagtaccttatgtattaataaaataaaggtgcatatgttctacattagatttacttgttatatagttgaacaaacgttgctgcacaatgagtttcgtgtgtttttgtttgcagaggtacttgcttgggtgaaagaaaagagaccgagcgtaaggaatgcatggatgattgaagaagttgattggggaccaaaccaagaccttgtccaagtcttcttttatctcaccacgtcacttttggttcatagaaaacaagagataaagttttacacgttttggattcggattcgggcctcctgacagcatcaacttcaaatgaacctagccgctgatctagaaggaatttcacggcccatgagtacttgttggaaagcttatggagtctactttcagatggttttggtcccacgtcaaaattcctaccgagctgccgggaaactgcaaaacaaaccacgtatctcatccagtccgaatctgatttgagttttgggccttgtaattatgtcgtgggcttaggccaagggggtgtgcgccctaggacaaccctaggacgtccctaatcatattaattcagtagccgtcatcgtttagagttgggttttgcttagattattctatcaagaactgttttgccgctagattggtttgtgaaaccccaaattcgagtgcttaatcattcatatgcaatttggttgcaatctatcttgttcttgcttgtgttcttcgattcgcatgcagggattagccctctcggcgaggtcaaccggatttcggcacggttgataaccagaggagacgtggtgctgcgattgcggggctcagtagtgtattcattcagaagccggatcgagttgtgtcgcgactccgcccaaattgactgtttatcaatacctatcggaagatcaggacctaacatccctcatcgtcttctttcatccatgcattccttacgctcggtctcttttctttcgcccaatgtaagtacctttgcaaacaaaaacacacgaaacttattgtgtagcaacgtttgttcaaatatataacaagtaaatctaatgtagaacatatgcacctttatttgattaatacataaggtagtcatggttatatccgagctagttatgtcctcatcaaaaccccagcctggatggctctggttcggccgaacctgggctgggcccatctggcctggctcttggcccatcttctcccctggacctcctctatccatttctcggagttttgggttgaattattggtgtttggatgaagtttacaacccctccttatatggatacgtgaatctcctcactgtagtctgattttcctcccaacatcggggtttgtcgtctgcatacaaatatattccaacacttgtggaatatgtgagattaagcacctatcactatgttggatgttttattatccgaactttatgcagatgttggcggtatagaatcggcatttaacaaccgccaacagtgaacaacatagatctagaacatgcacaataaatatataggatttgctccccctaaatatatgcatacaaataaatatacaagagatgcaagtgtatgcataattagagaatgatcaatgggggtttatcctatacacatagagaaggcatatgtagtaatgatgtagaccaacataaaacatataccttcatgatctccatgttctcaatgtaaatgagactaaataagataagactcgagtaaacattagtttcacacttatatatcaataacatggaaatcatatatatgaacctatcaaaaagtaggagataagaagtggtacatatcgttttatctccatgcatttcatccttgtcatgattaaggtccatcaaaaaataatgcatgtcttccacacctcattatcgggaaataacctagtagacaacttatgcaaaagagaggttaatcccataaacatcggtttatcatctatcaccaaagtaacaattacacaaattgtttaatccaagatctttcaatcttctctctttggtgatggataataacctgatataaacaattagagagatgagatggaagatgatttcaaatcaagatagaaatcttataataaacaaaatatagaataagctccccctcaagatgtgcatacatatggatataaaggaacacatatgcacataatcaatcaagatcaatgagggagctcacactatattttggattcacaagagagaccaagttagaatatgtgaagtttaatacatacctctcatcatttttattttcatatccaaataagactagtcaaagaaaggctcgtaaaaacgttagtctcatataattagatttgtcattaatcaccaaaaccaaattaaggcacttgaacttacaatgggcggcgacactgtagcccgagggaaaggtcaacgtttatcccgaatcgtaattatcttcaactcaccgaaagatcgggccaatcatagacgtgagtttctcaagtggagatcagggttcatcgggggggggaggggggagggggcatcgtccttttataggcggcgagaggcgattgtcgacttggccacgatgacggtgatgtgaagaagaagagcacaaccgccgccctcgtcttctgattggacgataatgttggttcgtctgggcgacaacggcacactgacctcagcaggatgacgtcatgaataaggtcggcgatgattccctggcatcgacagcaggtcagtggaggcggtactcaaagccatacaagcggcgggtggcaatggtagagcggcgcacggtggcgcccatggcgcacggtggcagcaccca

SEQ ID NO: 439 - DNA, 656 bp, Oryza sativa
  unsure (1)..(656): unsure at all n locations
cgccgctgattgagcagaggtggcaaattggggcaagatgccagcccctgcgttgaaggttgtcggcagtaaggcaagcgctcttcatcgcacaaaacataaagaatttgcatcgttccgacgcccgggatttccagatgatcttgccaagagcgcagcgagaccgtcccgtggacaaaagtgaataagccgatttgacggagaaagttcccttagagtctggacaccacctcaactcatcgcgcaccccatgatccagctgcactagtgctagaagatcccaaagcgcgaagaactccaggagggcctggacagacaggccgccccgaacgtctcctacccaagaattctcgtgcagcccttccgccaccgattttgtcttgttgcgaacataggagaagagcataagggaacgatttgcgattgagccccctcccgagagccagctatcagtctagaaggatgtttgttcaccattgcccagttgcaccatgcagccagccgcaaagcagtgcgccacttttttgtctattggctacacaaaattaacccagggcctcttaggctagacacggcagagccattgccagcgagttctcaaggcgacgcccatgagacgcaggtccttaatgccgagaccnccgttctcgattggt

SEQ ID NO: 440 - DNA, 656 bp, Oryza sativa
caacatttacaagtactaaatgattttacttgaaaagttcattaacatcaaagttgtataacttatcaagatctataatttttatttgggtcatttcttcatccgacaaaacgatttataacaatattcacaaaatatacatatgtcttatatagtttataaactataagatagatatgttaattttgtgaacaatgttactatccctttactaaatgaagaaataaccaaaataaaagttatagatattgatgagttatacaactttgatgttgatgactttttcagttgaaatcatttagtatttgaaaatatcgtttgaagttgtcataatttgaaattaaaattcaaagtgtttaaacaaagtcatatagaaaaatggccaaaacaaaagttgtagatattgatgtgttatacaactttgttgttgatgacctttccagttgaaatcatttagtatttaaaaatgttatttgaagttgtcataatttaaaattcaaattttatataggtaaatcaaactcagatggagaaataaccaaaataaaataggtttatctcaataagttatacaactttgtttttgacaacttttccacataagttcatttagtatgataaaattcgattcaaaggtttaatattttaaaattaat

SEQ ID NO: 441 - DNA, 18438 bp, Oryza sativa
  unsure (1)..(18438): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgttggtgtggagaaattttatgttgtctgtacttatttatggcctaatgtcacgctacacttacatgtttgttaaagggagttaagaacgaaagtttgccagaggtggtgcacaatgtgaagactttagctgtcagtgtgcttttgcttgatgtggataaggttgttgacatattgagatgctttccttgcttggagaacttgtacttcaaggtattctttactgaaggtttattgtataacttggagtagtatttattaccgctcttctaaaatagttaatttttgttcttcatgtcctttttcagtcatgtgaattgacctcaaaagttgtgtggcgtaaaaaataccggaatcttaccaagagccttgacattcgtctcaagacagtagtgttggaagattatcggggcatctgggcagaagttcattttgcccaattttttgtactgaatgcaaggacgctggaagctatgaaatttttcgtaacatgcaagattactataaggggtttgctgcagaacagcgaaaggtgcttcagctggacaaaagggcttcgagtggtgctcgtttcatatttaccacaaagggatgtttccacgatgctgcatgtattgagcatgtccaagatttgtcatttactgatccctttgaatgtagatgttgaaatcggtttggtcctcgggggacttatccttgattatccccatcttgtgtttcttccaacatgaatcatgtattggttctcagaagtacatcaatttgacattatgttgtctctgcttgggactaggtgcaaaagatggtattagaatttggtgtttcaaaattggggaaattgtctttggaagttctgacatttttagtgcctgtcaattgttactaagcaaacctggttgatggacagaacagcattgagaatttcaagctaacccggtacctaatatcaggtgagttattatataaaatatggctgcttatattttagtgcatgcttggcttagctgtggattataatctgatgctgatactaaattttagaatatattctacggttttgtttattttcccttctgttgcatggcactctttgtgattgttatagaactatacctgaattcattgtttgtaagtaaagcatgtaagtaactactagtatatgcaattcgccaattcccatgtcatagtttgtagaaactagaaacggccacctgtttatctgcgctggaggctctatttgcttcgcatgcgttggccgtaccgtagacatttggaatgaaatctttggtatgattgttcaatcagtcgtgctgaagctgataatgatgtttattttttatttttcactccaatacttctgatgttattattttcacctcagtacttctgatttgtactctgtcaacatttctatgtgtcggcctagggggaaaatcatccgaaatgtggctcgcaatagttttactaaatcccccccccccagtcaaaatattccacgatcttttactggaatttacatgacacgtgaactaattttaatcaaacgtaaccctgttaagagtttttcataaataaaactatttgcctcctacatccggtacacctcctattcgtcatgttcatggcgtctaagctttcatggcctcacggccacttgctattttattttcaaaaatgcaaaaatttgtgagatatgtatgtactccctccgtcccaaaaaaaagtagattaatctaggaggggatatgatattttctagtaaaatgaatctagacaaaagatgtactaggagatgtcacatccttacctaggttgagtttttttttacggagagaatatattagaagcacaaaacaatttcttatacaagataggcgatgtaccgtgccatccgcaaagcaaaggggccattttggcatgagataccagatttttttcgatgtttggtgtcactggcggtctacttcctccgtcctaaaaaaaggcaacctagaagaggatgtgacccctcctagtataacgaatttgtacatatctacagaaaaaattatggagggtgcattacaaattacttctttttaaatagtaataaaatgttaaagtttaaaaaattaaagaagttaatccgagggagagggggagagggaacggtgcaccccgtggggaaaggagaggatgaaggggaaaggcggcaccctatggggggaggcggcccgtggtgtggggggatgaatctagggttagggttttttttttggtactagggttttgattgattcggaaccgatctgagccgtccatcaaaacgaacgactcagatcgattaagtgtcaggtcgacctccattgccgtacagcaacactgctggctgcgtgcaaaacgtggttagattttcggttacagctcacatggcaagtgaaaggaggagtagtgggaggttaattagactttggttgcttcctgggccggacgcttggttgcgacctgaggaaatcgggccgactcggttgcgtgttgaagaagaaaataggctgaaaatggcccatagagaaaggaggatttttatttaaataaatgctgaaatgatgtttgtactaagatttaaaaattccaagaaaatttcagagtgaagctaatatggacagtttaataaaaattaaatccaaccatattattttatttgttacacttactttagttgtaaattaatttaactatatacctaactacttaagaaatacccaaataattccaaaaatttgtatttgaattaaatagataatgtaaatatttctcatccctttgtcaattttctcgtcttttcatctcattgcgacacacggacactttttctaatataatactccagtataagtctaaataattgtgtttgatctttttttctaaatcggaggcaacctaggaacgctcacatatctctattaccgatttctggatccaaaccctggattttcattgggtcacgtgactctaccagaatcagccagaatcagcggtacctcttctaaaattcgtgccacgtgggcttctctcccttcggcgggttttgccgcatcctcgtaaaaacaagcgagcgtaaaatcctttgcctctcctttaggccttgtttggttgggccgttcccggccaggattggggtccaatccccgtcgatcaccccggcgaggaaacaatccaggcccatccgaaattgtgtgttcggttaagcccagtctgggttttaccccggcctatcccggcctttccccctcacccaggcccgggaaaaaaatcaacttctcgtgtggcgtggaaaaattcctcacgacgggagccgggaggcgacgcgcaacacgcgtagcggcagcacgacgtagaggcgattcgaggtggtgcaacggcgggggcggcgcgacgcggaggcgatggtgacggcacggcgctctcctccggccgccatcttctctccagtgagcacgcagccttttcccctctcccctcctctttcaaagctagggttagggttttcttcttttctccctttcccgtcgtcgccgcgattcgtcgtcgtcctcctcgtattctgctcgatctggtgagtcttgatctgggtgagaattagtgagttcttgatcagatggggaatgagctttttttcttggttgggtgaggatgagttcttgattcaccaccaccgccgccgcacgtcctaaaccatatcattagttcttgatttgggcgtggtgagttcttgattgctgcatttcccggagagtaagatcggagctgcgaaggctgtacatggcaatgcagaatgtaataactctctggaggttagaagagggtaacttgggctttaaactgtatgatttctctgacataaaagatgcaactaataatttctcaagtgaaagtttgcttgaaaaaggtggttttggatctgtctacaaagtaagttcagatttcagagtcacactctattaccagtagctagcaagcaagtgtttagtgttttcaaggctgaattgtacttccacacgttctaatttctagagagagaaactagaagaaggttgaggtggtcatccttttctacatttacgatatatcagttatacacttgagtctgaaactttgtgcattataatgttcactggttttattttatgtatgtacagcaagaaatggattgttgcattagttcagttcaacatgttttcataagattatacttcttgtcatgtgcaacatgtttaagaacgctgaaagttgacaagatattaatttttgtgatgtgaatataataattcctctgtcaatttgtttctgtctaaagtgttattatgaatattaatcatgcgtgatgaagatgatcatttacaactagcttatatgctatttttagaagaaaaaaaaatcattttttgtttgtgtggcatggcaaaaggcaatgcttgcataagttcctcgaagtactgtagattaaagttaatggtatttgtgtataccaatgtcaccatatggatgcatgggggaataggagcatgttgcttaatttttggatcattattctgaacatggttaaacttcagaaaattgcaattagtttgtatggtcttccatacaactatattagataatgcttaatttttagttgttataatctacctctctttggggttacccacaagtagttgtcaattgctggaattttaaattaccatatacatatcctcaatcagctctattatggtcttaaataatttttcgtaattctcctgtgatgatagttggagaagatgctgatgatggtgtaaattatggaactggaaggctgtaaggatctttttgttgcaggggcactgaaggatcaattatgcatctgcactgcacttctttcactatgtctaaaatatttattaagcatagactgtagaagctaggactgatcgatattctaacatattctaacttatattagataatgctatgtttcgactgaaaagcaaaagtgacatttgatgttcattggagattacagtaagagtaaattgcacccatggtacaataactcggcaggtgggtgcgatataatgcaagatcttgcgaattgaacatttgagtacaataacttgacaagtgggtgcattctagtacaagaactacaatttatagtattttggtgcgtcaacttggctaagcatatgctaggtgagttttttcacgatgtcaatatgccattacacaatattcctacggatattaccttataatattgaatttaatcttcaagaattatactgcatatacaatttaatcttcaagtttttttttttttgctttcttcaccatctcaaatatcaaccgaaatataataattctacatccaattttattaactttcagttatcggttattagaataaatatataaatatgattatacaaatccatgctagaatatggtcaaaataaaaactcaaaaaattaaaatgctccaaataattaagttgtcatgtaacttcttaatttattgtatcaaaatcgtacctacttgcaagttgttgtatctatacgatcacttataaagttcttatactaaattacacctttctaccaagttgttgcactagaacgctcatttctcaagttattacaccaaattacaccacctatcaagttgttgcatgtaattactctacggagtatattttgtttgtacgataagatattatcaaattccgttgctatgtttgataagatattatggagcgacaggcctgtcgctccataatccccatacctaaacagagaaaagttcgcacttctccccctctcgcacgcgcctcgccgccgccgcatcgcatcccctcgtcgtcgcagccgctacctcctccgcttagtcgccttccccccaccccggcacccccaccttttctctccgcctcgctgttgcctcttccatgatgtccctagtgagagcacggcgagggcatctcctcagacctcacacatgccggcgagccgccatctgctcctcgtcgttgctggatggggaggaagaactcggtgacctcctcggcgcccacgccgtcgccgaacgccgatgaggtccagcaggagatggccgtgggccgctcggcgtcggccaggatccgcgaccgggcgtctcgttcgctgctggggcaggagccatacatgacaatgtaacttattcttctcatgattttgctgggtgaatagcaaatgattttgcttttttgctccagtaaatgggaaaattgctctggttactgagcaattagggagttgatctggttgattttgttttggtggaacatagaagaagctgtcggtggaagagaagtgcttttcactgcatagtagctgatttatgctagatttatgagcgcgcagctgttcttgagttttggccctcttgttcagctattcattcagaagctgtcaccgaagaaagttgttgagcttagactcactgatttataagcacattgctctgggaaaatttataagcacatagcgcctcctctgctcctcacattgctctggtaaaatttataaacataaaatttataagcttcctgtttagcaagcagactcatcggtgtgtcacattcagaagataccagcacattccaactggaacctagatctgttggcctattgcatcatgtacaggcaagtctgaaaactaaataagggtaaaaccgtcttttctcctctagttaacaccatcaagtgtaaaaactaatggaagtgctacatagggaagggaaattttgagggtgcatagatagagaacttttgaagtttgggtggtagagatagaagaacaactttttttttatactacatagggaattttctctacaatatatcagtttgcgaggggtacggcgacggagatagtggcaggcctgctcattggaggacagcacctcaccgtcgtcagagctcatcgttgctgcccagctcctcctactctctaggtcagcccaaacggatgattatcggctctgggttctctattcggaggcaaatgctggccaacattcaaagattcatctgctcggtaggcatttattttccatgtaaataaatcttcaaactctcttcatcgttgattgttaattgctttactgctttgaatgacacaaccagatttggagtacgaaaccacctcgccatcacaggcatactgcctgccatgtggacttcgattataaatctacctcgccatcgcgcccatactgttcggtgtggtgtcgatgctcctgttgagaagtagcgcaattggttggttgcttacttaggcttaatattgggttaatgtagatatgaccctatggccttttattgtctttattttaaaatatatatatatattctgaaatacaggaagtatattttgtcccaaactaaatacatcacagtaacagcatggttgccttttttcttagattattttttcttcaactcaacattagggaactacctgttggtattaaaattttacactaataattaaataagtcaacttataaagcgattcatataaggatgtaatctaactcaatttatttaaagattgttttgtgttgctcaaacctacaattatgatgcattaataattttgtacaagatcatcggcttcatgatatacacttatgtaagacttgtacatatcaatgtagtttttaagacatttatgaactgtgttttgaaacaatcatgttttcaaattatcaccttgcaataaataactattgctacctagcaaggtgagaatgtatagccacctcctcaaggatggttaaaaaaaagatcctttttacggttcttgtagagctacacatctggtttaaatttgtggtatctgctatcatccaggaggtatgatactatgtacatcttcgaggcctgtaaaaaggctttttgtttgtaaataatcaccttttctctatagaaatgtgatacatgccttaatttgtgtttacttgtactgatgatatctggtctttgtctaccaggattttatagtaataatggttaattatttgatgatttcatgtaatgatggacttagtcaattgcgagctataataagatgccaaaaaatccctatttttgaaaattcatgaggaaagcactttctaatttctgactcttaacacggtatttgtgaaatttcagctttgatctgtttgagaccaattaaactctactagcaaatttcatgcctgatgtcgacatcaagcttccatctgcttttggtatgccaacatttccttggatatttattatcataacatcatctcttcaagctcttaacaatttgatcaataggttataacttctatatagaatttacatttatcttttatttttgaattatattatattactctaagttgtatatgccaactaatataatattgatatccaattgcaggttatattattaattagaactatccgatttacctcatttctttattttgatttaggagtaactggtggtcttttctgagcacgactgaacccaccatttgataattttgaaatcttccctatacatccgtttgtggaagcaaatgctgaggactccagtgttggtgctggatcaaaggaatatgtgcacacgctcattcagtgtggcacaacggaagaaaaagactgattattgttcaaggcttgaagagagaatacagccagaacaaaatattctaggatctagaaaaggaatttggctgtaatgttactgtggtccatgattcagagctaggaggtacaaaatagcacgtatattgtgttgtatccaagttgtttggtgtgaatgtgtataataatgaatggtctgctatatatgtttgtaggtcattcagattcaaggtgatcaacgtaaaaatgttttgatatttcagtactttgaaatacatttccttgcagtacaatttgacaagtgtaattctctgcctttctgcatccatgttgagtcctatataaacggcaactttatgagttgactttgaaatttatagaactgactcatttgaatggtataattccataggtaacctgcttaatgatgagaaacatagatatcaacagttgatttcaatggtgtcacgtcctgataaattcatcccgaaataaaaatcattctctaaatggaataatagaattaattaaaattcgaaaagaaattagcaaacattaaaatgcgtacaagaaaatttcgaatgtggcccggagaattttcgttaaattctccttggtctaaaatgagccctcaaattttacttaaattttccgagcaccgaaaatatttattaagcaacaacaactattatcaaagtttattaaaaagaaaaacctaaaaataatcctccttcctcctttgggccaaatctggcccaaaatccactctctctctctcggcccacgcccaaagtccttccctcctccctctctttttccttctctctctcttgggccgccctccctccttcccctcggcccagctccctcctcctccctctccctcccgggctgcctctccctcctctcctcctgggccggctccgggcccaagccgagcggcgccctcccgcccgtgccgcgcacgtgcgtgcgctgaccgcgcgcctggccacgtgggtcccacgcgccgggtcgtcgtcctcctcccgcccggcctcctctctctctcccgaaaacctagcgccattcctccccaaaatccacgcgattcaaaccgggaattccaaaattgattagggggaattaatcccctttccttcctcttcaattccaccccaatttcccccttgattcgtgcccccaatcatcgagaatgcccgcgccaaccccggccaccttccatggccgctggccgccttttccaccgtcgtttcgccctctcccgtggccggctccctccccgcgcctataaaatgaaatcccctcgctccgttctatcgttttagccccctcccgcgctcccccgtcgcctcaccacccctccccgcctcctccctctctctctccgagcgccgaccacctccagccgcctctgctgtcgagcccgtgcgccggccggccgcgccatctcctccctcagcgtcgcacctgcttcccctccaccggcgtcgcctccgtttcgcgcggagaccaccggaggcgtgttcccgctggcgtccaatggcatcgccaccactgcaccacctcccgtcggccgttcgccgcgcctaaagcgttggccgacgctgctatcccctccctcggcacggtgacatcgccatcaaccccgaccgctgcccgtcttcgtccggagaccgccgccgccacgccggcctctccttcctcctcgtcaacatcggcttcggcagccacttccgccgtgcccatgcgccggccgatgtcaccatctccacctctggcattacagcggcaaggtcgccctcagcctcgcctccccttcgaccgaaccccaccggtgttcgtcgtcgtcgtctccgtccgacatcgccatcccctcctccggtcggccgttcctcctcgccggctcatcatctcgcggcgccaccctccgtcgtcggatttgcagtggcgtgttccgcgccgtcttcgcctccgtgcagctgctgccggaagcctcgtcgcctcctcgccggccccggtcgtcgttgcgtcgtcctctcgtcgttcccggtcgtcgtggtgttcgtccctccgtcaagctgttcgcgttcgtcgtccgcgttccgtcaagtgagccgctgcagccccgtcgttgtcttcgtcatcgcctccgcgtcgccaagcgttgcgccggccgcgtctcgccttcatgcaaggatcgccgccgaagtcgttccctcgccgttcgcctccgtcgtccccgagccgtctccgccacgctcgttcatcgttgtcgttcccacgcctcgtcgcgtggtggtaaggatccgtcctctcgctgccccgtcctagtcctttcggtgtcgcccgtgcccgttgtgcggttgttgaccccggtacccgtgtactggtgtcggtagtcgttcgcttgtgcgtgtggtgaccgtgttagtgtgcctgctcggtagccgcgtggtttccacgtgtgcaggccgtgtggtgtctcgtggagtccgtttgtcggccactcgcctcagttgacacacgggatccgcttccgtcgacccgtggaccgtctctgtgtacttggtctactgtggtcccttaggttgacttgtggggtccacatgtcaacggcgcagccttcttgtcttttccaggctagcgcttatatatgttttataattgcaaaacctaatcacaataatccgtaaatctccatgtaacaacattaaacttcggatgatcatatcttggtcatacgaacgccgaatcaacccgttcaagtctcctaatatttgttataacctaaagaaccgtgtgctttctttttatgtattgttattgcttctttataggcttgtagcttgtcttgtgtgcttcgcgtagcttctgtcgtttcgaaggttctcgaagcatggtttgcagtcgtcgccgaaggttcggaaggccgttctctctgagcaaggcaaatcgcatcatccttgagcacattgaatcccagtttataaaattattttgatttaaattaatgcattatcgctttatttaaattcccgcgttatcattgttttatttagccatgcctatttatctttggtacgaccttattattactactatcattatttttaccttgttcaccctaggaaaataaaaccccaactagtgggtactctatttatggttccactagtatgaatttaggtagatgcttcgctgtttaattaggcaacactaggtggttttataactttagactttgggaattctcatatcacttggatactatggaatggttggcttatggtggaattggacatacccctcttttcctctttcaaaacccctaaaacctgttttccggtggggtttgggtgcattccagttgtgggaagtagcaccccggccaatataaggattaagctcgggcctctattgcaaagcactaccgtactaaccacatgtctaatgggtaaggcttaactcggtactcagtctactcctgaacaaaaggacacgtatagagatggatgaagtcgttgcgacgatggatatctctgaggcaaatgaaggctacacgagctgtggctcggtaatcgagatgtctaggcaaatgaagactacacgggtcggtgcccgttagtcgagatgccatggcactggactagtacgcgggtggtctcacccctatgcgtgtggcgcacccggtctagatcctgttgctaggggctcaatcctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgtgccctcggatatgggcaatcctagcaatgtacccaagttagtggtttaattcttaaaatttgcttaacaactaaaatatggaatggttggcctgggttggcttgggacgagctgggacccagggcgggttgccagttcggtctgaatcatcgtaggccttgggttaaggcaggttcgtgtgggtccacggccttgattaataatactgtgtaactctaggatcgtctttataaaatagctttgggcaattaattgacttttaaatgctgtttactgccaaacttaacccctatattattaccccttgtacccccttgcattaatcatgcatctcccggtgtgacttgctgagtatggtggttgtactcattcttgctctatctttccccccttcagtaagagaagctttggagaagaagtcttaggtggagtcctggcttataccccagttgagcgcctgtgaagatggagccgtaggcccgctagtccgctgctgtttatttttgattgtcaggcctgaagtgcctttgtaataatgtaaatattatcgatataataaagatgtgccttttgtatcatatttgtttggtgtaccccggcttttcctgggacggggattaatacactagcgttcgggaaaaggcaattttctcggtcgcgacaagctggtatcagagccatctcgactgtaggataagccaagtggataaaacctaaggacatattttataaatgaaactatttgcgaaagttcctttttttttctccttccctaatgctatttgcaaaatgtttactcctttctttcttcttcggatttcaactagtactagttggtcagctttgtgaagaagaagatgtcgtcagttgtctgctgaagctctagaaggctgttggatccgttagcaaagcaaaggaagcagtgaagccagatgtgaagcaagagtgaagatcttggagaaccagtcacagaacctaagccgccctctagggtagtgtggttagtcgtgtgttcttttgcttgtgtgtgtagtgcgtggtttgcatcggtgggttgtgatgtaaccatgctaggttgtttgcttaatcaacttgcagaataagtgaaacaaacaacacatcaacaagaagagttagttcctttaaggtcttgtccctagttctggtctattctttccttgtatgcttcccctctcaacctctaccttgtgacagatggataacactggtaacaaaggctatgggaatgatggatccgatgactcaagaacccaagccaatgggaatgagaaaagcatcaacgaaacctcgccagagctaatccaaattgtggttaaccaaaccaacatcttggcaacagcatttcaactattacagaattggtacaacccagcaggggcaaccaacgttcaagtacctacagtccagcaacagtacaagttatcagaatttctcaaaactgagcctccaacctttgccattaccgtcgatcctatggaagccagtgattggttgcgcacagtcgagaagaagctggggttgattcagtgcacagaccaggagcgggttgtcttcgcaactcatcagttggttggaccggcttcagaatggtgggatagctacaaagcatcacgaccagaaggacataccatcacctggggcgagttttcagctgtattcaagagatcacatgttcccgcaggaatgatcacactgagaaaacgagagttccgctacctgaagcaagaagatttgaccgtcacagagtacctgcacgagttccatcgtttggcttactatgcaccagaagatgtggaaacggatgaagacaaacaagagaagtttctccaggggttaaaagatgagcttgtagtgcaactactcctagaggattatgaagattttgagaaacttgtggacaaagccatgcaactcgaaagtgagcataatcggatgacgaactgcaagagaaggattgtcaacatcccagtatttccactgagccacttcagatcaccggatcttctgttgcgcatcaagagttcctaccccaagaagatggacacaatgcagacaacaacattagcaatactaatgctgatgataccaccaacaaccatggttcttgccccattcatgaccacttggatcaagagtgcaatgtcaacagcattcaccaagatatcgatgatagtatcaatgaaggcacccagaatgacaaccctagcaattttgactctgagaaagactccaatggtgatagcaactatggtaccactgatgccaatgttagcaaggatttccaaccaccaattccaactccaagtcagaatgatcgttcccagacggacaactcagtaaagaagacattaatttgttacaactgcaaagaaccaggtcatttctccagagattgtccacaaccgaagcataacctgcgtcatcactctggccattatgcaagaagaagacaagtcactcgccttgtggtcactagagcaaacgccatacctgtgaggcctcgtgttaatcataacccatagcagaaacaatgtaccgatgctaagcacctttcctttttttaggcagtgcttagtattcatgtaataagggagaaatgtgtaatacagacaagatctatggggattcttttggaagatgcggatatgtgattatgtgcgtaattgtttactgacaaaggagacctagggtctcatatccgtaagctcataatctatgataaatcaagtaacctagttgttgatagaaaagaaaatgaagcgatctgtgttagattaaaaagccaaagagacttttgtttggactaagagtttcagatgtgtcttctttggatcaaaggcaacaaccgccagtctagcttttgacgaaccacttgaaggtttctctgaaaggcagcaggctcaagtaccacatcgtcaccagaatcatccacaactctcggagtgaagagtacttaattgacaaaggtcaaaagatgattgatagaagatatcgaaaaagatgtttattaccgggcaaagaagtaggtcgaaaggtgattgataagagaaatcgagaaagaacacatcaaggtaaaaggtgtaaaggaatacgttaaatgctaactgaggacaacatgaagagaatagtgggaagtgaacccaatgtaaagaaagtgaatccgagttgcttgttcgtgagagctattcccagttatgaaccaagtgatatgttcaaagataatctacagagtcaagattaaaaatcacatccaacaaagaagtttcagatttggcaggtcaataatcagaaaaatacaagtccagcagtaaagacatttgggaagacatcaaagcatgtcgagtgggataagttggttctcttgagaaacataattcaaagttagaatggtcgaccctcgcggcgattagcagaagtttctagcacccggagaccaggaaagctaaaatgaggcagttagtggcaagttgtcaatcttggtacccttggtaagtgggatatcatagtcgaaagcatttggtggtaagctggaaggaaacgccaagcatggtattctcatgatgacaagcatggtatcctagtaatgacaagcaggtatcgacgtataacgtgaagtgggtaacttgtatgaggttgacaccaaggatatgaactatgagaagttctggaacggaagcatcattaaactaccgcaacctagtctgagtcagctaaaaggtgcgccctggttcaagtcaggtgaagagaagattccatctgcaacaaaagatcgagccaagcagtccagagtggagaagttttgctgggtaagtttgttatagaagacgcaacggaagaagtcagaaaagaagagaaaaccgcccaacctatcttcttgctagcctcctcgaatctcggggacgagattcctataaggggggtggatttgtcacgtcctgataaattcatcccgaaataaaaatcattctctaaatggaataatagaattaattaaaattcgaaaagaaattggcaaacattaaaatgcgtacaagaaaatttcgaatgtggcccggagaattttcgttaaattctccttggtctaaaatgagccctcaaattttacttaaattttcagagcaccggaaatatttattaagcaacaacaactattatcaaagtttattaaaaagaaaaacctaaaaataatcctccttcctcctttgggccaagtctggcccaaagtcctctctctctctctctcggcccgcgcccaaagtccttccctcctccctctctttttccttccctctctctctcttgggccgccctccctccttcccctcggcccagctccctcctcctccctctccctcccgggctggctctccctcctttcctcctgggccgcctccgggcccaagccgagcggcggcctcccgcccgtgccgcgcacgtgcgtgcgctgaccgcgcgcctggccgcgtggatcccacgcgccgggtcgtcgtcctcctcccggccgggcttctctctcttctcccggaaacctagcgccattcctctccaaaatccacgcgatccgggaattccaaaattgattagggggaattaatcccctttccttcctcttcaattcccccccccaatttcccccttgattcgtgcccccaatcgtcgggaacgcccgcaccaaccccggccaccttccatggccgccggccgccttttccgccgccgttccgccctctcccgtggccggctccctccccgcgcctataaaatgaaatcccctcgctccgttctatcgttttagccccctcccgcgctcccccgtggcctcaccacccctccccgcctcctccctctctctctccgagcgccggccacctccagccgcctttgctgtcgtgcccgtgcgccggccggccgcgccgtctccttcctcggcgtcgcagctgcttcccctccaccggcatcgcctccgtttcgcgcggagaccaccggaggcgtgttcccaccggcgtccagtggcatcgccgccactgcaccgcctcctgtcggccgttcgccgcgcctaaagcgttggccgacgctgctgtcccctccctcggcacggtgacgtcgccatcaaccccgaccgctgcccgtcttcgtccggagaccgccgccgccgcgccggcctctccttcctcctcgtcgacgtcgccttcggcagcccctaccgccgtgcctgtgcgccggccgacgtcgccatctccacctccggcatcgcagcggcaaggtcgccctcggcctcgcctccccttcgaccgaaccccgccggtgtttgtcgtcgtcgtctccgtccgacgtcgccatcccctcctccggtcggccattcctcctcgccggctcatcatctcgcggcgccaccctccgtcgtcggatttgcagtggcgtgttccgtgccgtcttcgcctccgtgcagctgctgccggaagcctcgtcgcctcctcgccggccccggtcgtcgttgcgtcgtcctctcgtcgttcccagtcgtcgtg

SEQ ID NO: 442 - DNA, 3965 bp, Oryza sativa
atggagccgtaggcccgctagtccgctgttgtttatttttgattgtcaggcctgaagtgcctttgtaataatgtaaatattatcgatataataaagatgtgccttttgtatcatgtttgtttggtgtaccccggcttttcctgggacggggattaatatactagcgttcgggaaaaggcaattttctcggtcgcgacaaatggtcaaatcaaactcaaataaaaaggtcaagctcccttcgacgatcctcgttgatcagccgtacaaacatcatacatggattaggaaaccgttgcgccgctcagtttatccataaaaattagcatatatggggacaatattgtctaatagaaaatgtctaatagaattcaacttttcttgaggaaaatgtctaatagaatagaacaaatcactatagatatcatcgaaataatctataaatattacgtgcatgcacaagctgtaaaaaatatcaaccctgctatccgtccgacgcaaatcatccgactagcatccgactgaaacggcgacaacgaacaacatgacggcgtgagacgactctattatctatatatgaatcggtccaacgccatgcaagcagcccattcctgcacggctacaccatatgcaagcccatatacaagtctagactccaagcccaaactcaggaagactccacgacacttctgccggagttttggtcgatctgaatcactgcgtgctaacttcaatctcaacgttctcttgtaatgttttcacagctgcagctgctcattttccagacaagtttttttacccttttaatatactcctctgtttcaggttataagtcgttttgacattgatcaaagttaaactgtttgaagtttgacaaagtttgtagaaaaagtagtaacattttcaacccaagatattgtaaatattactatatttatctataaacttagttaaatttaaaatagtttaacttttaatcaaagtcaaaacgacttataatatgaaacaaaaatattttttttgaagcaaatgacagcaggagatctgctggatatattagaagtattagaaataacaggttggtatataccacagtttcaagttctatttttatgcctataacaggttgcatttaacaaaatataaggctgtgtttagatcaaggggtgcaaagttttggcgtgtcacattggatatgtaggcatacatttaaagtataaaacgtagactagtaacaaaaaatttacataatccacttgtaaattatgagacgaatttattaagcctaattaatccgtcattagcaaatatttactgtagcaccacattatcaaatcatggactaattaagcttaaaaaattcatctcgcaatttacacgcagtccgcgtaattagttattttttttgtctaaatttaatattacatacatgtgtcaaacgttcgatgtgatagggtgtaaagttttggcattagatctaaataggccctaaatgcagtgatgtccaaaaccacaagcatagtttctaatttgtcacgaccggaaataacccaacgggcattccttacgtgcgtgcattattccttgtcccaggaggcaaggtacaccaaagttgatacaattcagagtttaacaagcggaagcgtaattaattaatttattacatgggcggcgaagacccagcacacacaaagacaaacgaaaaacagcggaagactagggcgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggggttataatataagggttagggtttgcagtaaacagcattaaaagacacttagttgctcaaagctattttgtgaacatggtcctagagctatacaatattattaaccaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaattaaaacactaacttgggtacattgctcggcttgcccataactgagggcgcggctattcgaatagattatactctgatcagaggtgtacatctttacccacaagacacatcttcctcacgtgtaaccacgtgccacataccaccacggtatacggacggaagacatgacatagtttccaacccatcctagccataacaagagtaccgacccaacccacctacgggcggaacccccgggacaggtaggccaggactgagcccctaacaacaagacaccggccctgggccatgacatttcgactaccgggccgcagctcgtgtagccttcatttgccctagagatgtccatcgacccccgacttcgtccatctccatccgggtacttttggttataaccagactgagccacaaactaagccttacccactagacatgtggaagtacagtaggtgcttttttggggccaaacagaggcccgaagaccggtccttatatggccgtggtgctactatggccgtggtgctacttgtaacaccatgcaccccgagcccagcctaaaaccattttgagggttttgaatagaggggaaggtgtgaatccaattccacaataatccaaccattccatagtgtctaggtgataagagtattcccaaagtctagagttgtaaaaccacctaatgttgcctaattaaccagcgaagcctctacctaaaatcatactagtggtaccatgagtagagtgtccactagttggggttttgtttattctagggtgaacaaggaaataataacaataacaataataaggtcataccaaaggtaaataggcatggctagataaaacagtgataacgcgggaatttaaataaagcgataatgcaataatttaaatcaaaataattttataaactgggattcaatatgttcaagggtgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcataaggaaaaattagagacttgaacggtccaattccgagttcaaatggccaagttatggtcatttgaagtttatatgctctttaaatgaatatttgcgaatttcttcatttaaaatttaatttaaaaagggtttattgcgtcagccgaggggagggggcgcgcggaccgggtccacgggagtggggcccacgcggcagcctcacggtccacggtggaccgggtgcacccgggctcacaccggccggcgccgtgggtcccacgcgtcagccgcacccgagggcgcgggcggctgacggccgggccccacgcggcagccactcggcgcgcccgagggcggccacgccagcgcggtcagcatgaggcggcgcgcccgcgccccgatggtcgccgccggcgaccaccggcatggcggagcggcggccgagagaggggagggaagggggaaaggaggcgacggccccacgactcaccccggggcgacggcggcgatgagggaggcgcccggaacgaaggtaggcggcggcgcggctcgggtcgacggggtcgacggcgttccggatcgggtcgatggggtcgacggcgttccggcggtcggcgaccgacacggagaggtggacgaggtgggcgaggatgcggcgaacccgtaggaggcggccccgaggtgggaggtggttcggggcgacgacggcggcggaccggagctcggcggcgacggcggagaga

SEQ ID NO: 443 - DNA, 5006 bp, Oryza sativa
attgcgtcagccgaggggaggggccgcggggaccgggtccacgggagtggggcccacgcggcagcctcacggtccacggtggaccgggtgcacccgggctcaaaccggccggcgccgtgggttccacgcgttagccgcacccgagggcgcgggcggctgacggccgggccccacgcggagacactcggcgcgcccaagggcggccacgccggcgcgtcgccgccggcgaccaccggcgcggcggagcggcggccgagagaggggagggaagggggaaaggaggcaacggtccacggctcaccccggggcgacggcggcgacggaggtggcggccggagcggagggaggcggttgcgcggctcgggtcgatggggtcgacgacgttccggcggtcggcgaccgacacggagaggtggaccaggttggcgaggatgccgcgaacccgaaagaggcggctcccaggtgggaggtggtcctgggcaacgacagcggcggaccgaagctctgcggcgacggcggaaagagagagtgacctcgcgagctcgaattctgccaggaggaaaggcggcgagaggccgaaaccgaccgaggaggtgcgaggaggttttaaatagggtttgaagggagagagagtggccggaggggaaggaaaccggcgcgggaggtccggccgccatcaatggcgccggcgagatttgcgggggcaaatccgcccgtttgaacgcgagagagagagggaaaaatggggggaaagggagaggggatcacggggagtaattccccccactttattgcacgcggggacggcaggaggcggcgggattcacggcggcggcggcgctagggcgcgggggaggcggcgggagcggctggaggaaggggatgacgggtgggccccacccgtcagcgaggagagatgggccgggccggcccaagggagggaagggggacttttagggtttttctttttataaaatcattttaactttgtttatttcttaacaattattatttgtgctaccagtcaagtccagaccacgacggttgatgctgccggccatctacaaacaaaaacaaaagagaaaagcaacattttaaaggtcagattttgacgataaatgaagcagcaggatagagagagactagaggattttcacaaataagaaaggatttttatttcgaaaatattgctaaggctttggatctaaggctcgtcctagggtcaagggggctaaccaaagggtccgctacgccaatccctatccagggggatcctcctcgcagcagcagaagcagcagcaaccacgctccgcgccccgacctcaattcttggtgagcgtcccacagccgcagcaacagtagagttagcaagggacccgtgcaccccgtcctcctgcgcccgttgtgcagcctggtcaaggccgcagagacgttcaaggtcagcagcgtctgtgcttcaactgcttcgagcccgggcactttgcggataaatgcccaaagccgaggcgccagcaaggccaagcgcctccccgccccaacaacggtggtaaggatgtcattcggggtcgtgtgaaccacgtgactgccgaggatgtgctgacaactccagacgtcatcgttggtacgttcctcattcattccatccctgctaccattttgttcgactctggagcttcccacttgtttatatttgtgccagtcgtggggagaaatcagttggggtagaaaggcttaggaactctctgctcatcaccacccctggaggggttatgacagcaaagtattatagccctgccgttcctatagaaatccagggaattccttttccctcggatctgattcttctagacaccaagaacttggatgtgatcgttgggatgaattggttggctcaattccaaggagtagtggattgcgcaagacgcactgtcactctgtaccgagggccggaacaaccggttgttttctttgcacccccaacctctgtcggcagttcagaacttcatcagataggactgtcagaaatccccatcgtcagtgagttcggagatgtgtttccggaagaactacccggtatgccgcccaagcgagagattgagttctggatagatcttgctccaggaaccactcctctgtacaagcgaccctaccgtatggcagcaaatgaactggccgaagtcaagaaacagttggaagagttaaaagaaaaggggtacatatggccgagcacttccccctggggtgctcctgtgatttttgtggagaagaaagacaagacaaagaggatgtgcgttgactacagagctctcaatgaagttactatcaaaaaacaagtaccctcttccccggatcgatgatctgttcgatcagcttaaaggtgccacggtattctccaagattgatcttcgctccggatatcaccaattgcgtatccgtgaagaagatatcccgaagaccgtattcaccacgcgttatggactgtatgaattcacggtgatgtcgttcgggctaaccaatgctcctgccttcttcatgaacttaatgaacaaagtgttcatggtatacttggataagtttgttgtggttttcattgacgacattctggtgtactcacaatcagaggaagaccatcagcaacatctccgtctggtgttgggaaagttgcgggaacatcaattgtatgccaagcttagcaagtgtgagttctggttgtccaaagtcaaattcttagggcacgtgatatctgctaaaggagttgctgtggaccccgaaacagtgaccgccgtcacagattggaagcaacccaagacagttacccaggttcgcaactttttgggtttggcaggatactaccggaggttcatcgagaacttctccaaaatcgctcgacccatgacacagttgttgaagaaagaagaaaaatttgtgtggagcccgcaatgcgagaaggcgttccaaactttcaaggaaaagctggtttccccgccagttttaatcttaccggatactcgcaaggacttcatggtgtactgtgatgcttcgcgccaaggattggggtgcgtgcttatgcaggaaggtcatgtggtagcctatgcctcatgtcagctatggcctcatgaaggcaactaccctacccatgatttggagttggccgctgtggttcatgctctaaaaatctagcggcattatctcattgggaatcgctgcaaaatatataccgatcataagagtttgaaatacatctttacccagtcggatctgaatcttcggtagagaagatggttagagctcatcaaggattatgatgtgggaatccactatcaccctggtaaggccaacgtggtcgccgacgctctaagtcgaaaaagctattgcaacactcttggcgtccgtggcattccaccggaacttcatcaacagatggaagccctgaacctaagcatagttggtcgtggattcttggctacgctggaagccaagcctaccttgctcgatcaaattggcgaggctcagaagaatgatccagatatgcatgggatcctcaagaatatgaaatagggtaaagccgctggtttcacagaagatgaacacggaaccctatggaacggaaatcgggtatgcgttccgaacgacaaggaacttaaacagttgatacttcaggaagctcacgaaagtccctattccatccaccctggcagtacgaagatgtgcttagacttgaaagaaaaatattggtgggttagtataaagcgggaaattgcagagttcgtggccctttgtgatgtgtgccagcgtgtcaaggcagagcaccaacgaccggccggacttctccaacctctacaggtaccagaatggaaatgggttgaaattgggatgaatttcatcaccggacttccaaaaacccaaggctgttatgactctatatgggtagtcgtggaccgactaaccaaggtagctcggttcattcccgtgaagaccacctatggagggaacaaactagctgaactctacttcgctaggatcgtgagtctccatggcgttcctaagaaaattgtatctgataggggaagccaattcacctctcatttctggaagaagctccaagaagagttgggtacccgcttaaatttcagcaccgcgtatcacccgcagacagatggatagaccgagcgtctaaatcagatcctagaagatatgcttcgcgcatgtgtcctagattttgggaagacatgggataagagtctcccctacgccgagttctcctacaataacagctaccaagccagcatacagatggcacagtacgaagcgttgtatggccgcaaatgccggacaccactattgtgggaccaagtcggggaaagccaagtgttcgggaccgacatcttgagagaagctgaagcgaaggtcaggaccattcgggagaatctaaaggtagcccagtctcggcagaagagttatgcagacaaccgacgccgtgacctggaattcgcagtggatgactttgtgtttctccgggtcacgccgttgcgaggcgtacactggtttcagacgaaagggaagctcgcacctcggtttgtgggtcctttccgtatcattgctcgacgcggagaagtcgcttaccagttagagctgcccgcctccttgggcaacgtgcatgatgtgttccatgtgtcgcaactcaagaaatgccttcgagtgccgtccgagcaggccgactcagagaagattgaagttcgcgaagacttgacctacgtggagagaccagtgaaaatcctggacaccatggagcgcaggaccaggaaccaggtaatccgtttttgcaaggtccaatgaagcaaccacgccgaggaagaagctacttgggagcgtgaagacgagctgaaggcagcccatcccgatctcttcgccagttcttccgaatctcggggtcgagattccgtttaagggggtaggtttgtcacgtcccaaaacgaccctaaaatatatcctctaaattatgccta

SEQ ID NO: 444 - DNA, 652 bp, Oryza sativa
cagttgtaaacttggtttattatactctcacagaagtagacaaactgcataccattctgctgtcccgtaacataattattactttggtacaagaaaccaatgcttctaaacatagaagcgctacaaacacaaccgcgatctgctacgtgtatcgtatgctgatcgcggattgttatggaactggagatacagattacagaccggctacaataacacttaagatgcccccgtgcccacatcaactctgcaccttacgggaggaaacgacgcctggtgccgcagaagcgtgcctatctgccatggatattaccttcagcaatttgaccgggcacttatctatgcaaatatgcaccaggatttacccatgcatctatcgactacttaggctcatcttgatttattaatctccaaataaagtagtgagcagcaggtcttgcacaaatgttgctctgacactcgcttgcttccgtttctgttccctttcttcccttgtgagggatgagtcaatactgcaaatgaaaaaaaaaaattagcagatcattcaactgccaaaatttgaaatttataatgtatacctcccaaatagtcctaacatgcaggaagccatacagcagcttgttgctacacgctactcatcagtcaaacaacttgc

SEQ ID NO: 445 - DNA, 11996 bp, Oryza sativa
atcaaccccggatttgtccatctcaatccgtgtacttttgtttataaccagactgagccacaaaataagccatacccactagacatgtgaaagtacggtagtgctttgcaccaaaggcccgaagaccggtccttatatggccgaggagctactgtcaaaaccatacaccctgagcccagcctaaaaccattttgagggttttgaatagagggggaggtgtgaatccaattccacaataatccaaccgttccatagtgtccaggtgataagagtattcccaaagtctagagttgtaaaaccacctaatgttgcctgattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaatgtcacatcctgatttttgtttcaggatttataaatcatttaataaattattattagaatttatattaaatgttctttaatttacaagtgaagttaaatgtgggaaataaaattttctaaatttaaagcatggatggatttaatttttattaaattctccatgattaagtcaactctctgaaatattctcggatttttcagagctcaattcctaaatgatacaaagaacagttcagtaattatttgatcattaatgatctaattagaattgttaagagcttttcttgtttaaaaaaaatccttaatttataaatttttgtttaattggaattattagaatttattttaaaagcttagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaatagaaaaaaggttttaaaatcctccttttggctttgggccgaaagtcagcccaagtctctctttccttctccctctctcctccccggcccagtcggcccagtccgccgcgccccttcctcctctctctcggccgctgacaggtgggtcccacctgtcaggttcgtcttcctcgctccgccgccgccgcccgaaccctagtcgagccgcgctgccgtctccttccaaatttggccgcgcctttccttctccggtgaaatctttagaggggaaatgatctccgggatctcctctaccttttctcttttggaatcgtcggctaatttcctttggaaataggcggattcgagtttgattcggattcgtgtttccccaatctttccttccgatgccggtcgccgtgggctttcgccgccgcgccctagcccctttaaaaggacccccgagctcccctctatccgccgtcaccctcgccgtcggaagagccctagcgccgtggacctcgctccgccgtcgtcgccgtcgctccagccgtgcttcgccgccgttccggtcgtcgtcgtcgctcggggaggtcgccatcgtggtcgccaagttgtcgccgtcctcgtccgcctcttcgccgtcgctgtagaccgccggagcaccgccgtcgtcgtcaagccgaaggtcgccgccgcttcttcctcgtcgccgtcgtcgtccgttgctcctccgccgttgctttggtcaccggtgagttcaccgcgatgcccgcatcgtcctggtgccctccgttcgtgccgaagcgccgtcattcgccggcgagcttgcgcgcccgagccgccgagccgccgccggtggtgacgtcaccgctgacgtcatcgtggccgtctgccgtgagccgccgtagacccgatcgatctcggccgtccgttttggatggatcgatctcggccgtccgtttccgtgaaccgctgccgtgcgcccggtccaccgcaaaccctagccgctgacgcaataaaccccttttccttttcaaaaataattcattattgcgtcataattcaattaaaatccatataagtgttttaatccgatttaatctttaaaaattcataactaattcattgtaactcagtttaatgtggttcaagttgcaaaagttgtataaaataaagatctacatattaaaattatccataaattgaattaaatttatttaattctttttaaatgcgctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgtgtgttagcttgtcgtttccgtcggtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggatattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaaataattacttgccaactaaaatatgataaaggtgggttgtgagcacatggttttgagagtcgtgctcatggcaattaaggaccggttcgcgagctactgttgtgaaacattaaccgtgccaaccacaagccagcgtgggcaacggctttaccttttgtatagcatggttcattgcagagcaccagactgagaagtggcggagataagcccacgggggtcgctagggagtccatgccttgtttataagggggtgactatgatccgggaacggtgcactgtggtgggttgtgttatgcaaggggtaatgtcacagctcctttccgaggtaccgtggtggtactgaggcacatgctgacatgttgtgggactgtgtcttgtgggtacagtggtacacctctggccagagtaaaactattcgaatagccgtgcccacggttatgggcgggttgagcaatgtttttcgtgattagtcccacacctctcacaataattatggatgttatatctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgataaaagctgcttttgcaaatgagcctatattatgccatcctttggtatccttgtgcacttgcatatttgctgtgtggcttgttgagtatgtcatatgctcactcttgcaataatcaatcaacctcagttgaagaaaaaggatccagaaggagaagacgtttggcttataccccagttgagttgcctgtgggagtggagccggagcttcgctagattttattttccgctgcagttttcttcatggtgaggactaagtgcctctgaagtaagtgtttattgttttagttaatttgatgaatctgtatattaaattgtcagtttgtgtacctcggctgattcctggacgaggattttttgcacaaataagttcggaaattactagtgaatttccgggcgtgacaagttggtatcagagccatcttgactgtaggataagccaaatggtcaaaccttaaggactaattttccgaaaaaatgatttgtgaaaatttctcctttcttccttatctagaattctttgcaaattgtttcattgtctactcccctctctctttcaacttgagttgttctaagacattgaaacttgaagacgccaatgaggtctacttatggaggttaagaaaagtggatcgaggaaggaccgaagtgccaagtggacaagatggaatgaagtttggatcctaccttagaacctatgccgccaaactatcctcgaagaatagttagtagggtagaacgtttgttgtttgctttgtgtgtaggtatggttgcattcccatcattggagtagttcattgatgagtgtgtaactatactaggttgcttgcttaatcaacttaaacaatataatggtctatacacatcagatcagtgttaacctggttaaggacttgtctttagtgtaacccctctcctcctatcttctctaatctgcaacagatggtaaacactcacgccagtggaagtggaaacaataacaatgaagggaacccaactcttgctcaagttcttgctcaacaaactcagttaatgaacatgatgatacagcagatgcagaaccagctcaaccaagggaacaacaatgctccaccgccgcagaacaagtcaactgattttcttcgtgtgaggccacctaccttttctagcactaccaacccagtagaagcaggtgattggctacacgctgttgagaagaagttggaactgctccagtgcacggatcaggagaaagttgttttcgcttcacatcagttgcaaggatctacttcagaatggtgggatcatttccggatgaacagagcagaaggacaaccaatcacttgggcggagttcacggaggcattcaagaagacacacatacctgcaggagttgtttctttgaagaagcgtgagtttagggcattgaagcaaaaggatcataccgtggcagagtatcttcatgagttcaatcgtctggcacgttatgctccagaagatgtgcgtactgacgaggaaaggcaggagaagttcttggaaggtctgaaggatgaactgtcagttacgttgatctcccatgactatgttgattttcagcagctagttgacaaagcaattcgacttgaagacaagaagaacaggatggataaccgtaaaaggaaaatgactgtattccaggaggcacaaggtagtagccagaggcagcgtatcaagccactccaaattggtgaatcttcttccgctggtccaggatagtcgcagcagttgaacatcggtggtgagatcaaatcagagactaatgaaagcaatgaggttaacatcgagcaagctaatcatccggtgccagttcagcaggatcagtctcaagagaataacagtagtggaagggagcagcaggtatgtttaaactgttacaagccaggccactttgcaagagagtgtccgaagccaaagcatcagcagccgcaagtcaacaacattgtcgtcacaggagccaatgcagtgccagttgcgtcttcaagagttgcgtcttcaagtgttacaactcagccaccagtttcaaagcggcagtagttttctttaaagccttagaataattatcggagttatggaataagatagactgcagtttacctattccctttttctttctagccgttccgaatctcgggacgagattctttgtaaggggggtagatctgtcacatcctgatttttgtttcaggatttataaatcatttaataaattattattagaatttatattaaatgttctttaatttacaagtgaagttaaatgtgggaaataaaattttctaaatttaaagcatggatggatttaatttttattaaattctccatgattaagtcaactctctgaaatattctcggatttttcagagctcaattcctaaatgatacaaataacagttcagtaattatttgatcattaatgatctaattataattgttaagagcttttcttgtttaaaaaaaatccttattttataaattgttgtttaattggaattattagaatttattttcaaagcttagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttcatgaattgctctttaaatgaatatttgtgaatttattcatttaaaatttaatttaaaaagggtttattgcgtcagccgatgggagagggcgcgcggaccgggtccacgggaatggggcccatgcggcagcctcacggtccacggtggaccgggtgcacccgggctcacaccggccggcgccgtgggtcccacgcttcagccgcacccgagggcgcgggcggctgacggccgggccccacgcggtagccactcggcgcgcccgagggcggccacgccggcgcggtcggcggaagccggcgcgcccgcgccccgatggtcgccgccggcaaccactggcgcggcggaaaggtggccgagagaggggagggaagggggaaaggaggcgacggtccacggctcaccccggggcgacggcggcgacggaggaggcggccggagcggagggaggcagcggcgcggctcgggtcgacggggtcgacggcgttccggcggtcggcgaccgacacggagaggtggacgaggttggcgaggatgcggcgaacccgaatgaggcggcgccgaggtgggaggtggtccggggcgacgacagcggcggaccggagctcggcggcgacggcggagagagagagcgacgtcgcgagctcgaatccggcgaggaggaagggcggcgagaggcggaaacggacggaggaggtgcggggagggtttaaatagggttggaagggggagagagcggccggaggggaaggaaaccggcgcgggaggtccggccgccatcaatggcgccggcgagatttgcgggggcaaatccgcccgtttgaacgcgagagagagagggaaaaatggggggaaagggagaggggatcacggggagtaattccccccactttattgcacgcggggacggcgagaggcggcgggattcgcggcagcggcagcgctagggcgcgggggaggcggcgggagcggctggaggaaggggatgacgggtgggccccacctgtcagcgagggtggcgggcgggcccgcccgtcagcggcgtgcgcgcggggagaggccggatgggccgcggggagaggagagagagaggggggggaggagagatgggccgggccggcccaagggagggaagggggacttttagggtttttctttttataaaatcattttaactttgtttatttcttaacaattattatttgtgctctgaaaattccactaaaatttatttacgcattttaggcttttaggaaatatacaaaaatcctctaagccttatttgacttttaaatttgcacattttaattgttggaggctttcacatgaattttaattattctcggcacaatttcgaggatgtattttagggtcgttttgggacgtgacaaacctaccccccttaaacggaatctcgaccccgagattcggaagaactggcgaagagaccgggatgggctgccttcagctcgtcttcacgctcccaggtagcttcttcttcggcatggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaagacatttcttgagttgtgacacatgaaacacatcatgcacgttgcccaaggaggcgggcagctccaactggtaagcgacttctccgcgtcgggcaatgatacggaaaggacccacataccgaggtgcgagcttcccttttgtctgaaacctgtgtacacctcgcaatggcgtgacccgaagatatacaaaatcgtccactgcgaattccaggtcacggcgacggttatctgcataacttttctgccgggactgtgccacctttagattatcccgaatggttctgactttaccttcagcttctctcaggatatcagtcccgaacacttggcttttccccaacttgatcccacattagcggtgtccggcatttgcgcccatacaacgcttcgtaaggtgccatttgtatgctggtttgatagctgttgttgtaggagaactcggcataggggagactcttatcccaggtcttcccgaaatctaatacaatgcgcggagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatatgattttcttgggaacgccatggagactcacgatcctagcgaagtagagctcggctagcttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactgacccaccagtatttctccttcaagtctaagtacatcttcgtactgccagggtggatggaataaggactttcgtgagcttcctgaagtatcagctgtttaagttctcggttatctggaacgcatacccgatttccgttccatagggttccgtgttcatcctctgtgaaaccagcggctttaccctgtttcatattcttgaggagtccatgcatgtccgggtcgttcttctgagccttgcggatttgatcgagcaaggtgggcttggcttccaacgcagtcaagaatccacgactaactatgcttaggttcagggcttccatctgttgattaagttcgagtggaatgccacggacgttaagagtgttgcagtggcttttccgacttagagcgtcggcaaccacgttggccttaccaggatgatagtgaatccccacatcataatccttgatgagttctaaccatctcctttgccgaagattcaggtccgactgagtgaagatgtatttcaaactcttatgatcagtatatatttcacagcgattcccaatgagatagtgccgccagatttttagagcatgaaccactgcggctaactccaagtcatgggtagggtagctgccttcatgaggccgtagctgacgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttgaaacgccttctcgcattgtgggctccacacaaatttctcttctttcttcaataactgggtcatgggtcgagcgattttggagaagttctcgataaacctccggtagtatcctgccaaacctaagaaactgcggacttgagtaactgtcttgggttgcttccaatcggtgacggcggtcactgttttagggtccacagcaactcctttagcagaaatcacgtgccctaagaatttgacttcggacaaccagaactcacacttgctaagtttggcatacaattgatgttcccgcaactttcccaataccagacggagatggtgctgatggtcttcctctgattgtgagtatattagaatgtcatcaatgaaaaccacaacaaacttatccaagtattccatgaacactttgttcattaagttcatgaagaaggcaggtgcattggtcaaaccgaacgacatcaccgtgaattcatacaatccgtatcgcgtggtgaatgcggtcttaggaatatcttcttcacggatacgtaattggtgatatccggaacgaagatcgatcttggagaatacagtggcacctttaagctgatcgaacagatcatcgatccggggaagagggtacttgtttttgatggtgacttcattgagagctctgtagtcaacgcatatcctcttcgtcttgtctttcttctctacaaaaatcacaggagcgccccatggggaagtactcggacgtatgtaccccttttctttcaactcttccaactgtttcttgacttcggccagttcatttgctgccatacggtagggtcgcttgtacagaggagtggttcctggagcaagatctatccggaactcaatctctcgcttaggcggcataccgggtagctcttccggaaacacgtctccgaactctctgactatggggatttcggatagtcctatctgatgaagttctgaacttctgacagaggttgggggtgcaaagaaaacaaccggttgttccggcccttggtacagagtgacagtgcgtctcgcgcaatccactactccttggaattgagccaaccaattcattccaaggatcacatccaagttcttggtgtctagcagaatcagatccgagggaaagggaatcccttgaatttctatagggacggcagggctataatactttgctgtcataacccctccaggggtggtgatgagtagagggtttctaagcctttctactcccaactgatttctccccacgaatagcacagatataaacgagtgggaggctccagagtcgaacaaaatggtagcagggatggaatgaatgaggaacgtaccaacgatgacgtctggagttgtcagcacgtcctcggccatcacgtggttcacacgaccccgaatgacatccttcccaccgttgttggggcggggaggcgcttggccttgctgacgccttggcttcgggcatttatccgcaaagtgcccgggctcgaagcagttgaagcacagacgctgctgaccttgagcgtccctgcggccttgaccaggctgcacagtttgcgtaggaggacggggcgcacgagtcccttgttgattctgctgttgctgcggctgtgggacgcgcaccacgaattgaggtcgaggcgcggagcgaggttgctgctgctgctgttgctgctgcgaggaggatccccctggatagggattggtgtagcggaccctttggttagcaccctgttggttgcggaaattcgccaagcggcgcttgtgcgactccagttccttgtgcttggcttccaagcggatgctcttgtccaccagacgttggaaatccggataatccccagagactagacggacggacagctcggggtccattcctgccaggaacttctcttgcttctcctcatcttcccgcacatcctccggagcgtaacgggccaggttgttgaactcatgcaaatactccatcacggagcggttgccttgcttcaactctcggaattcccttttcttaagggccacgactccagcgggcacatgggtcctccgaaaagcggcggtgaagcgagcccaagtaataggctgtccctctggctgcgtagcctggaaatggtcccaccatagagatgcgggtccctgcagctgatgggcggcgaagatgactttctcctcatcgctgcactgcacagtgtctagctttttccccacggcatgcaaccaatccaacgcatccacggggttgttggagctagagaaggtaggtgggcggatgcggaggaactcggcgagtttagagtgttggggaggtggtggtggggcattctgttgtggcggattttggaggtggtggaggaaagcagtcatcatgttggcctgctgggcgaggatttgggtgagaatggcgttggtgtctggtggtggtgg

SEQ ID NO: 446 - DNA, 8080 bp, Oryza sativa
cagagaaagagctaacaattaaaactaaccacccacgactaccataatttttgaatttattactgctattaaattggttcattaatgttcaagttgcttaggcgaataaaataagacaggctccgacacagttatgccacacaccggcataaccatgccccacacgactcaaaaagacaaacgagaaagaacacacgcgcaagcctactaactgctcgtctactgctgcgacgggccaggacggaaggtgagcaacagcgcatcctccgtgctaccgacgccggaggcttccccctcctggggaaccacgggcgcgggctcggcacgaggggtctcgatgaagcaagtccacgccagggactgacgaacaagctcgggcctggaggtgctcttgcgggcggtgatcttctggctgcggcagacgcggcgacgcttggggcgacagacctttccctgggcgatcttgagctgatgcagctgcgcctccaccgcgtctaggtccttcttgagctgcaggttctcctggcgcagttccaggatcttcatgttgttctcgaccatcccgcgacgtaccatctggtggaagtcgatacgagccgcgttgtacgcctccaccatccgcgccaggtgcacgatggtagcgtcatcctctgagctagcatcccggaaggtggcgtagtcgcgggctcctccgcgacgagggtggtagcggtagggcgagtgttgcaactcgtccgggtagcgctggtgaagagtgccgatggcgaggagagcggcgttctggcaagcggtggggaaggaatctccacccgcggtgactgccagcgaagtccgctcgggagagccagagaggatcactgcagtgacctcccaaccagcgtggggctctgcatcgtcaccctcctgctccggaagcggcctggcctggtagtccactccgtgtggataccccagaaccacgcacatgccccgcaactccaagacgaagccagtcatgtccaaaccacgacgggtgacgctgccggccatctacaaacaaaaacaaaaagaaaagcaacattttcaaaggtcagattttggcgataaatgaagcagcaagacagagagagactagaggattttcacaaataacaaaggatttttatttttgaaaatattgctaaggcttgggatctacggctcgtcctagggtcaaaggtggctctgataccaacttgtcacgaccggaaataacccaacgggcattccttacgtgcgtgcattaatccttgtcccaggaggcaaggtacaccaaaagttgatacaattcagagtataacaagcggaagcgtaaatagttaatttattacatgggcagcgagggcccagcacacacaaagacaaacgagaaacagcggaagactagggtgacaaccacaggcgcttgacggcaggcacgagctagacaccaaagccttcatcttcaaggagctcctcttctgggtttggaaaaattgagcaagactgagtacaaccaccgtactcaacaagacacacccacaagtgcaggataaatgtaaaggagtacaagggggttatgatataaagggttagggtttgtagtaaacagccttaaaagacacttagttgctcaaagctattttgtaaacacgtttccagagctatacaatattattaatcaaggctgtgaacccacacgagcctgccttaacccaaggcctacgatgattcataccgaactggcaacccgaccctgggtcccagctcgtcccaagccaacccaggccatccgttccaccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccttagacaagagtaccgacccaatcccgcctacggccggaacctccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactaagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggaggtgtgaatccaattccacaatagaccaacaattccaaagtgtccaggtgatgagaatatcccaaagtcttgagttgtaaaaccacctaatgttacctaattaaaagcgaagcatctacctaaaatcatactagtggtaccatgagtagagtgtccactagttggggttttgtttattctagggtgaacaaggtaataataacaataacaataataatatggtcataacaaaggtaaataggcatggctaaataaaacagtgataacgcggggatttaaataaagcgataatgcaataatttaaatcaacataattttataaactgggattcaatatgctcaaagatgatgtgacttgccttgctcgctttcccaaacgtcggcttcaacttccacgaagagtggatcttccgaagctgtagcgtctacacgaccaacggaaaagaaaaggcttttactctaataaactccacataacagcagaaacaaagcacaaaaatgggttcttgacttcttaaggaaaagttagagacttgaacggtccaattccgagttcaaatggccaagttatggccatttgaagtttatatgctctttaaatggatatttgcgaattgcttcatttaaattttaattaaaaactcatttattgcgtcagccgggagagagggcgcgcggaccgggtccacgggagtggggcccacgcgccagcctctcggtccacggtggaccgggtgcacgcggctgtcgccgaccggcgccgtgggtcccacgcgtcaaccgcacccgcgggcgcgggcggctgacggccgggcccacctggcagccgcggggcgcgcccgaaggcggcctcgccggcacggccgacgggaggcggcgcgcccgcgccccgatggtcgccggcggcgacctccggcgcgacggagcggcggccgagagaggggacggaagggggaagtgaaacaacggtcctcggctcaccccgggtcgacgatgacggcggaaacgacaaccggagcggaggaaggcggcggcgcggttcggatcgacgaggacggcggcgctccgacagtcggcgaccgaaacggaggagcggacgaggtcgacgaggacgcggcgaagccgaaggaggtgacgccgagtcgggaggaggtccggagcgacgacggcggcgaaccggagctcggcggcgacggcggagagagaggaagacggcgcgggcacgaatccgacggggagagtgagcggcgagtggcggaaacggaggagcgaagcacgaggaacgattatatagcgtcgggagggagagagggcggccggagaggaaggaatcggccgcggaaatctcggccgccattgattgcgccggcgaggattgcgggagtaaatccgagcgaatccgagggagagagagagggaaaaacggggggaaagggagagggaatcgcggggagtgatttccccctctttatggcgcgcggggacggcgggatgcggcggattcggcggcggcggcggcgctagggcacgggcgggcggcgggagcggcgcgaggtaggggatgacaggtggaccccacctgtcagcgagggtggcgggcgggcccgcctgtcaacggcgcgcgcgcgggggagggccgatgggccgcgggggagaggagagagagggagggagctgggccgagccggcccaagaagggaaggggggggaaaagaagacttttagggtttttctttttataaacctttttaactttgtttatttcttctcaattattatttgtgctctgaaaattccactaaaatttatttacgcattttaggcttttaggaaatatacaaaaatcttccaagccttatttgacttttaaatttgcacattttaattgttggaggctttcacatgaattttaattattctcggcacaatttcgaggatgtattttagggtcgttttgggacgtgacaggttgcttccaatttagcactgactcgacattgcttggatccacagcaactcctccagctgagatgacatgaccaaggaacttcacttcgggcaaccaaaattcacaattactaaacttggcatagagctgatgctcacgtagtttctctaaagcaagacgaagatgctcttcatgcttttcttttgtcttggagtagatatggatgtcatcaataaacaccatgacaaacttatccagatattccataaacactttattcatcaagttcatgaaaaaggacggggcattagtgagtccgaacgacataacggtacactcgaacaaaccatactgtgtggtaaaagcggtcttaggtatatcctcctcacggatttgaagttggtgatatccggaacgaagatctatcttggagaaaactgtagcaccggaatcaaaaagcacagttgcgggtatagagttaacaggaaacgtacccaaaaccacatcaggtgcattctgggcttctgcagctacaacatgattaacacgagccttcggtgctggagcattggagtcattctggacaggagcattcttcacacgtcgaggatttggacacttatcagcataatgtcctggatcaccacaattgatgcacacccctggcttgcttccttgttccttcctgacagactgattctgtgttggagctgctacaggacgagtgaccacattacgattgttgttgctgcgattaccagtgttgttgttgtagaactggcgttgagggcgaacaactgaagaggatcctccctgtgggtatggtgcagcttgaggtcccatagcaatgtgcggcctctggctactaccctgttgagccttgaattgagcagccctacgcttcttctgttccatcctattgtacttgtcttcttggcgactcgccttgtccaccaactgctggaaatcccggtactccatagccatcaatgcataagacaactcatcattcaatccctctaaaaacttctcctgacgctcttcatcagtgcgaacatcttctggggcataacgagctaagcgattaaagtcatgaaggtactctgtgacagaacgggatccccgattgaatgctctgaactctctcttcttaagtgccacaacacctgatggtatgtgtgtcttcttgaaagcagcagtaaactcccgccaagtgataggctctcccgcggctctgtttagacgaaagtgatcccaccactcagcaacaggaccatgcaactgatgcgaagcaaaggaaaccttctcctgctcggtgcactgaatcaaatctaacttcttttccacagcatgcagccaatcacctgcctctactgggttagtggtgcttgagaaggtaggtggtctcacacgtagaaaatctgccaacttgttttgtggaggtggtggttgattgttgttatttgcctgctggttctgcgcttgctgcactaatagattaatcaactaagtttgttgagccaagacttgggcaagtgtgggatctccttcattgtgaccacttccacttccacttccagtgcgggtgttcaccatctgaagaaaagcatgggcaaaaggaaagaacgacagagagataccattagaacggagaactttaattaatttcaattctatattgctcttaactgtgtatgattacatttaaattgaattaacactatctcaccagctaacttactctctgacaagcaaaagaagtaaactcatgtagttacatcccaccaatgatgtaagcaacacgctaaacccacacacacacaagcaaacttaagcaagcaaactaacacagcgaactacggaaacggtctaactaggcaactaatcttgccttgcgtcggaacgaagagatggatcttcctcctctggagtagctggctctctttcttctgggtcttcctcttcttcctcatcacttaagacatggatgacaggttcagcatgatcaggcacagcatctcccaccacatgagtctttgaagctaactggagacgaggtggtggacgggttctcttccttgcggcgaggcgaagcttgggtgctggcggtggtgcttctcccttaagctcagctagttccttctgcagacggtacaccttgctctccaacttgcaaatcctggcacagttccagttttccctatcatgagctgctttctcccgctccacgcctactgcatccatggcgctaagcatatacacagcatgtatcagagtggcactaccttcgccttcaggacagttgtaagttccatagtcttgaccatgaggcttgtgtggatgatactggaaagctaatgactctaactcctcatcaaagcgatgacatagctctccaatggccaccaaggctgcttcctgataagcatggctgtactttcttcccccagcttcaaactttatcgacggaaggtcttcatgatcactagccaacgtcacgcgaacacgacacttctccttgttggggtcatggggaatctggcgatactcgggggcaacctcatagcctacttcaaatgccatcaatctcagctccctgacgaatcctagcacatcgatcaagcttttcggtggatggggcggcatctaaaggaacatagaaaggaggaatttatgcatatatttaagttagctgcacatactagacttaattaatttgacccaaaaagaaaaagaaaagaaaaggaggaaacagaactaattaaatttcgaatttttcttttctgaccgaaacataaattttcagaaaccaatttgtttttctgaattttttttcgaaaatttttatttatacaggagcacagacttcggaagtaaacaaaaagaagcaaatatattttcttcctgtacagtactcgtggaaacggaactaaacaaagtttttgtttggaaaatgaaatcaactttggacagagacaaattgctttagacaaatgaataaaacaaaactaaaatacttaggatctaccataagcacggtatagtgtcaccattaacagggatgagtagtgctggtgctatcttgattgaatcgataccataatagatgtacagtgccgactaaccaatgaaattcagaaaattaaactatttaataccctgaacagtaaagtttttttttaaataaaagaacatgtttctgttttggtaaagtaggatttagtaaatttggtacataaccttgcatgtgctgccaacttaattaatttgtaagagaatagagaagagcagtcctatttttcaaaatattttgaaggctacttaaggtttaccatttggcttatcgtaaggtcaaggtagctctgataccaacttgtcgcgcccggaatttctatccaaaattccaaatgcttacacgtgcgttaaatcctcgtctaggaatcagccgaggcacacaataacaaattgataatagagtactatcaaacatctaattaatactcgcgaaataaataattattacagaggtggatagttcctctcaaaagaataaaattctacgcagcggaaataaaaacaaaagatggaacagctatggcgactccactccacaagcaacttgacccgaacaaagcctaatcctccagatcatcaccttcaccgaagtactcctctgatgaatgaatattgcaagattgagcatatgacatactcaacaagccacacagcaaatatgcaa

SEQ ID NO: 447 - DNA, 6932 bp, Oryza sativa
tccccgtcaaaaccagaggcaatggacttcccagcgactcccacggacttctcgccgcttctctattttcatctaatacagaaaattattacgaattaaataaaagatttatgatgtcacgatgacatcatcgccggccatggcacgggacgacgcgaccaccggcgatagagggctcggttgggctatccgagaacacccacgcgaagaggacgacgacgtgaactcaccggcgcaagaaactacgacggacgacgacgaacgacggccggcgacgaggtccgacggcggctcggctcgggtcgacatcgacgacggcgctctgacggtcttcagcggttgcgaaggggcggacggggtgctcctcttcctcacgaacccggtggtggcgacggaaggcggcggcgacggctacagcggcggcgcggcgcgactggaatggcgtcggtagcggcggtgctagggcaacgtggcggcggcgctacgagcaacggtggagcttgggacttgagggcaaacgtagaggacgacttggggatgctttatataggcttggattagagagatcggactccaatcgagaggatttgagctggaaaaatctagggttagtttggagagataaactaaaaacgaattcgattcggtttatccgggcaaaattgatctccgaaactttaggggaaagggagaggataaggaggagatgatttcctttcaagcaatcgaactcggagatggccggctggggcggaatcgaaggggaggcggcggcgctcgggctcggctcggccggccggaggtggaagatgaccccgacatgtgggccccacatgtcagcggcttgaaaggagagggtggggcggcggctcggcttgggccggcttgggccgcacggccgcgcgcgaagaggagagttgagccggaaacggcccaacggcctaggggagggttttaaagactttttcaattaaaataattcgtgaaatgatgtttcatttattaaaaatacttcccttgctcaaataactcccagaaaaatctagaaaatagataaacaagcaaagtatttaatggaattttatctagctcaattttatgttgaaatttttcctagattattagagtttaacttgtaggcttttaaaaataatttctaaaaatgcattaaaaattgaattattaaattaggcgattttgagggcgtgacattctttttcctaaatgttgataaaatcatgttctatcatgttattgtgttcttactgctattattttggccatcttttcttttgactttgttttatgaattaaaaagttgaatttcaaaaaatggcaacttcaaataatattttgaagcagtaaataatttcatctaaaaaagtaataaacataaatgtcgtagaactcatcaagatgtacaacttttatttggtcatttcttcatccgacaaagtgatagtaacattgttaacaaaatttacatatttctcttatagtttataaaaccatatgagagagatgtaaaattcgtaaacaatgttactatcaatttgttggatgaagaaatgaccaaaataaaagttatagatcttgatgagttatacaactttgttgttgattgatttttcttatttgaaaatgttgtttgaagttgtcatattttgaaattcaaattcaaactgttcaaacaaagtcataaagaaaaattaccaaaacaaagttgtagatcatgcgttatacaactttgttgttgataatttttctatttgaaatcaattacaacccaaaaaattatttgaatttcaaattgttgatgggtgatacccgtagaccggatgaataggatattggggtacgttggtatgaggatctacgtgatatgacatcaagcaaacaaggagacaaggattttactggttcagtccccttatatggtattgatatggaaaaccacagagatgggaacagatgaattcgacaatcacacaagtcttttctgcacactttgtcctcactcgtgggaagaatttcccggtcggtcacttatcccaaaattgctctaggccaagcatgcttaattcttcccggtcacacttcacgtgctctagctttgtaaactatggtgggtgtgttggcagtgagattcgatgatctgaatccctcagggggtgtcccttttataccgtggatcaccttgttctccaagtagaactcggagacatcggactccacactacatagaaaagaccccatcctctccgagtagtactctgctaatctctttacccgtgagaatattttctacaatatccagtaaatttccttaacgcatacgaaaacaaatcgtatgcgcaaaggtataccgtactcgtatattccgtaagtcattggatagaaggtatgccttattcgtacccatgacagttatattttaaaattcaaattttatatagttcaatcaaactcgatggagaaaagaccaaaagaaaaatggtagatctcaatgagttctacaactttgtttttgacaactttttcatatgagttgatttagtaccataaaattcgatttgaagtttaaagagccacatgcaaaaaatcgatttttgcatgcggacctcttaaggatcagcctatattaggtgatctatactaggtgatttgtctataaatgaaacgagtaaggagacatgcatattagataagatcgattgaaacccgatgctacccctattggcaatcaacaagtaggctagagattatggttctaaggacggcttagtagatcaaacttaactgatgaagcactaagtatgaaaagaaacataatatctagacaattaagcctttgactgatttttttacgtgacctttgactgatttttagggtggtagatgttgtcggactcggctgcggaacgaggagatcgaaacagactcggtgccacatcttggttggattcgtaatctaaaagtgcatcggctagaatcacattggttgaaggtgaagattcgaggtcagaaaagccagagtcaaattaagccgatacatcacaaccagggctcgtgtgggccaaactcggaatatccatcattgccaattagagataaaagctcgtttgtaggcaattgtatctattaattaggatagttaagtcggtgtgttcagttttggcaagaggcggccatatatggtcttgtttgtatcttagagttttagaatgttttgagtcatgtcggtaagggccatgttgttttttgagtctgacaagcaagaccgtacctcctttcgtttagctcatagatttcctacccgtctccggaggttatggagcgggcgtcttctgcttaacttgccacaccttcttcctcttaggtgtggttggcggcatctttggagccgtcttctatggttttttggccggtgtaatggattgtaccgatgtcttccaataacgggtcctgggaacagatgatcccttttccaggaagttttgcataaactttaccaggctatccatcttgggttgctccacttagaccacttgaatgttctgtgggtttgccctgtattttatcctcaccatggagcattgctctgtcctcggctgaaactcaaacttctcctccttcctgttgataggagacagatacttcccgcccccacatcaaagttggcgttcgcggtgctaaggaacggatgccccaagataagtggcgtctccttgtctgaatccatatccaacaccacgaagtcaaccgggatgaagaaatcccgtatcttaaccggtacgtcttccgctatcccagctggaaaatagaccgaagaatcgactagctgtaggcgcatcggtgttggtgccaacaccgtgaagttgagcatgtcgaaaacgtctttgggcatgacgcttatgcttgctcctaggtcggaaaggtcttggtcaaatctttgtgtcccgatcgagcaagtgattgtgggacaccccggatccttcttcttttcagggagtttgtcgagtatcgcattgctgcattcctccattagtttaaccacttcggtcgtcggaagtggtctcttgttattgagtatgtccttgaggtaacgcgcgtaggtgggcacttgcatggcgtccaacagtggcacgtgaatatggattttctggatcacctcaacaaaacaagcgaactgctagtccaccaatggcttgttgtatctctgggggaatggcagcagccttgtgtcgcagtactcctgcggcatggtcttctcttgctaaaccttttcttcagccgcatcgctagatggtgcttccctattgttgttgccagctcctacaaggttaggatatgtcagatcgcaagtggacttacctcccctcgtcgtgattgccttaacatttttaacggagggttcggttgtccaagaatcctcccagattcattagcaggtactaaagcagctaattgtgcctgctaggtttcgatcattttattaaaactaagctagttttggaatgcataagcaaaaccatctagcttaacatttatattttccagggtcttgtcattagcagctagctttttgctaagagcgtttgtagttttggcttgcgcaaaaacaagatccttcaaggaaggctggttagaaaagttgccgttattgttgcctccttggaaatatgggcgtggctggttccacccctgagcctggcgaacggaacccgttgttgttgttattgcccatgtacatcgcctcttcacgggtttctaggcaatcgttcccagaatgacccgtgcctccgtagacttcgcacgtaacgtgggagtccaaggccttgacggtgccttggggttttttctcgtggtcgttcaaacgattcatgaggaggtccagttttgcagcgagcaactccatctccttgacggtgtgcattcctcgctgatgggtctatagtcgttcctcgctccagcccatgttggagaccatcttttctaaaagatcgacgactcctctgaccgtcttagaaatgaaggctcctctagctaccgcgtcaaggtgatcatgtgacgtgggagtgagtccattatagaagttttgcaggattaactagtcgtccattccatgatgaggacaggcggccacgtactcctgcagtcgttcccacgcctcgggaatagactcgtctctcgtctgctggaaacttgaaattttgccgcgtagggcgttggttttgcccatcggaaagaactttgataggaatgttgttcagcatttgtcccaggtgttgatcgtagcgcggttggcatagaaccactgcttcgctttcccaatgagagaaaatggaaacaatcagagcctgacgccgtcaggactgatgcccttcatcgtgtacgtgctacagatctccaagaactgttgcaaatgtgagttggcatccttgtttggcttgccacagaacgggctagcctgtgcttggtctagcaatgctagcaggctaggaaattgaagtttcaatttgatcaggatgagaggttgatgctccaatttcaacaggctgggaactggaagctacaatgttgttagctcctcccttcatcaatgttgctagccggctctaagcaatggttgttcaataaattagtaaatgccccatatccaaagtatagtgagggttttttagatgatcaccttcttgtgattcttcttgggctttattcaagtattgtctgcatagctagtcttttgggactaggaatatctgaagtagttggcagtgttcctccttggcttcctcttcctgcaaaatactagacaaaataatgcattaaggtcatcaaactgtattattgagaacagtattatggaggtcaagcagacttgcctttttttggttccattaagggaacacttgtagcttgtttgaatgtggcaaaatttccacaacccttacaccttctcttgcctcttaccagcaccctcttccctgaatcattgtcaattgaagcagttttggatttggacttcctaccaccttcaaggcaagttttggtcctaagctttccgtatcttccatttgtcttcttaggtaaaggtgcacctaacacccttggcaattcaacctatggccagtatgggttgtcacccaatggctttataatcccactataggccttcttgaacaaaatcctcaatgttcacatccatattttgttgggaggttatcaaagccaatgcatgctaacatggttttccagtgtgctgccagtactggttgtaagctttcaccacatgcttaccattactgttgttattgttaacaacttctgcacaaaagctatcagatttcactactgagaggtgacccaaacccgtagttcttgccttcagctgctgtgttacagcaggcaagatcttcctactcaccttctctacaattcttctcctcttattccatagaaccataaccaacgctctgtaaatttccgcatggtcacaaattagcaatgccttgtaatccttaatccagttgttaaaactctctgcaagattgttagtaatgtaatcacactttattgttggattgaaaccactcctcatccacttcaatggatgataggtttcaagccaaggaagcacatcactgcaagcttcaataacttctttcatgtgctttttccaaatctccttcctataagccgtttgctgctaagtgcacacatcaccaccaaacctcttcacaaagttcttcattagatggcagaagcattccgtctactcagcatgctcaaacacagtatgtgcaaccttttctaatccttacatgcataggtacaaacagctagtgggttaacatctcctatagctttatgaagttgtctcataaaccactctcaattatcctcagtttcagcatttatgaacccaaaag

SEQ ID NO: 448 - DNA, 18540 bp, Oryza sativa
  unsure (1)..(18540): unsure at all n locations
aatttatactaatgtatggcctacattcctctaagaaaccatctatacagagcctcagagcacaaaaaaacctatgaaaatatactttcccacaaacctccacggtatctatctctatcacactccctggtgaagttctcggtacctaagccctccacctataaagcatatgcaaactttcttcccaggtccaatagagctcaaccatagccttttgtctacccctaaatattgtgtcatagttaattgtgcacttctgatcttcttgtagttggctccgcaaggctttagggcccatacctatattcttcctaaggtttggaattgcctttgcagctacccaactgatgtgtggtaattattctcctactgctagaacggcatgtatggaagtctattaacactttcacattcaaaataaatgcaacaatccatcaatttccaaccattatgaaaatatcaaaatgaaattactgaaattcaataccatcactatcttctaattaattaggttgcttatgtccaaccatatgccaagggtaaccatcaaatttacaaccacctatattttcagggtcagttttcaccaacttcaactcaaactccttgattatagcacattgtctcatggctagactaaactccttcatgttaggatacatagtgccaaccttcatgcaaggattattagggtcataagccatgaccatctcccctggtacttcatcatgtacaggtattgatgccccattaatatcttcaacattagtagtaggagctgcagctgctactgcagtaacaccagcacccgtagttccagcaccatcagcagctccaacttcagcagcagcatgtctagccatctcagcctcatcctcagcactcaaaccctatagctggtagaattgctcatcccaatcattttgacaatatctagcctcccttcatcatcattttgagcaagaatctctagcctattccaatcgacaacatcggtactagctgggtcaaaagcaccgtagactggaacttgttcgactactcattcaggcacaatgaggaaaacgaaatcgacggcatgatcagattcgggttcgaccacagctaaaataaccttaggctcttctagcctgaagaaaaataatttggaacacttgttagagtattctctaacaagcaaaaaaaaaagacaaatcaagcttcacaaactaaggagaaaaacatattcttaccccatgactagctcatacctggtacacccaatcaattccaccttattcctagcaccagcattccgtcgggaagtaattaagatgggaacaacggcttcgagaggctgcccttggcgtcggcggcgaggaggggaagggggagggtggcagcagtgagtaggcagaggcggcggcgggaatggcgatggtgacagctaaatctggggcgccgccacgagctataacggagtacgataggggaggagcgactgcatctcgatcccttttcattcactgacctaaagaatgagccaagggcaatttggtcagaacacaactcatttactggcttaatcgagtgaaattggaaaaacgacgaagtagcatgttgcgcgaaggtggcgatggcattttaacaaaacaagttcgcggtgtggcattacaatgaaacccagccttgaatgtggcacaatgtcaattttcttgggcaggcccacactgcagaggcgaggcaacactaacgacgcggcctctacaagcaaactcgagttccaccactggctcacctccgctcttgatgtcaagctgcagccatggatctagagcacgtgaccggggagtcctcacctccggagagactggatgctcattctcaactcgtcaccggctgggtcaccagccccaactagcttctctgagaccaactcctccagatccactgcgtgtgatgccacaatgatggggtagccggcgttgccactcttgcctgtgtcgctcggataggctaggtccttcgctgccgccatggaccaaagaatgggagaaaacaaagaaagtggcatggtggatgacatgtgggcctagttagttttttttcgattggattgccacatgtgctggctcggatcaaaaccgctcaaaacagtgcttaggtggttatttgtcaggattgaaatgttcgggctgtagaatatccagttttgttgtttagaaaagtaattcgtaatgttgcgttcagtggcggaggactcagtaggataaggttttgcttgagccatacctcgctttgaccacaagtaaccccatccactcctcgccctgctccagcactgcagcacgaccaccacggcggcatcgccgatgccgagatatgtaagcgcgaaaggaggaaacaatgctctagcagtaagagcttctgtatttcattccatatgctgtaattttgggatttttggtcaaaaaccgtatccaatcgattccctactagcgctcccaatagatcgagttcccttattcggattattcgttccccacttctagccactcggtttcattcccaaacccttccctcgccgctctctcgcgcacgtccggcgaaatgttcccgcgcagcttttctcgcccacctcgaccgccgccaccgtcctctttctcacagccgtcggtgttggctttgctccagggggcgacacatggtgtggcaatgccgaccatgccgattggtggagcaggaccatcgctgccaccgcaagccccaccgccatctcgattcggggtgcttccacgatatagcaagaattggtccaacgccccgcaccgccgcctggccgtcgcgttgtaacaccccgaaaattttgactctaaaatacaaaaacgaaattcagaataataaaaataatcttttccaaaattcatttatgctggaatttgttgttttcctcctgtgcttggaacaaaggatgggtgtctgagaatatgcttgtattttagatttcaaaatattatttgttgaaagaaccatgattatgaaatatgttaattaagaaaatatttgcaaatactaacagccttctcacaaatccttttctatggattaaaacccatgggttgtccttgttttgccaaatagtttctatttggagaaaacccttcttgaaggttaactccctaaggaattattttaccaataaaatgtaatattgattatttcctaagaatcctttcctttaaaaggattacgtcatttggcagttatttttcaaataacaattattaataaagtatttcctggaaatcctatttgcgaagtaaatcccaaaaaggttatattaaaagaaaagactttctcagataaagtctagattaccgccttaaaggcctaaacgagcctgcataatagaatttcttatttgagagcatttgtgtgtttgtgccaagatatcgattgaatcaatattactaagccccaaaggatgccttttgatcgacatccttccttgtcctctctcctctcgtctgttttatttagcacttcggtgcaaaactaatccaagttctgaaactctttccttctatcgcgttgtgatatctctctcgagctcatggaattctatgattaaatcgaaacccactccgttaatttgaatcggcctttcccttgaaaacctaaaatcgttcgacggatttatttctcgtgcatcgacccgaatatcctcggttctatctctaaacttgaaacccaaccacgtcgaatggatttgtatgccatacaccgctcttaaacccctctttgttattgtcatcaattcgttctagtgatcgcaaaggaaattctaaatccaatcctcgaacaaccaaattagccaaataatattcgaaagcctaatcaaatgtcccatcatagagtccttttacaagtttcgaatacaattccaaattccaaaccccctagcaaattataaagttacctagcaattatccaagtcccctattacagttgggccacccttctctcttccagccctacccattccacaacacaagtccattatccctctctctgcatgccgagctctctctccctctcagcccgcttccaggccagcacatcgagccgccgtattcatccaaaatgcctaattggtgaacagttgcacgcctccctcttcacgcagcaaggccacgtggtgcgcgcggagagggggcggcggaacggcgcgggagggaggggtccaggtatgatttttttttcgttttttcttccatatgttcttcagttttcgtgtttttttatgtttttttctttccgtatctttttttagtttttttcgtttttaataagtacgtatacaaactatgtatacgtataaatacaaactttgtatatgtgtatataaactttataacatgtatttttttggttggtatacgtatgcacgtatacaaagtttgtaaacacgtattttttgggcttttatacgtatgcacacaaactttatatacatgtgtatattttctatgcaccccgagacatgggcaatacagtgagggaaatccacaccccgagttcacaaaaccatgcttaccttgcccttcccctcctgtggcgatgtcgacatccaggttctgcgccgtcgccgttcaacctgtgggcgcgtgccacatagcctcagccctgtgctttttcccccatgcccatgccgctctgtgccgctacacttggttcaccaccccgggcaccccgcttcctcgcgctctagccggcgcccttgttcgtccacgtcgaaagcgtgagccgagctcacagagctgcgtagccgtcctctactttcctgtgccgcagccttctccttgaaggaaggaagaaccaactcagcaatctccctcctcgccgtggatataaagccagccagcacccctccctcttnctcctttcccgcgtacattcgccgacgaccaccgccgatcccgtcatcgtcatcaccacacccgagtccagctcgagctcgtngncgaactacaaccgccccgcacagncaagtctgctgcgcgggaagccgctcagcgtacggccaagtcagccgcgcgagcatcgtccgcagcggtttccacctagcttctggccagtgcccagccgagcatggtcgagccactggcactagtacactagtacagaaccttccatttgtgacggcctctaacatgcttgaaattagtggccgtcacaaggaagtcatctcaatcgggccgaaaaagcgcccgattgagataacttaggcccgtcacggatgacacatatcagtgacgggtgccaacttggggcccgattgagatatgaaatgttatctcaattgggcctaaactacggcccgtcacttatatgtatcatccgtgacgggcctgagttttatgcccatctaacatgccttcgagaccatatctcaataactaggcctgtcatagatgactcatccgtgacagactctatactaatgcccgattgagatgacttagtatttttccattttcatatgaaatgtttatatttgtgagttgacatgtagcaaaataattaactgcagtataataattcattttattagtcaaaaataaaatgatttcaaatgaaaaattgtcaacaacaaagttgtataacttatcaaaatttacaagttttattttggtcatttttctatataacttttttgaacaatttaaatttgaattagaaaatatgacaacttcaaacaatattttcaaatattaaatgatttcaaatggaaacaaagttttataactcatcaagatctataacttttattttggtcatttttctatataactattttttgaatagtttgaatttgaatttaaaaatatgacaacttcaaaacaacattttcaaatactaaatgatttcaactaaaaaagtcatcaacaataaagttgtataactcatcaagatctataacttttattttgatcacttttctatgtaacttttttttgaacagtttgaatttgaatttaaaaatatgacaacttcaaacaacattttcaaataataaatgattttcatctaagaaagtcatcaacgacaaagttgtataactcatcaagatctataacttttatttttgttatttcttcatccgataaagtgttagtaacattgctaacaaaattgacatatctgtgttatagtttataaaacaaaatgagagatatgtgaattttgtaaacaatgttactatcactttgttggataaagaaatgaccaaaataaaagttatacaattttgttgtgatgaccttttcaattgaaatcatttaatatttgaaattgttgtctgaagttatcatattttcaaattcaaattcagactgttcaataaattttatatagagaaattaccaaaataaaagttgtaagtcttgataagttatacaactttgttgttgatgacttttctatttgaaatcatttagtatatgaaagttataaaagttatatcttttataactttcatattttcaaattcaaatacaaatagtttaaaaaatgttatatagaaaaatgaccaaaataaaagttatacgtcttgatgagttatacaactttgttattgacaattttcacatttgaaaccatttactacccgaaaatttatttgaatttcttatattttaaaattcaaattttatatagttcaatcaaacccgaatggagaaatgacctaaataaaattggtagatctcaatgagttctacaactttgtttttgacagttttttatatgagttcatttcgtatcataaaattcaattcaaaatttatttttgcctaaatgtctgatttgactcctcatcatgttaatacttgctaaatatatatttgatccaattaacttggttttgctggtgaaatatgtgaaatatgtgataaaatggatgttatgtgaatgtggttgtgttaaatatattgatagttgtgtatgtgaatgaatgtacaacttcttcttcagaagccgaatcccaaagtgctctgaggttaagcgtgcttagggtggagcaatctcaggatgggtaacccgactgggaaatccttccctagaagagcaatttcgggatgggtgaccaaccgaccagcccacgggcatggctagcaaaggcctaaggctagcaaaaaaataaaatttatttatttttagattatactcatctgtgacgggctataatttaggcccgattgagataagagtcatccgtgatgggctatagttcaggcccgattgagatgagagtcatccgtgacgggttatagtttaggcccgttagagatgagagtcatccgtgacgggctataatgttagcctgattgagatgtgtgtcatgcgtgacggccggatgcccgattgagatattttatcacatcagtgatctttgcttagtgaaggggcgttacctgatagagatgaggctttaggcccgttacacatgaccgaacctgctctagtgtggatgccagcgccgtcaagccggccaccccgtccaaccagtgccccgacctcgtcctgcccggtgccgttcccttcctttcctcctctgcccggctacgccctgactcctcccctctgtgccgcctccctctccctacgcgcaaccgagccgccacgcccgggcgccggccgcgccgtcgcgcgcctgccgcctctcgctcggacgcacacgcacgtgagacgatgggaacgagagagagacataaggcagacaaattgagaagaaaaccatgagagaagaaaaagaaaaaggaagtgggacccacccttttgactcctcaccgtgagccctttttccctctaaaagtctacatcaagtccccctttctcccttgggccacccgattaacaagtctacaaggcattcttcttggccaagcccaggaaatcaattcctacaaaagtctgtattatttccctcctccaaacctcggaccgtagcccatcagcaatcatcacctccaccaaagtccatccctcctccatttcataggataatcttgggaatatttcctccaaattctgggaaatccttttcctccatttataaaaccatttgaacttcggaaatttgtatcttgcaaaccgtaactccgattgggtccattcaacttccaggatttctctaaaatcgacatctatcaaatggcactactgaattgaggtgttttgtactttatttgtaggattttggatgtttatctcttattgaccgcataggtgatatttttgatatttaacgaacgtggatttctcaaagatattggattctaaaagcaaggcaaatcactacacatccctccttgagcatgttgaacctatctttataaatgtggtgattaaaaataaaattgcatgctatttataaactgcgtacctaaacttgaatgtaacccacccttgatattgttacatttatatatttgtatatccttgttgcatgagtctattatttatacgcggtcaattattgacattgctagcattgcattgtacagacaattatagataccatgtttattatatggatatggatgtgagatcactcgatgcgagtgattaatggtttatggctagagacatgagcgccacccgcgacacaaaaaccttttgcgaaaactaaaacttaataaaacaaaacaattttgactggagtggcatggatagaatatgggtggatctatgaaacggctagtcgccgaccctggtcaattaagcaccgagtcaaaaagctatacagtaaacaaaccgagtacgaccgcacttttcaaatgggtaaacccgacggactaagaaattctcgtggggcggcaccctagtcatggtggttctataggacgttggttttgttgcagtgttgtgatttggataatgtcaacgaaaccaaaaatgcgcctaactatatttaaaatgtaactgcctgttatcccgggagtgccaggactcccttcacttctggctcgaggtagggatggtttgccggggtgaaatgggcgctcattgtctttggagcgggtgccgtaacacgagggtgactgaaaaaccagaccatgacaagtctcatgtgtggggactaggctcatgggttgggtatattatggagtgcgggattaaaataatacatccactgcggtgtgattaaaccaatctattcgaatagccttgctcgcggttaatgagcgccgagacttgtattactctagactagccccataagtttttaatactgcttatattaaaaatggaaaggaatgtgtgaccttgcccgatgtgtgggaaggtcgatatggtaaagattttataaaacaggaggcttggggaaggtggatgaaccctcgataattaatgacaacttcaacttaacgacttaacgtcgataatctaagtcatagatttgtgaaatgaattgtgaaaactagctttatgcaaataaaccaagccatccttgaacccctgtgtgcactaaatgcatcctgtagtggtggcttgcttagtatgattggtactcgccattgcttaattaaattttttagaaggagttgttggagccaacatgtatgtatgctatgcaaacaaagattttcaaaaaaaaaacaaagcactgctacaaacctgcgtctaaattgaacatggagatatgtaggttcttcagaaaatagtcattatacaatctccaatgactagccaatctatcctgatcaattactgcatgacctaaaacagacccaccacgcactgtgcactgcgtgacctaaaacagacccatcgtcgaactcactgtgcactatatcaaccgccgaagaaataaattcttcgtcgccattagatgaagactcttcgtcgcatttggaggagggtgctttgatgactcatctctttttttttaccaccaagttggattgcaagggagagacggccaacagagggaatggagaggtggctagcagcagtggggggatatgagagggtgttagtatttcttaacgacattactagaaatataattcccagcaatagcgcagaaatactcctggtatattatggttacagagttcatccgtaagcgcacggatatatcattgtagcatttcacccgagagtattccaagggtaccatatttatttaatcctgcgggaagatcatagtagagaaaacatgactaataatttatatgttatttgtagtaatcatattctaagtagaggttaagaaaatccaagggtagagtgacacacaagcatggaactactcattctcatattaaaatatctaagctaaatgaaaaaaaaatagaaagagaatctattcctatacttctagtatacatagtatacatacatcctagttatctgatatactagctaataccctctatccgatacccttctagtacttcgagaagccacccctaactgccgagtaccttacgacagcccgtcatgaccatacaaccggggctaaatacggatgagtacccgccccaggaaattaacttagaactatatacacgcgtggaggaatacccgtactgacctgtcaccatcagtgacccacctctcatccgtaacatataactccaaataatgatgtcccatagtctagacaccacgcctaaactaccagatactactctaatatcatcgtcatgacatagagtaattgcacaagcaaacactatacccgtaccaaagcatctcttagataagctagcagtataatcagtataacatgaatataatgtaaagttagcattcatatactcggaaagtattccaataccataaatgtttaaagaagagtattctaataaaagtacaaagcttacaaaagagaagagaagagctactagagccatacccgaactcttcccaaggcttccggactccgatttctactctattcctattccactagctttagaacactaaactaacttgagaggatatgaaagaactcttgcttgaggttgtgaagagagtgaggaagtgaagtccttttatagcctcccaatgacggttatggcaattggaatggtcggaaattccctctaaccgtcattggggagaaatcctggacgtccacgccaaaccctacatccaatggagcagatgggctggtccaatccagcccattttcggctggcggcctcctagacatcttctctctgtagacttgtgaattttggctcaattggtcgtgtcatttctgagttcttggcccattcatacataagtctgatcctcgacatcgtccgattgatttatcatctggtttgatgtcgattcctctcccttttatatatggttattttctgcaaaaggttagtaatccaaatattagtggaatattattattctaacatggatatgcattgcaagcataactagttctcatctattttggtaatattgacggtcaaaactgatcgctaatgaccgtcaacagaggggaaggaggaaggaagagctgggcggtgagggtgttgggagatcggcaggagtaatcggcgtcaggaacagaagaaagcgacgctcgcaggaataggaagagattggcgcgccccaccaggaagtcgtgcgtcgcgcgcaagttggagatcgcgcgtgatcgcggacgaggaaaacggatttttgttgttactttaaaggagtgcccattgttagttataggaaatcaaatttaggctctctcttggagatattagttttttcaattcccatattgatgtttaggaaaaccaaaaacttaattttggaaatggatttctgtcattcccttggtgatgctctcaatcccgtcccgcaccgaagcccaatgggattttgccgtgtgaccaatgttaatgactacttggtctctacgtccctatttccctacctcccatattcccaatttccttcgttcttagggctacggccgacgactaagggatgtgcgggcgtgtggggaccgtcgaccagaacaacaacatgcagagcgtgcggctggcacggcagtggcggggcagggcggtgcgacgccaggcttcctgctctgctgcacaggcagatccgcacagtccgcacacaatagctgtatcctgtgttaatttgcagccaaacagtgttacgagcccaagcatttgtttttacatatcttgctcttcgtttcacagattgttgaacgatttcacagattgtctatgctctacaagtttgcgtatttaatgcattgcccaatcttctttgttttatgcttttccgctaaataatttacatattccgttgatgtcctgttgctcctttaatctaattcgagttccataatatcatgacattgacagaacaacaatatttttttctcctttgtgttcattctagcattttcatggccatacttcttatttctctcaccctccgccactgatcgcgacagttggatgggtaattcaaaatttttcctaatacaattgactaaaatttccgatggctgacaaattgttattacagtcgagggatctttttgtgcttttttggttttgtattacaacaaggttgaggagcaaatcaaagcgatgggtcctggcagctccacggttttcacgttgattgggtttctttgtctgtcaaccctagtattatttttatatcttttattggaggtataccacgaggtccttcgatcggacctgccgaaaccgaagcgctagcgaggattcaagccgaagaggtgcggcgaagaccaaggggacgcggttgcgctccacacccaagaaggccgcatgggcgaaagctacgtcgcgaagcacacgggcttcaccggaggtggaccctatcaaaagagggccacatgggcgaaggctgtatggcgaggtatacgagcttcgtgccagccgggccttgccagaggaaggcatggcgggccgtcgtgccctcaaggagccccttcgccatgactgggccgagtctgttggcccactaaaagcccatatatgtaaaagagatagcgtgcccttaataatgtcactatcataagggtaaccatgtaaattcccctgtaagcctaaaacctaagagagggagcctgcaatagagttataatagcctcttatggccatgtaatgggggatccctgaaaaatttttaccaggtaatacagttgtttctactttcaactactattgagagaaccacacccttcgacgtgacgcagttgtcgttcgacaacatctttcttttgaactatctaccactactagaaaaattgtctttccagattttccttggcgaggggaaggtccgcctgcacgcgcggcccgcctgcgaaaatagtttacgtgaacaaaaaaaattgctaccaaaaaaatcgccgccgctacagcccctccccccttcggcctgatctgggagggagggaggctgccgctgggagctggcaccacctggagccgcgttgccaccgccgagagggagggaggagagggaagccgccactgccaggacctgctaccaccttgaccctccgcgccaccaccgcttccctccaccgctgcctccaccgaagatgtgagaggggagccgccaccgccctccggccatatttgggagggagggagccaccggtgccaccgcctcgaccgtccgcgccgcaaccgcatcagccaccctccgcaccgccactatttgtagatgtgctgccttccctcctgcccagggagggaagccttcaacgccgccgccacctccttctccaccctccgcagccgcctcctccaccctttgcgaactcaccgccatcaccggtagccgctgccgtcaccgccctccggtagttgcgctgggagaggaggggagggagagatgaggccccggaggggaaaggagaggggatggagagagcatgaggtgtgaaagtgaatgagacttagccattttggtgggtagatgccgcttttaatgtgtttgacctttttgccggcggacctcttaaggtaccgtttgcaaaaatagaccacttaagaggtccgcctgcaaaaatacctctattttttttggcaggcggacaacgatctcgcttcgcgttgttattttcgcaggcggccatttagctccaaaacgcctacccgccaagaaaaaaaatgccatcgtctagaaaaatggtttttctagtagtgtacatgactctaatatttagacatgccctttttccaattattttgactttagttcgagggatctagggggtggatccaacgtgaattctagggggattcgagtcctctctaccctgttggatcaccattgatagaagaagatagaaggggaaggaagagggagaggagctagagtagaaggagatgattcccttccaaattatattctggatccacccctgcagggagcttatttctatttttttgacattaaaaataacctacagagacaaaggcgcgtgacgatgagaagattatgacatccatacgcaagcactcgtgtcatgtgacacgttacatgcttcttcgccccacttcaatttgttcccactttccaatcttgtcctttctaattaaacggttggattttgtttataaatggtgataccaatatcttgaaatactacttgatggaccataacaaacctcaatttatatttaagtttgattgagcaaggcatactacacatttcttttggaataggagatgattcaagcttcctagcctacaccttgattacatggtcagcttagtgcaaaaaatgggaccggccatcgaaccgatctgaccactaggtcgtccagttcgactatagatggccataaggcccgcccggcacggcccggcccaggcacggataggcacggcccgagagcgatcgggccggcacggcctgattggaatttcgtaccgtgccgtgcctgcccatgggccgcacgtcaggcccaggcacggcccagtagcaatcgggccgtgccgggccgacacgaaggcacgatcagcccattgggcctgggctagcccaggcacggcttaggaccagtggatcagtggaccagtaattcagtggattgacaaattcaatggatcaatggattgaacatgcaaaatttaaatttaaacatgccttagttaacaaattcaaatttcacaacttacttgacaaattcaaatttgaacatgccttagttaacaaatttaaattacacaacttagttgacaaatataaatttgaacatgccttggttaacaaattcaaataacacaacttacacaacttaattgacaaattcaaatttgaacatgccttagttgaattcacagttctagattcacatatcacctttacaaaaattcacagatcacagatcaaagattcacagatcacattgacaaaaattcatagatcacttgactaagatcacatatcacatggacaattcacagaagagtttcaaaaatcacagactcacagttgttgattcaaaaatttcaccaagtcaaattacccaaaatcacaaattttcacccaaactttcacccaaaaaacttgacttagatcacagatgacatggacaattcacagaagagtttcaaaaatcacagactcacagttgtagattcaaaaatttcaccaagtcaaattacccaaaatcacaaattttcacccaaactttcacccaaaaaacttgacttagatcacagatgacatggacaattcacagaagagtttcaaaaatcacagactcacagttgtagattcaaaaatttcaccaagtcaaattacccaaaatcacaaattttcacccaaactttcacccaaaaaacttgacttagatcacagatgacatggacaattcacagaaatcacagttctaagattcaaaagtttcacgaagtcaaaaattacccaaaatcataaactttcacccaaaaacttgacacaagtatttcaatgaataaagtagctgtgtagtgcaatggctgcctcgttaaaaacctttctaggtaaaaactcacacctcgtgagaaaaccctagaaaggaaaaaagagtgcagccccaagcattaatcaaatgttcataataaagtccaagtccaatacaatcatccagtcccagtggcagtggttacttcatcaagaaacaaattgtcaaaagagtttataagctctaaattctccatggtatgttgcatctttgcatctgcttgctcccaatctttgattagtgccaaagcttgcaccatgtcaggagctagacgccgtcgtcgctcctcgatgatcctgccagttaagctaaaagcagattccgatgatatagtagaaacaggaacagtcaaaacatccctagctaatatggaaagaataggataggtgtggttgtgctcatgccaccagttaaggatattgaagtcatcatcgtattggttgacagtgtcactgtcaagataggcaaacaactcagatgcattcatgttagcagtagaagaancagcttgaatcaaagcggtagcagaagttctcctagaaaatgcaccagcaccaagtccagatcctgcactggcaccagcatcaccaagtcagaacctggactggcactagcaccaaatccagaacctggactggcaccagcaccaaatccagaacctggactggcactagcaccagcattaccagcaccaagtccagcaccaagactggaaccacaagcagcagcaccaaaaattttcccccaagctgtctttttcttaccagaaaaagagcttggggttgccctttgtaatgtcacagcaccaaatttacttttcatacttagcatacatgtcagacaatgcagccctaacctcatttaaatatgcagagtaatcaccactaataagttgtcccataatttggagaacattgctaaaacccctgatcttggccctaggatccaagataaaagcaaatgaatacagaaatggaatctcagaccagtatgacaagaacttatttttcatgggaacaacaacatttctaaggttccaatcattctcataagtatttagatgtccagcaatctcaagaatgtgatgcataattaatggagatgttggataataaacaccagacaaaataacagttgaatcataaaattgttcaaggaataaaagaacagtttcagcaattgtccagtgtaaatcagtcagtaatggctgaccatcagccattggatggtgagatgcaataaacactgaaaaaatgaccctatgtggcaagagatgcttaagcattagataagttgcattccatctaacatccatgtccaaaccaaatttacgaggacgaatacctttagcaatgcagaagtttttgtataaagcaatgcgctgattagatgcatttataaatgaaatagcagttctaaaatcttgaagcatgggtttgaagatttctagaccagccttaacaattaaattgatgatatgacatgcacaacgctgatgcaaatataaatcaccaatataaccagacagagcaggtttaagactatccattgcttttgaattagcagaggcattgtccagggtaatagagaagatcttattagtcaaaccatattcttgaacaacagaaagcacacgttcagaaatattttcagcattgtgtgacacatcaattagcaccagtcccaaaatcctcttctctaattgccaattagaattaacaaaatgggcaacaacactcaaataatcctccttagcattaccagaccatatatcagatgtcaaagcaacagagctaacagacttcaaagtatcaataagcatagcacgtctcttgtcgaagaccttaaaaacgtccctactgatagtttgcctagagacaacactaaatctagggttgtgagcattctgaatatactcctcaaaagcagcagattgaccaaaagtaagtggaagatcctctctagcaatcaacctaaccaactcagttctagccacatccggtttatattcccattgactaacagaaccatcagcattaaacctaagcatggactgagacaaagcaccaacatttctaggtttgcacgatttaatatgcctaagcaaatgtccagtaccaccagttgaacgagcagacaatgttttatgacagtaattgcatttagcagaaacgcgaacctgagcgccattgcgctcttcaaagagttcttcaaagtcgtcccatacctcagacctggacctcttgttgctagcacttgagccagacggagcaccgttgccatcggcaccggtaccatcatcgtgtggctccggctgcgacagatctctcagaggtgaagcagtgttgccaaacacctcgatgcgttcctcctccaagtcatcttcgtcatcaccctgcgtccccatcaccctcgcctcgtagttgcatgaggttggatcaccatccatcgcaggcactccggttcctcaacggtggctgccggctgccgctcaacgacctgcaagaacaaatgaaacaacgacgagagc

SEQ ID NO: 449 - DNA, 6156 bp, Oryza sativa
gggccgggccggcacgggcacgaccccagtcggcccgtcccgtgcctgggccgggccaatttgttgtgccttggccgggccgtcgggccccgggccttatggccatctataagttcgcccccagaaccagattattcatgcatgacttgggaatgaaacaacgtgtataagtggtctagctggcttaattgttgagcatgtaatgaagcaagtagggagcctagtaaaacttacacttgcatgacttgggagcctagtgggcctttctagcctggcccatgtgcttgccaaaaccgccggttttgaggtgtccggttcgccggtttgaaaaccgcccggtttatctgatttttactggttcaattgtatatctagtccttgcagcaaaccgaaccggttgaggagctggtttcggtttttcttggtccaaccgccgggtcaggcccctttttttttactaggatggtcagtgtatttgctacatgataaaatttttaaacacgtggaggctgctgcaattttttgtggcacatggacacgatatgccgtgccacgaaaggacgcagttcacgcaagcatgaaaagattcctaccagtaagaagcaatatgtttctagtactgttggacggtggcaccagttgtatatgtacaacaaccaaacccagtgtgtatgtacagctattgccgccgtccaacagtacttccaaacatgaggttcgaaacttgtacaggcatccaggatgtttctgtgaggtgaatgtcgaattgtcgatggtgctttctctagtaggatgtaccgctgcaataattagggatgaaaatgggagcttctagcttgcaacggtagtctcgcatactaaaattccatgatgaagtgtcctgcaatggtgatgatgatagtagaaaatagggaggcatatgtgtagcacaaatagcaacaattaatgaaccaaataaatagtcaagcagaggtgacgacaatagagatctgaaacgaacctgaatcttgtacgttaacaccggccaccacagaaactataaccataatgaatgaacctgactttagcatcatgtgccttgacgctagagagaatccactcagtacaactgagttttccctacttctacaatctactactgattttatcaagttgaataatatgctatcgtgttttcttgaacctatactacatgccatcgtcatctacaagccgttagttgaacatctgttagagctttagttgaacatctgttagagctgaaaaaaggcctatttaccctaactcatgttttattgtgtgtcagatactacttccttttacttctccgcgctcgctacctttgttttcaaacttacaactgcgttgaaattccactgcctttttctttcgaacttactgctgcgctgaaattccactgctattttatttcaaacttgctactgcgctgaaaacctgaaattcaccacattttgaccccccataatacgcttaacaattccggcattattactacctgcatttttttttcgcagcagcatttcgttcaactgcatcaaaatgtacatggacggatatttgtataacactcagaaaaaaaaaatccattcccatgccactttactcgcgcctcgtgagatgactaatacagattacaaaatgagagatgactaacaaacgttgattaccattcactagcaaagcaggagcaacggcataagtcccatacagccaggttcagagtcaaaaaaaaaaatcacaagaacagtagtacagtcggccggccagccagcggcgcgtcgatgggatcccggcgaccggccgccgccacgcttcgatggggagcccagcgcccggccgcgcgtcgatggggagccgggcgcttggcagcgcgtcggggactggggtagtcagcggcgcgtcggggacttgggcggccggccttccatcgatgggagtcggcaccgcctcacactgggcagatcaatttggggcaggagcacggctacggttttcagccaactagtgctatagtgaaaggatattttagtcattaagaaaaaattcaatacatcaaacgggtgccaactaacggcttgtggacggcgatggcacacagtagaggttcaagaaaacacgatggcatattattcaaattgacaaagttagtggtagattatagaagtggggaaaactcagtggtactgagtggattctctcacgctagagacccaacatctcaatgtcatggttcttagcactaaatactggttataagccaatatctctgacgcttagccactactagaaaaactatttttttcagatgatagcactgtcgacgggggatacccgtagaccggatatagagagtattggggtccgttagtacgaggatctacatagtacgacaacaggcaaacaaaagaaaagaattatactggtttaggccccttggtaggtaatagccctaatccagttgatatgggattatatgatggaaaccacaggttacaaagggaatagcggaactcaatgataccgatgagaccgtagtcgagttggttcaactagatctcctggcgacttggctcctgcacgctccggctccgtaggctgtggtggatgttttggcagtaatattcgatgccttaggtcctgccagggggtcccttatataccgcgggttagttgatcctcaagtaggactcggagatatcggacccctcacgatacagtaaagactcaatctcgaccgagtaggactcctcccatccgtagattatgtttctatcacgtgatagatttgcttaacgtatacggaaactatccgtatacgcgtgggtataccgtattagtatacagcgtacatccaagggtagagggtatatcttatccgtaacactgatagtagccccccgacttctgcttaaatgaactcatgttatcgatcgcaacttttgatgtcgaaattgttatcgttctcatctgatcgatctcggtgtaaaaaaccgtagagacaaagagccatcgacaacaccgcgtgaagttcaatggtcatgagtgaatttaaattgatgtctgaaaactaccgcgcgtaacagacctagaattttccggcggcaatctctctcctttccttgggatacgcaccatcgatagtgcgcttatttatagggatttcgggaatccattcgaagtccgtttgccagaaaactctcttgccttgtagcgctcttcgtcttctccgctccccgcaaagaaaaccctagcttatttccttcatcttattctccagcgatcctttggcggcgatggatcttgagtagtctaccttgaacaccgcattcctgaagaagctgtaggacgacggtgccctccctagtcgcgggactttgcaaagggaggctggaggtacagaacctgaactcatcttgggccccatgtttgtggtcgaggattatatttcttgcggttttctcccttcgccttccgaatttcttcttctagtcttgaatttctacggcctttctttgtttcacttgaaccccaattccttcgcatttcttagcatcttctctcatcttttagaggcctacattggggtagtgccctttcttgacctcttttgcttctattacgaattgcgtttgatggaatccaacagggtgtctggatgcatcggattccgacttcggaatggcctgaagtcgcgttatatccccttccagtgcccttcttattgtagcaagtggcggacgagatggttctatctctagatagaaaactcggaacccgtccttgttgtccctaaggatcagccagaagaaatcccagagtggaccgcaaaaccagccctgactccctccctccaatctttcatcgacatcattgatgatctccgaaaacggcggttgtcgggatacgaagtcgctgtcgacttcgtaggtcggtggattgagccgctgcaggcccgtgcccatccggcctttgaatactctgggccagaggacacgacccgggtctctcctcagggtattttttctcgcatttctaattttgttccgagtgcatctgtttctcctgacttatcgagttctcgttctcgatttataggtctggacagcgacactgtgggacgtcacgttggtcagataatgatcagcgcatcctcgaaggcggacgatatccccatcgcactctgcaacaaggacgcgaccgaacgcgccgccgcgattaatgtaagtgtattcgatgattcctttacatctctcttctcggggtcgcatcgtgacttcacgttgtgcaggctctccctctgacgtacgccatcggacctctcgtggatcaccaggcggcaacatcgttgaaggagggcgttgccaaggaggcatctgacgctgttgctggtggcagtgttccgaagaaagggaggatattctcgtccgtggtcaggacccgctggaaagcgacaagctccgcggtaagcctctctctcgttctttagtgcgtagtcggaatgacttgacctcacaccatttcatcttactcatgactcggacgcatctcctccacctcagcaaagccagaggttggtgacgatcagcaagaagtaagtaaacgttcttgaggtcttttcattctcgaagttttgattgtctaccgtcatgaagtaaaggaaaatcttcgcagaatggcgcaggcgaaggtggcgcaaggtgggactgatgctgcttccagcgtgtcccctgtggcgacttcgactggagtcgtggtcgctactaaggaccaggaagcagcaccgagtagccctgccgtcagcctcgtgcctacccggggcttgtccaccgatgccctcaccttggggggagctccaagcggagatggagcgcatcctctaggtcggtgctcgcggcgtaggccgcgagatcaaggaggtgagggcggcggcgtcgtcggcgaatcagcgtaccgatcagctggcgcgcgatctggcggaggcccgcgaggacctcttaaagatgagggagttggtagccggaaatgagatgcagcggcacggacacgagcaccggatgtcggagctcgagggcgacatgatcgacatccgaggttcgctgtgaatgtcgttcactagcctgcaccaacttgccagggagtgcggcgccatgactaccatcccggcgaacctgatgagttctcactgacgtcatcactcacggaactggctacgacgatgggggaggtttgtaaggagctccgagttccccgtggagaacccgaggagtcagcgactggttacatctcgtggttgaatagggcctgcacacagctcgaagggattggcaagcgcatcgatgaggccctgaagcaggagtgccgtcgagcgagccgctatgccggaggacatgtgatggcctgtatccgagatcaccacccgcagctgcacctcgagttcctttgtgaagggttctcgcattctcggaggacgcccgcggagatcgacggtcttgtgtagtcgatggcgccgcttgccgagaaggttttctgctccatgcattggcgttggccgtcctggtagcttttgtatcctatagaaaaatatctcaaggaagcatgtaatatactttgaagtatttgtgacttgtaagaaatacttgtaaaatataaatggaatctatctaagttttcttactctgggtacgctgtgaacgagtgttttctcactttccgacttcagccagtcacttgagccatacactctccctagctttgtgaattgtcgcgaccgagaaaattgccttttcccgaacgctagtgtattaatccccatcccaggaaaagccggggtacaccacacaaacatgatacaaaaggccaacctttattatatcgataatatttacattattacaaagacacttcaggcctgacaaacaaaaataaacagcagcggactagcgggcctatggctccatcttcataggcgctcaactggggtataagccaggactccacctaggatttcttctccaaagcttctctttctgaaggggggagagatagagcaagaatgagtacaacccccgtactcagcaagtcacaccgggagatgcatgattaatgcaagggagtacaaggggtaataatataggg

SEQ ID NO: 450 - DNA, 12049 bp, Oryza sativa
ttattaatcaaggccggtggacccacacggaacctgcctttagcccaaggcttacgataattcaagaccgacttggcaaaccggacgtgggtccaagctcgtcccaagccaaaccagggcaaaccttttcacattttagttgttaggcaaattttaagaattaaccccttaacttgggtacattgctaggattgcccatatcagagggcacggctattcgaatagatttactctgatcagaggtgtacatctttacccacaagacacatctttactccgcattccatggccttggaacccgtcataaacatgtgacataacccttcacccatcctagccgtgaacaaaagtaccgacccaaccctgcctacagccggtatcccgggacaggcaggccaggattgagccattagcaataggatatagaccgggtgcgccacacgcataggggtgagaccacccgcatactagtcaagtgccatggcatctcgactaacgggcatcgacccgtgtagtcttcatttgcctagacatctcgattaccgagtcatagctcgtgtagccttcatttgcctcagagatatccatcgtcgcaacgacttcatccatctctatccgtgtccttttgtttaggactagactgagcaccgagttaagccttacccattagacatgtggttagtacggtagtgctttgtaacagaggcccgaagaccggtccttatagtggccgaggtgttactggcaaaaccctgcacctcgagcccagcctaaaactattttgggagttttgaatagagggggaaggtgtgtgttcaattccaacataagccagccattccacagtgtccaaatgatatgagcattcccaaagtctaaagttataaaaccacctaatgttgcctaattaatcagcgaagcatctacctaaattcatactagtggaaccgttaatagagtacccactagttggggttttgtttatcctagggtgaacaaggtaataataaacaatagcaatgataaagctataacaaggattaataggaagtgctaaataaaatagtgataacgcaggaatttaaataaagcggtaatgcaataatttaaatcaaaataatttttaaactgggattcaatatgcttaagggtgatgtgacttgccttgctcagagagaacagccttccgaaccttcggcgacgaccgcaaaccacgcttcgagaacctccggaacgacagaagctacgcgaagcacacaagcaaagctacaagcctataaagaagcaataacaatacataaaaagaaagcacacggttctttaggttataacaaacattaagagacttgaacgggtcgattcggggttcgtatgaccaagatatgatcatccgaagtttattgctgttacatggagatttacggattattgtgattaggttttgcaaatataaaacatgtataagcgctagcctggaaaagacaggaaggctgtgccgttgacatgtggaccccacatgtcaacctaagggaccacagtagaccgagtacacagagacggtccatgggtcgacggaagcggatcccatgtgtcaaccgaggcgaatggccgacaaacggactcctatagacaccacacgggctgcacacgtggaaaccacgcggctaccgagcgggcacactaacacggtcaccacacgcataagcgaacgactaccgacaccagtaaacgggtaccggggtcgacaaccgcacaacgggtacggggcgacaccgaaaggacgaggacggggcagtgagaggacggatccttaccaccatgcgatgaggcgtgggaacgacaaagacgaacgagcgcgacggagacggctcagggacgacggaggcgaacggcgagggaacgacttcggcggcgatccttgcacgaaggcgagacgcggccagcacaaggcttgacgacacggagccgaggacgaagacaacgacggggctgcagcggcacacttgacggacgtggacgacagacgagaacggcttgatggagggacgaacgccacgacgaccgggaacgacgagaggacgacgactggaaccagcgaggaggcgatgagggcagccggcagcagctgcacggagacgaggacggcgcggaacacgccactgcgatgccgaaggtggttgaggtgcggccgaccggtgcacgggcgaggagggacgggcggctgaacaacttcgacgaggcggatggagaggttcgtggcgatgtgcggcggcttccgggcgaaaccgaggggtggacgaggtggagggctacgtcaccgtgccgagggaggggacggcagcgccggctgacgcacgggcatggcagaaggggctgccggaggagacgtcgacgaggaggaaggagaggccggtgcgggcaacggcgttctggcgaaattcgggcgacgccgtggcctggccaggaaagaggacggcgtttcggtgccgggagaggtggtggcgacgtcggccggcgcacaggggacgtggcagaggcggccggaggcggaacagtggcggcaacgccactgttgccggcagggatgcacttctggaggtctccgcgtgaaacagagggcaggccggcgaagaggaggcggctgcgacgctagaggaggccacggcacggccggccggcgtgctaacgcggcggcaggggcggctgaagatggccggcggcacgggagagaggggacgacggcgggaaggtggctagggacctcgggaagactcgggaggaggcaaaaacgagagaacgcaaggagggggttccaatttataggcgcgggtcgggagctggccacaggagagggtggaacggcggcggaaaaggcggccggcggccatggaaggtggccggggttggcgcgggcgttcccgacgattgggggcacgaatcaagggggaaattagggggaattgaagaggaaggaaaggggattaattccccctaatcaattttggaattcccggtttgaatcgcgtggattttggggaggaatggcgctagggttcacgggagagaaagaaggaggccgccggctggaggtcggggacgcgcctgacaggcgggacccacgcgggaggcgtcatcagcgcacgcacgtgcgcggcacgggcgggagggcgccgctcggcttgggtggggcggcttgggctaggacgtggcccaggcgggaggggaggaaaagggagctgggccgagggggaaggggaggcccaagagaaggagggagagaaggagagggagtgaaagagagggaggaagagaggactttggccgcgggccgagagagagagaggactttgggccagacttggcccaaaggaggaaggaggattatttttaggcttttctttttaataaactttgatcatagttgttgttgcttaataaatatttccggtgctctgaaaatttaagtaaaatttgagggctctttttagaccaaggagaatttaacaaaaattctccgggccacattcgaatttttcttgaacgtattttagtgtttgccaatttcttttcgaattttaattaattctattattctttttagaaaatgatttttatttcgggacaaatttatcaggacgtgacaataaggctcttggacccttgacctgctgtagacccccgattttggaaatcggaaatcttctgtgtttatccgtaccaatccctagatcagtagttggtacacacatacatagttggatcacaacatatcacgaatgagttcaggctaaaagagttaaatacttacattagggccaggtaggccaacaactatcagagaacaacagcggaagacaaaatattataagggcccggttaacatgccacaggcagtcgacaaggacttagaacaaaaccgcaatccgatcatcttcttggatacgcaagcgtaccgacaagggcttctcttcaacactctcctaaaagatatataaatagcaagggtgagtaccaaccgtactcagcaagccaccacaacaacaatgcatatgatagaggtatttcaaggaatggcttcaggttcctttgcgcaaagcaagttttgcaaatcttttcacaagcctaagacctagcatagactgattaagttttaataccagtgtttacattaaacaacgatggttctgtccaccatccattgtgatcccaaggatagcttcccgccattgagtcgtcatggttttctgaggacgtccaccttccctcctctcaggaagtggctccatcagcataaaattcatcatgcaatatcccatcccacacatgttaagaatttagagtctagccaagtgtaatacacgtcccggtgctcaataaccgcgagcacggctattcgaatagatttggtttactcacactgcagtggatgtacactttacccgcactccgtgtcacgtcctgataaattcatcccgaattaaaaatcattcgctaaaaggaataatagaattaattaaaattcgaaaagaaattggcaaacactaaaatatgtacaagaaaaattcaaatgtggcccggagaatttttgttaaattctccttggtctaaaaggagccctcaaattttagtggaattttcagagcacaaataataattaagaagaaataaacaaagttaaaaaggttttgtaaaaagaaaaaccctaaaagtcttctttcccccccttcccttcttgggccggctcggcccaactccctccctctctctcctctcccccgcggcccatcggctcctccccgcgcgcgcgccgctgacgggcgggcccgcccgccaccctcgctgacgggtggggcccacccgtcatcccctacctcgcgccgcgcccgccgctcgcccgtgccctagcgccgccgccgccgcggattccgccgcatcccgccgtccccgcgcgccataaagagggggaaatcactccccgtgattccctctccctttccccctatttttccctctctctctccctcggattcgttcggatttcctcccgcaaacttcgccggcgccatcaatggcggccggatcttccgcgccggtttctttctcctccggccgccctctctcactcccaccgctatttaaacgctccccgtgcctccctcctccgtttccgaccctcgccgcactctctctccgtcggattcgagcccgcgccgtcgtcctctctctccgccgtcgccgccgagctccggttcaccgccgtcgtcgccccggaccacctcccgcttcggcatcgcttgcttcggcatcgctgtgtccttgccgatctcgtccactcctctgtttcgcccgccgaccgccggagcaccgtcgtcctcgtcgacccgagccgcgccgccgcctctctccacttcggtcgccgtttccgtcgtcgccgtcgacccggggtgagccgaggaccgttgtttcacttcccccttccctcccctctctcggccgccgctccgtcgcgccggaggtcgccgccggtgaccatcggggcgcgggcgcgccgcctcccgtcggccgtgccggcgaggccgccttcgggcgcgccccgcggctgctaggtggggcccggccgtcagccgcccgcgccctcggtgcggctgacacgtgggacccacggcgccggtcggcgtcagccgcgtgcgcccggtccaccgtggaccgtgaggctgccgcgtgggccccggtccgcgtgtcccctcccctcggctgacgcaataaatccaattttaaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcacccttggataaataaaaccccaactagtgggtactctattcatggttccactagtatgaatttaggtagatgcttcgctgattaattaggcaacattaggtggttttataactttagactttgggaatattcatatcacttggatactttggaatggttggcttttgttggaattggacacacacctccccctctattcaaaaaccccaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgagggagatgtgtcttgtgggtaaagatgtacacctctgatcagagtataatctattcgaatagccgcgccctcggttatgggcaagctgagcaatgtacccaagtcagtgttttaattcttaaaatttgctcaacaactaaaatgtcgaatggttggcctgggttggcttgggacgagctgggacccagggtcgggttgccagtttggtctgaatcatcgtaggccttgggttaaggcaggttcgtgagggttcacggccttgtttaataacattgtgtagctctaggatcgtccttataaaatggctttgggcaactaagtgacttttaaatgctgtttactgcaaaacttaaccccaatattattatccccttgtacccccttgcattaatcatgcatccgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatctcaactgtaggataagccaagtggataaaacctaaggacatattttataaataaaactatttccgaaagtccctttttcctcctttcccctgtgctatttgcaaaaggtttactcccttcttccttcttcagatttcaactagtactagttggttagttttgcgaagaagaagatgtcgccaattgttcgccgaaggtccggaagaccgcagggtccgctagcgaagtggaggaagcagtgaagccagctgtgaaggagtgaggatcttgggaacccgtcgcagaacctaagccaccctctagtgtttcgtttgttgtgtgtttccttgcttgtgtgtgtagtgtgtggtttgcatcggtgggttgtgatgtgaccatgctaggttgtttgcttaatcaacttgcagaataagtgaaacaaataacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaacccaagttttcaactcaatccaccactggcctcaagagagttaaccagggcatacccttggtccattccaagcatgctgcttagttcacagctaccattagttggaagtcaagaccaaaatcagtatgtgtttgatcgagcatttgccacccaggtcaatgagcttccaatgctagaagaggatgtccccttttgtcacgattgtagagagcaaggacactatgccctgaattgtccatgggtatatgccaaagaagccccttcctttggtttagcagggcagacatcgctaaaccagcctcctcgcaccaagtcaagcttgcagcctagtgtacaaaggagagagcctaatggagagaatccattgaatcccgggaattgctttcctcctagcccttcgtaccacgtggggtcacgtgctaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcaccttctaagccatggtggcagagtatctgatagtgaagggtcagatcaagtctcctcggattatgaagatgagtctctccgacatctcggcgaggaagagatggaatcaaaagcatgcccccgttgtggagaaattggacacgttgctagcctgtgtttcacactctgcccttattgtgaggaagaccatccaccaggtaaatgtcccacccgcaaggtcacatgttttctgtgcgaaggtaccaaccatgtgcccaaggattgccaactcagtgtgttgttgaccaagaccgcagaaatccaacgaacaaccctacgattgtctcatcagctagtcagctccaacatcaacatcgacgatatcatccccagcaccaatgctcctcctgctgcacctgactctgcagtaaatcatagcaataataccttcaacaccaaccattctctgcaccgacggcctcagcaaagaattgtcgtcgatggaagaagttgtgtctctccccgacctactccaggccgagcgaagggcaatcaatctcaggagtgcgataccaagcagaagaccgttattcgcctcaatcagcaatcagaaggaaacttctcttgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaatatattcatgattataaacaatgagtttgttatgtttatggaagattcatgttgaggatgcaaggtaccgatgttaagcaccttccctttttgtttaaggcagtgccttgtattcatgtaataagggagaaatgtgtaataaaaacaagttctatgagggttattttggaagatgctgatatggaattatgtgtataattgtttactgtcaaaggagacctagggtctcatttcagaggaactatgttctaacctcgagttaaaaaccaacctgatgatagaaaagaaaatgccgagtccgggaagatatctgttgcttcaattgtcaaggaatgggtcatttcgccgacaagtgcccaaaaccgagaaacatagctgccagcacgtcagtccacgcaactccttgcaatcagaagcttgctcctcagcgaattgtcatccatgcatcccgaagcagtcctatagcccgcattgcaacagctccaactccagcgagtgcattaccacaaggtgtcaatgctcaatttcagccccagccatcagttgacaagacagaggccagtatcggcattgtacctttggatgttccagcacagcagccaagaaatcaagtacaagatgaagaacccgaacgtaagaaagttattgtctgttacaactgtagtaccggttaaggaagcagacatgccaatcgccaagtggtcactggagcaaatgcagtacctgataagcctaacgttagtcagaagcaaccataatactcttatatcagtgttcaaatacttttgttttatagttgttccccgtcaatcatgtaataacagagaaacatgagataatgaatgagcttgataagcttatgaaggacccatgttaagattgcaagtgctgtgagttgtgcacgttttgttgttgattagggagacctagggtctcattttcgtaaacccatgatctattaggaatcaaatagcctagcgattgatggcgaagaaaatcaagtgatcaaccaaagagacatttgtttggactaagagtttcagatgtgtctcttcggatcaaaggcaacaatcgtcagtctagcttttgacgaactacttcaaggtttctctgagagacagcacgcccaaggacctcattgccccagaagcatcctcaacacccggagcgaagagtacctggttgagaaaggtcgaaaggtgattaatggaagagatcggaaaagatgtttggttactgggaaaagaagtaggtcgaaaggtgattgataaaggataacgagaaccatgatttgtgtcactcgaggaagactcccgatagcaaaacaaccctacaacagttgcccggtcattaaagtaggtgaattcacgagtaagagagatgaccacaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcactagcatcgttcaacgcactttcctagcaatcgatccatcgagaaagaacacatcaaggctgaaggtgcaaaggaatacgttgaatgctaaatgatgacaacatgaagagaatagtggaaagtaaactgaacataaagaaagtgaatccgagttgcttgttcgtgagagctattcccagttatgaatcaagtgatatgttcgaagataatctacagaggtcagattaaaatcacatctaacaacgaagcctcagatttggcaggataatgattagacaataacaaatccagcagtaaagccatttgggaagacgtcaaagtatgtcaagtgggataagttggttctctggtgaagcataattcaaaggcaaagttatcgacccttgcatcaaatagcagaagtagctatcacccggagaccaggaaagctaatatgaggcagttggtggcaagttagaagtaaatgacaagcatgatattcttatgatgacaaacatggtatcctagtaatgacaaagctgatgtcgacgcatgtcacgaaggtggtaacttgtatgaggttgacgccaaagatatgaatgataagaagttctagaactgaagccccatcctcaaccaccgcagcctagtctgagtcagttaaaggtgcaaccagggacaagtcgggtgaagagaagattccatctgcaacaggagatcgagccaagcagtccagagtggagaagtttagttagacaagtttgttatagaagacagagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaggaataatgaattaatttaaattcggaaagaaattgggcaacactaaaatacgtacaagaaaaatt

SEQ ID NO: 451 - DNA, 2921 bp, Oryza sativa
taagggttcacggcccttgtttaataacattgtgtagctcaagaatcgccctaaaaaaatggctttgggcaactaagtgacttttaaatgctgtttactggaaaacttaaccccaatattattatccccttgtacccccttgcattaatcatgcatccgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacactccgcgactgcccaacacatgagcctcgtcccgacacatgagacgcgtcacggcaaagcttttcgataacctcgcattggcagtacccgctccatgaacataaatcctcatgaactctaggcgtccatgtttctagcagtgagaggagttctggcgctcccgggaaagagaaatctcacatacatattatattagggttcaagttaagttctctctcacacacactcatggcagtcctaccaatggcgacaccgatgtagggctcgcctctcggccctacctcaacggctgttccaccgtagcgcacctgcctcactctggggtgaaccatctatgcagggatactgcctccgctcggctatctagtccgctaggtctatacccatacgagaagtgtggttgtacgggggtcgtttcatgcttaacttcatggctcagtccttaattgaccggggacggtactagccttttccagataccacccaaatcctccgtccgccccagtcgaaaacagttgttcccactttattttcctttcacaaatcatgtcatcaatttcatggcaatgtggcgctcatgtcttcacatgccgcatctcaattaccttcccaaaggtaattgcccaagcatttagcatttgataaatatgagtctgcatgatcctagaatagcatttctaagcaattgtcataattgactggggactcatacgtaaacatggttacgaaggaataagggataaacaataatcaaggcatggcataatcacaagtaggatgttcatcattgcatgcaattttatttataaacaaaataatttcgcaattaggatcaacatgttcaaggaatagtgatgacttgcctgctcatgataatccttattctcgatataatcttgatcaaccttcacctcctggaagttgctgacattgcctcacgactaaccgatacataaattctataatacgcaagaaaaaccaatattcaaacaacaaccaaatatgcacaacaaaatatactattcgtgtctgcttaatggattccaatcacgctaggggctaaggtttcttaatctttctattgtcaacgtggcctatttaggagttaaccaacatagcatttatgggatacatatatttttggctaatcggtggtttagtctatcaaatggctatggaaggattatggctatgtatgcatctatctaaataggacggttatatactagaggttctgttgttagatggatttaggatcaatcaaataattacagtgaatcatttgtattattattttattgatggaagctttactttaattatgaacatattttacttgtcacaataaattataaaaggttaataattatccatgctttgtatgttagatttgtttaggttaatcatattatggttacagattatcccatcacaaaattttacaatgaataatcctaatttacagttgaactataattataattatatgaggtgaagatttataactagtatttatctaatatacatgtttgtcatacactccctctaaattaatatatgcaacacgcaaattaatactataccgtacaactataatgggatgtatagtatatgtgtaagcaacaatattttattattagatcatatatttgagtatttgctttttactgtaagctatacaatacatgttgattttaagatggctctgtttggttaactaatagatatcaaccgactatatatatatattctacttcacatgacattgtatcaactaatttttaagtagtccaaatacaactagctctgtgattactctcctaaacaggttaaagattcatctatgtgtgtttatattttagttacaaaatatgaggctaaactttatgtaagtaatttataagtcatggatttagttatatttggacataggctagtgaatggcactaatattttcctttacacccattaatttgaaggattgattataactaatttatttggttgctacagtgacaagacatattaaagataattatgctactgtacaatatccatttttatttattggcacactatttaggttaactattatctaatcatttgatattaattaatttataattataaatatattttattaaatagtgaattatatatctttggaaagcttatgaatttagatgaatttaggttcaagtttcactcaaatccaagttaaaatgaataagttatgctagtgtaaagattcaaatttgaattaatccgagaaattgcgaaaagctactgttcataaacgattcatttttaatctaagacatatccacagccttgtaccaactgacaagtgggaccccgggtttatttctttttcctaccgaattattttctaaagggaaataggaagagctaatgacaagtggggcccacatg

SEQ ID NO: 452 - DNA, 16114 bp, Oryza sativa
acggcgacgggcgcgcggctcggggcagcgcggggctcggcgcgcagtgatggcgacgggcgacgcgacggcgacgggcgacgtgacggcgacggcggaatgtcgatgggacggcgacgcggcgacgggacggcgcggcgcggtgcggggcttggcgcgcggtgatggcggcatgacggcgacgggcgacgcgatggcgatggggcgtgacgcgcggaggggtggggctcgaggcgatgcgaccggagatggcgacggcgcgcggcacgatgggacgtgagggggcgcggcagcggcgaagtgatggcgcgcggcggctcggggcgcgaggcgcgcgcggcaggggagatgggacgggcgcgcgacggggcaggggcgcggggcgcgaggcgacgacgcgacggcgacgacgatggcgacacgagcggcagcgggcagggggaggaggaggggtaggacggctaggaaccaaatcgaacacctagggggctaatgaacagtgatagccggctatttaaccctattttagcctatttcctatataaattttattctataaatcctaatttttacacaaatgaagtttactcaatatttgtgttattctaaccaatggattcaccctatattaatattacccatatttatttatttatcacacaaacgagttctttttagaataatttagattattggccctaaagtgaacttatatatttttggaagactttggggtaaattgaatttaatataacgacctgtcatgattaatacattagtagattggtcaagtttagttgtatagcaatatattttacacggataggttcaatctatttattctataaatagtaaattgagactcggcacaatattaatctaattgtttaattaaaacctcacataattttataaagcttaatttaattatatgaccattatttcatgtgaattggtttacctttatatagaccattataatttagtaatatcccattaattactcctagtgaaactatgttatagatagagttccactataaatggtcatcatttcatgtgtatttagatgtcatggcacgcaacacatggttcaagtatttagtaattaatccataatttaaattagtaattaaccttccgtttgtctggctttgttttcttgtgcgtaattatttgtagggttaacaattaaatattcacgtaaatttatctattacttaaattttagatccttactttactttctttgtgatcatttacggtttggcaagcaataacaatcataacaaccagcatgatgcaaaagttttaaaaagttcaaaatttttgtgatttttattgtcttgaattttcaggatgttacacctgccttggttgaaaaagcactgaccctagcccccagccgtgaagttggaaaactcaatttccgattacatggatggtgagaactcttacaataccagatcttacatggtcgtttgtctctgcatgatctgacaaggccttatccgctctgggcgtccccagccgaagttcccttaggttcctcaaaggccttgccaggacggcgtaaagggacatgaggataggtttcaactctaggtgtcgtcgtggtaagggatcgtcgggaaggaacactttgacaatattctttacctgaaatcgactttattgaaatcgtgagatgtcttacaaatttggatactattgatttatatgtaaaatttacataattgatcaatgttccaggaatttgctaactcgcgaccctcgccatctgcaatcttgaatgcgctcggccacaagacttgcgtgaccgtgtatggtccttcccacttgggtgagagcttgttgcgccctgcttggctttgaacccgtcagaggacgtaatcgccgatcgaaagtgtgcgtgttctaatgcacttctcgtggtatcggcgaagggcctgctggtagctggctgctctgacggcaactctttctcgatgttcctcgagtagattcacatcgtcgcttcgctgctcctcctactcttcgtcggagtacttctgtactcatgtgctctgatgtcgtagctccgtggggagcatagcttctaagctgtacacgaggaagaagggtgtctctttattcggtgttgtcagtatggtacggacagcccatagaacagaggggagttcttcgatccacttcttattgtgtgacatgagtctgtcgtagacgcgggtcttgatcccttgtagtactatatcgtttgccttttcgacctgtccattgctttgagggtgagaaaccgaggcaaaacaaatcttgactcccaatccaatgccgtaatcctggaagtcggcactgatgaactaggagccgttgtctgttatgatgcggttaggcaatccatatctgtagaatatccctttgataaacttgatagcattgtcagccttgatttcccccgtgggcgctgcttcaaaccacttggtaaatttgtcaatagccatgaataggaatttgtagccgccatgtcctcgtgggaatggtccgagtatatcgagcccccagcacgagaacggccaagtaagagggatagtctggagtgcttgcgttggcatttttgtgtgtttgctgtgaaattaacaggcttcacaccgctgcaccatgtcgcatgcgtctttgagcgcggttggccagaaaaacccttgtcgaaaagcttttcctaccaatgtccgtccgccggcgtgtgacccgcagaccccttcatgtatgtcgagtaggagatgtttgccgtcatcggacgagatgcatttgagacgtactccgtttggcgcctttttgtacagatcgttgccgatcatacaatagatcttggcttgtcgggttatcttcttagcttctgcgtcgtcatcgggcaactcgtcgctactcaggaacttgatgagcggggtccgccagtcgtctgtggtctcgatatcggcaacgacgtgttccgcctctgtagcccccgagctgatgtcggggacaaccgtgctaccttcgtcgtttgcctctttcaccgatggttttgtcaggacgtccagaaaagtgccaggttcgagtggctctcgtctagaagcacgccgtgctacgtcatctggttcgatgttgtccttatggtatacgtgtcccatcaaaccttttctccagcttcctgacttctgcgaggtacttggataactcggggctagagcacttgtagtctttttgcacttggttcgcgactagttctcaatcccctttcacgattagtcgtttggctccaagtgcggctgctgctcttatcccggcaagtagtccttcgtactcggctatgttgttggttgccctgaagttgaggtgaattgcatgcttgaactgatctcctgaaggtgatgtcaagatgaaccctgcccttgctccttggctgttgagtgcgccgtcgaatgccattgtccatgtttcgctgtcggtttgactgtttgacatgttttcaggcatagtccattcggctacaaaatcagcgaggacctgggtctcaatagctattcgtggcacgaagtggacatcagactggcttagctcgactacccatttcgcaatgcggccgacaacgtctttgtttctcacgacttcttcaagggggaaggaggaaacaactatgactctgtgggcttggaaatagtagcgtagctttcttgatgtcataattaccgcataaagcaatttttggatctgtgggtatcttgtcttcgcgtcgtggagagcttcactgacgtagtaaaccggtctttgcactttctctctctcgacaacaatgacagtactcatagaatatggtgtggcggtgatatagaggaataattattcattaggttggggagcaacaagtacagggggatttgacaggtagcgcttgagcgcgatgaacgcgtcttcggcttcctatgtccatacaaatttgtcttgtttcttcaataaggcgaagaaaggttgtcctcgctctcccatcctagcgacaaacctgctcaatgccgccatgcatccagttagcttttggacttccttgagtcttgtgggcgacttcatgttctcgatcgccttgatcatctcaggatttgcttcgatccctcttccggagacgaggaatctgaggagcttgcccgatggtactccgaacgtgcatttctctgggttgagcatgaggcgatatcgtcagagattgtcgaacgtttcccggaggtcatcgatcaatgagtcgctggtcttggtcttgacaacaatgtcgtcgacgtaggcctcgacattgtgtccgagcttgtcattgagtgccccttgaaccatgtgctggaaagtgtttcctgcggttatcagtccaaacggcatcttgacatagcagaatacaccgaaaggcgtgatgaatgatgtcttctcctcgtcctcttttgccatgctgatctggtggtagccggagtaagcgtcaagaaatcttaacaactcacaaccggttgttgagtccaccaattggtctattcgagggagagggaagtgatccttgggacacgccttgttgagatcggtgaagtcgacacacatcctccacttcccgttggccatacgcaccatgactggttttgctagccactctggatggagaacttctttgatggaaccaactttgagaagcttgtcgagctcttctcgtatggcttgcttttgatctggtgcaaatctccgcagtttttgttttactggcttggcatcgtgtcgcaccatgagtttatgctcgatcacctccctggggactcccagcatgtcggacggctgccaagcgaacacgtctgcattgtcgcggaggaaggtgatgagcgcgagttcctatttctcatccagtgacgccccgatcttgacagtcttgtcggggtaggcactggagagcggaatgatcttgattgcgccatctggctttggcgtcttgttggttttgctcactttcttgagcagctcagctgtggcggatgggttgggagtgtgctcgaccatgtcgaggctctgcttgtcgcactgcactgccagcttcgcgtttccctgaatagtgattgttcccttcggcccaggcatcttgagcacttgatacgcatagtgagaagcagctatgaacttcgcgagtgcagtcctcccgatgatggcgttatatgctgtgtcaaactcagcgacatcaaagatgtttgcttggccaaaagtcactggtagcgtgatcatgcccaatggcttggatgatgactgaggagtaatccaatggaagggttgatcagtgggcgtcaactcgcttcgtgggatccccatcgcgtccaaggtactggcgaagagtaagttgatgaagctgccgccgtcgatgaaaacccgtgcgaccttgatattccgaataatgggcttgaccatgatcggatatcgccctggagcgactacagtcttggggtggtctgcctctgagaactcgatcttctgctctgaccacttcatcttggacgcagccccctgccatgtcgaacaaactttgcgctccactttcttgtactctcgctttgaggagtacgccgtggaacctctgaagatatgcgaaacatggaggtcgaagtctgggtacgctgagtctgagtcctgagtagccgcttctgcggccttctcgactacacgtactcgcttgcccttctccaacgccaattgcttcgtgagtgcctttttgaagacgaaacaagtctccagagagtgcttgtccaatttgtgtatagggtaccatattttcttcgtgtcgtcgccttgtgggtatgggtacttgggtgggtcaacaggttctgctgttaggacctccgtttgagctttccgtttcccactcctgcgactgtttttcttgcttgactcaggtgcgtccttggctgatttcttctctcctcctgtctttgccttgtcgttcttgcgtctcagtgcgtcgtccgcgtgagcgcatcgatcgacaatctcgaatagtttgtgagcagttgtgatctgtcttgtcgccaattcctgggttgtgtagcgatctcggacaccagacttgaaagcgcggattacagaagcatcggtgatttcgaggatcgtatttctgcactcattaaagcgccaaaaatagtccctcaatgattcgcccgaattctgcatcaacgcgtgtaggtcatccttaatcgcgtggcgcttgtatgttccttggaagttagcgacaaactgttgccacagatctgcccacgaggaaattgagtagggtgggaggtgaaccagccatgaatgtgcagatcccttcaacgctgccggtaaataactcgccaatgcgttgtcgtctgctccggcagcatagagtactgtggagtagacctgaagaaactcttcagggtcggtgcttccgtcatatttctctattgctcccagttgaaacttctcaggccatcgaacatcccgcagagcaggagtgaaagccctacacccgccgccaggggcagtaggttgccggcgatcatacgctcgtcgtggattgtcacgtcccaaaacgaccctaaaatatatcctctaaattatgcctaaaataattaaaatccgtgtgaaatcctccaacaattaaaagtcaaataaggcttagaggatttttgtatatttcctaaaagcctaaaatgcgtaaataaattttagtggaattttcagagcacaaataataattgttaagaaataaacaaagttaaaatgattttataaaaagaaaaaccctaaaagtcccccttccctcccttgggccggcccggcccatctctcatccccctccccctccctctcctctccccacggcccatccggcctctccccgcgcgcgcgccgctgacgggcgggcccgcccgccaccctcgctgacgggtggggcccacccgtcatccccttcctcccgccgctcccgccggctcgcccgcgccctagcgccgccgccgccgcgaatcccgtcgcctcccgccgtccccgcgtgcaatcaataggggggaattattccccgggatcccctccacctttccccccttttttccctccctctctccctcggattcctttggaaacctctcccctaacctcgccggcgccattaatggcggccgggtctcccgcgcccatttccccctcctctggccgccctctctcactcccaaccctatataaaccctcctcgagctccccactaccgtttccgccactcaccgccctctctccccgccggaattgagctcgcgccgtcgctctctctctcctccgtcgccgccgagctccggtccgccgccgtcgtcacaccggaccacctcccacctcggcgccgcctccttcggcttcgccgcatcttggccgacctcgtccaccactccgtttcggtcgccgacctccggagcaccgtcgaccccgtccacccggtcgccgtttccgtcgtcgccgtcgacccggagtgagccgtggaccgccgcttcgtttccccctttccctcccctctctcggccgccgctccgccgtgcctatggccgccgccggtgaccataggggcgcgggcgtgccgcctcccgccggccgcaccgacgtggccgcctccgggcgcgcctagcggctgccgcgtggggcccggccgtcagccgcccgcgccttcgggtgcggctgacgcgtggggcccacggcgccggccggtgtgagccgggtgcacccggtccaccgtggaccgtggggctgccgcatgggccccactcccgtggacccggtccgcgcgcccctcccctcggctgacgcaataaaccctttttaaaattaaaaatttaaatgaagaaattcgcaaatattcatttaaagagcatataaacttcaaatggccataacttggcaatttgaactcggaattggatcgttcatgtctctaatttttccttaagaagtcaagaacctatttttgtgctttgtttcagcttgttatatggagtttattagagtaaaagccttttcttttccattggtcgtgtagacgctgcagcttcggacgatccgctcttcgtggaagttgaagccgatgtttgggaaagcgagcaaggcaagtcacataatccttgaacatattgaatcccagtttataaaattattttgatttaaattattgcactatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatactcttatcacctggacactatggaatggttggattattgtggaattggattcacacctccccctctattcaaaaccctcaaaatggttttaggctgggctcggggtgcatggttttgacagtagcacctcggccatataaggaccggtctttgggcctctgttgcaaagcactactgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaagggctcagtcctgcctacctgtcccgggggttctggccgtaggtggggttgggtcggtactcttgtctatggctaggatgggttggaaactatgtcacatcttccgtccgtataccgtggtggtatgtggcacgtggctacacgtgaggaagatgtatcttgtgggtaaagatgtacacctctgatcagagtataatctattcgaatagccgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagttctaggatcgcgtttacaaaatagctttgagcaactaaatgtctttaaatgctgtttactgcaaaccctaaccctttatattataactcccttgtactcccttgcatttattctgcacttgtgggtgtgtcttgttgagtacggtggttgtactcagtcttgctcaatttttctcaagcccagaagaggagttcctggaagatgaaggctttggtgtctagctcgtgcctgccgtcaagcgcctgtggtcgtcgccctagtcttccgctgtttttcgtttgtctttgtgtgtgctgggtcttcgccgcccatgtaataaattaattaattacgcttccgcttgttaaactctgaattgtatcaactttggtctaccttgcctcctgggacaaggaataatgcacccacgtaaggaacgcccattgggttatttccggtcgtggcataattcttaaataaaataaaacatgcaaatgctatgtttagttcaccgattgaaatcgcaagactacaaccaagtttgatcaccgattcacaagatatgcaaagcaaacgcttatttagatgcttagcttcgacttgggcttttgcaaggcccaacgagatggataatcacaacggaacacgaatagatcacgtcgcttacgtcgcatacgccgtggtcgtatgacagtcagacatcgtagtcgtgtgtgtagcattttccaaaaaaatattcactggctataacaatgaaggcgcgccaattttctagtgtgttccgaatcggacgtggtgtttgtgtaaagggaaggagacaaattcgagtctgcccatgcgaacgtgtgggcggcagcaataaaaaggaaactcactgtggagattatgggtacctccacccatacccacatggcatggttatccgactagttatagaggatagtttatatctatgaaatatgtaacatatcatgacttgtatattatggaatggcctaaagtattggttaaggtttctatcttgtaatcttgccccccatcctatataaggtgggcaggaggccctctagggggcatatgagcacacatgatcgtcagatctatactacacccggtggattcaaatcctcaaaaaggagtagggtattacctctcattgagagggactgaacctgtctaaatccttgtctccgcatccatccacttttaggtctcgtgcgctacccccttttattattaccgaattcatgtttcgacagttggcgcgccaggtaggggatgcgctgagttttctgtcgacgagtgtgatggaaccaatcttcaaatcgctgggttggtcgttccaatctattgctgttagattaattttttgcatcagattgatccgttttattgtcttttggcgtgcatatactggtgcctgatgcttttgtcgatccaatgaatgacactatcatctacaatcttcacgcacgattctgcgcctgtgtgatctcgcgtcggcctcgtgcatgtgtagatgcatcttgtgttcatgcatgcctgggattgatcagcagagaagcgggcatgcgtgcattgctatatgcatctaatcttcatgctacgtgctaattagattgattttggattatagattattaatcctaattttgctggttatttttgcctgcatgtctacgctggttgacgaggactgatgatcatgatcactgtcgcatcaccttgccgatcgcaggaaccgctgcgagccgctgtacgtcaagaagccgtccacgcagaggacgcgcgagaccaccggccgacagccgccgcacacgacctcgcgcgatttcgcgtggtctggcatgatcaggccgtccgtcttggttgcatgcaatgcaaggcattcagctaacgattggtctacatgcatgacatgaccagtgataatctgggagcaagcaaacactccaagcattctttgactttgcatctacgtatatacatatgtatttaattcattgatgctgctgaaattgtttccccttttttgtttgcacatatactcggggaacggcgccgcatgcccgggggttcatcctttgcgtggctgacgcggcccgactacacccgtggcgcatgagtccggggcatcccgccgcatgctcggggggtctcaccaaccggccgcctcgctgccgccgactggtgtctccacctgcacggctggcctattatgctgccgttgttgggcgtctacgccttcaccgaccggccgcctcgtccgccgccgactggtgttctcgcctacacggtttgatggtcacaccactgttgttgggcatctacatcttcaccgctggcctgtctccgtcgctgccgactggtgtcctcgcctatatggttggttggacacaccaccattcatgggcgttcacgtcttcaccaaccggcttgccttcaccgccgccgactagtgtctccgcctatacggctgcctccgttgctgccgactggtgtctccgcctgcacggttggtcggtcacaccatcgaagttgggcatctacactttcaccgccggccgctgtcatcactgccgtttggtttcttcgcctccatggttggtgttctccgccgccattgctgttggcgaccatgtcttcactaccggctatagtcatcgctgccgactggtgttttcgtcaccattgatggacgattttgtttccacatcggtcacctttatcgtcaccgaggaaaatatcaaaaagctaagtcatcactaattttctttttttatatgatattttccttttcctctgcctcactacgtcaactggttcgccgttgcctagtgagtcggggggctacagatgttatatcatattttttcaacaaatttcataatatttatcttgattgctcgcgacataatctgagtacaaaagtgcctatcgagttatggagttccatcttcctatgctttccgtttggtttgctaatggatagttgcctttgggccgattcctagcacccgggtgctcgttggatggaccgaataatacaaggtgctaagtattattcggataaatcaaaagcatagagataagataatttattttatgctcttaataattgcaaaagtaccagagtagtaaactccgatctgtgaaactttgttccattaatgacgaactcatgtcacttgtatgcatgtttgggaagtgcctatgctgactcccggtgcgcgggggctatgattagtcaggtagagtgtttaaacgtaaggagtcatctgctcggggaaatcaaaattgacaagaggagaatacatatttataaacattttaaaatacttgaattttccttgagtattatatttacatcaggtactactcatcctatatgtttgttctgcaagattcagatccggatatgcataatagggattcatggctttaagcttatctcctacgcttcaggaatagatcagtcagaacaccatcaccggctcaccgtcgtcgccgccgactggtgtcttcgcctatacggttggatggtcacatcaccgttgttgggcgtctatgtcttcacagccgacttgccttcgccgccgccaactggtgctctcgcctatacggatggatggtcacaccaccgttgttgggcgtctacgctttcaccgccggcttgccttcaccgccaccgactggtgtctccgcctgcacggttggcctattatgccgccgttgttgggcctctacgtcttcaccgccggctgccttcgccgttgccgactggtatctccgcctgcatggctggcctattatgccgccgttggtgggtgtctacgtcttgacagccggctaccttcgccaccgccgactggtatctccgcctgcatggctggcctattatgctgctgttgatgggcgtctacgacttcaccaccggcctgcctccgtcgccgccgactggtgtcctcgcctatacggttggttggtcacaccactgttcatgggcattcacgtcttcaccgaccggcttgccttcaccgccgccgactggtgtctccgcctacacggctggcctattatgccgccgtttttgggcatccacgtcttcaccgatcggccgccacgtctgtcgccgactggtgtctccgcctgcacggctggcctattataccgctgttgttgggcgtctacgtcttcaccgaccggccacctcgtatgacgccaattgatgatatagtcttcatggctggccacgtcgccgtcaccgctaataggcgtcatcatcttcaactcaagctatctacgtttgttgccgactggtttcttcacttccatggccgcatgattctactagtgttgattggccttatcgtcttcatcgccggtcgtctcgtctggtgctgactagtgccctcaccactacggctattttatactgcaaccactactgatggatgtcatcatcttcattgctggccgccttgtttgacaccaactggttttttctggagctgaccggagtatctatcttcacaactacatgtctttgccaccggttcgtttctgtcgccgccgactcgtgttcacttcatcacggctatgcaactttgtcaccatggtggagctacttcatcttcattgtcttcggcaccgacaaactttattgctgctacttcgcaagttttgctactttaccagccatgacgtctacaggagcttcgacatctcagaatatgatgccgtaatattttactacaacaagtggtgttccaatattcaagatttatacctggacatcctcaatacatatattcactcaagtgatggctactcgacgatgagaagctacagttctcgactctatgatcaattgctttccaattaaccaaagagtcgggggctacacaaatacaagactcaaaatttgacaagttttttttttgtcaagatgaagcaatcaatcaatcaacgagtcaactttgggagttattatctccgtctgcgcttcagagccggcattttacttcagcgactccaattattacatcggcaggtcaagattaaatttacatgtctgggagtttggagtcatcaaccaatcaactcagatcagattcaatgagttgaacaacagcatatactttcctctaagtgaaccatctgcaagagctatagcaccaagttctactgccatcttcataaatcaagaggcgttgcatcaatcttcgtcgcacacatgccaacattaagaaaatacttgagcatggatttcttctcaacagtttgatggattgttgttactgacatcatcacctgcacatctacttcaacggccctgatgtctccgccattgctaagggatgactacgtcctcaccgtcggttgcttttgtcatcaccgactttcatcactgacttgttatttcgtcttcacgattggcctactacgcaactgccaatagaggatctcatcgttatcatcggctgctacaccgctattgactggatcaccaacatcatcatcttcatcaacatcctgtcaaacctcttcaacatagcccactctactgctattgatgggcaacttcgtcaacatatttgatcatatctattgctgccaatcgtcattaccatcggttgcatttgtcgtcgtcgactatttcatgcattttcatgattggaggatttcgctatcgttgttgatctgtctcgtctgtctccgactgattatttcgtcaccatggctacaaaactctgtcgctattgctgggtgccttcatcttcactgctagttgatctgactgttgccaactgatttctttgcttccatgccgattgcatcaactatcaccgatggacaatttgaactactccaaaaggataagctatatgcttaggggcttatgagctcaagcacaaggatcataccttcaagttggattttgttctagatacaggcaacatgcactcgtagtcctgaaattattttctatgctcgaagactggaccaatcattattccccgtaagggctatcaaccgaatacttgcgccagtcgggattcaatttttatatctatttttgagtatcccataagggataatcactcagatcagaagctattcatatgagctacacttggtctatatcacccggaagatttattactcgggagcatgttacatgcgtcatcctttaaagggtgtcgaaggcctaggcctaatatgtctgcagcccatatgttcaggtgtggcctatcacgttcttttaaggacttagacactttttgattaggccaaagtgcgcgtgatcaagtgcccaataccttaaaatcattttataccgcagttactcaactttttaggagttggtacaatgcattttaaaaggtgcccaacagtgaagtttttcatagctgtcccgctgacttttttatatagtcaaggcgctgtttgggtttatcaagcaattgattggatacaatatcgttactttttgccacgtaagtgtgcatttttattgaccaatattatggcttaggctgattatatattttggtcattttctaggcggttggtaaatcctttatgagtttatttactcggattttataccacatatgccatatattttcaggtgtggtgaaaccatgtgtcttttagggactcaagcacatttgttaaatcagtgtgtgcatggtgtatgcccaatactttggaaatttctttattcacaacattcaagcttctttttagctattttgctatgtgaattttcaatgatgtagtcaactttaggttgcaagcatcatattttacaaaacaatcggtatatcactcggatcatattattcagggattcacaccacatatgctatgtattgatatcaagtcacttgg

SEQ ID NO: 453 - DNA, 1959 bp, Oryza sativa
tacccacatggcatcgttatccaacctagttataggggatagcttatatctatgaaatatgtaccagattatgacttgagtattacgttcccttgtatattatggaacggcctaaagtcctggtttgataatattgtaaagtagatttaggaaatcgataccgtattggttaaggtttctatcttgtaatcttgccccgcatcctatataaggtaggcaggaggccctctagggggcatatgagcacacatgatcgtcagatctatactacacccgccagattcaaatccccaaacaggagtagggtattacctctcattgtgagggcctgaatctgtctaaatccttgtctctgcatccatccacttttaggtctcgtgcgctacccccttttattattgccgaattcatgtttcgacactcatgcagctcaagtcgttcttgtttttgggaaagctcgattcgatatctccgcggggcgcgccgatgtgtttgattcgaaacgccgccgagtagtttcgtgagatagatctgctggcggccatggcagctgatcctccatgtaaggaggtggagcaggcggtgacgccatgggaggtgtccgctccggggggagggcggcaccatcgactacgaaaaaatggtggaccgcttcggctgcaaccgcctcgacgccgcgctcatcgactgcatcgctcacctcacctcccgcctgccgcatcgcttcctccgccgcgggatcttcttcgctcaccggtgttcttctgcagctaaattggaggagttggcgactgaattgcagatggtttttgtttgttggatagggatttgaggaggatactggacctgtacgaggcgggggagaaattttacctctacacagggagggtgttagtgatatgccctagaggcaatcatagagataattgtatcacacactctgtttacatacttatccgactttgttccttgaaatagataaactcattattggttaatgaatatgtgattctttcatgagactctttatgttgtgtgttgctatttctaaaggatccctgatcaaatatcatatgtggaacaaatatgtttagatgatcagcacatgtattaattgatgatcatgtctcatggatcatggtatagagataccaaattaataatgtggacacatgttagtgaacatgttgttggatagatccaacatgagacactgcaagagccatatgtgttgtgtcatcaatgatctcatttagtgttggtgttgaatccttagacttgagattatcatggttcccaacatgtgaagcagcttacttagggactgctaaacgctacgccgtaattgggtagttataaaagtactttttgggtatgctatgaaacatgtagtgggatatgaataatcaagatgggatttgcccctcctatggagagatatctctgggcccgtcgatgttgtagattatggaagtgcatggccatgtcaaaggtgattgaggagtcaatcacaagttatataatctgtcaacaggtcgagtgaatgattgagctattagaggatggcacatatctagccttgagcttaatcgatatcgtgagtcaaatggttcatacaagtatacactacaggttcagccgatttgatctttatgtatgcctggtgggtcaatacgttctgctaggggccgctgttgacacgtggaccgaaaaggagttttcgggttacagctgaatatacatgaacctacagggtcgcacgcttaatgggctggaataaggggattggatggagatccaatatgagcttaattcggataggcatccgaataggagtcctacgggccttggaggctcgagtgatggatcctatatattcgtgaagggtgtgactggcggaggcattgcatcacgtgagaaaccctagccgtcactgtcacgtcctgataaattcatccc

SEQ ID NO: 454 - DNA, 10782 bp, Oryza sativa
agccccagagggcggcaaggggctaaatgcaatttttgcagacggcggcagacagcgtcgtcgagccttcatttgccacgttagcttgccgcccaccactagggcggcagggtctatttttgtaattttttgcgccgatagattatttctgtaaatattaaaagaaaaaaatttaaaaatgaaaaaaaaatcgcctccctcctctccttcgagcccctctgcacgcgcggcgcatgtgcacgccttgcgcctgaccggtgggtcgacccacccggtcgtcttcaacctccagccggccgctcctctctgtccctctcccgaacggaaaaaaattctatgcggcagcgtcgcaccaagcttctcgtgcggcactgcgtgaactggcgacgcgtgtccaactgcctcccgcgtgaggcgcgtctatcgcgatttttagtggagccgagccgacgcctatcactatggtggagccgagccgagccgtcgctctcatctgctatggcgacagcggcggcggctgctgctgctgcttctgaaacggcggcggcgcgcttgagtccccctacagcgggcgacggcgcatcggcgcaaggccacgaggcgcgagcggcatggccttgctttcctttcaataattcatttagctgcacttggcctgaataatttcatttttttataaggtctcttttgatgcaaacgttgatgataatatgcatagagatttttcgaacatggctgctcctcctatccatggagactatacaagtcttttgtttcgacttgatcaagatgccttgacttttctgctgctgctccctgcagacctgcttgctcctgcggtgctgctgctgctcggctgctcctgctctcgcgcagcgcggtcccgcgcgcgccgccgccagcctgctgcattgctactcctgctcacgtgctcccgcggctccacgctgccgccggcctgctgctcgcggttcgcgcggccgctctgatgctcggctgcccgcctgcctgtcggagtgtcggttgccgccatgcagccatgccgctcacgcctcgcggccttgcactgacgcgccgtcgcccgctgtaggggggactcaagtgtgccaccgccgtttcagaaacaacagcagttgccgccgtcgtcgctatagcagatgagagcgacggttcgacttcaaggtgtgggcctgcggcttggactcgttgtgataggcgtcggctcggctccaccaaaaatcacgatagacgtggctcgcacgggaggcagctggacacgcgtcgccaattcgcgcagtgccgcacgagaagtttggtgcggcgctaccgcatagaattgttttccctcccgaaccctagcgctgccatccttcgatcccgctccactgcgcaagttccggccaaataaattgcaaaaacggaatccccatcccttcctcattatttcccccaacttttcccctttaatcccgcccccaatcaccaggatttaatccctcttctttgaccgccattgatgccgccggccacgctctccggcatcgttcccgtcccctccagtggtcggcactcccctccattgcctataaaacggagccctagtccacctctccttctgttttcccccttcccgacctccctagccacaccgtcgccgacctcctctctctcctacgccgccggccaaatccagctacccctgccgccgcgtcagcacgccggccagccgtgccgtcgcctcccccggcatcgtagtcgcctccccttccccggcctgctctccgtttcccgcgaacacctccggaagtgcatccccgccggcaacagtggcgttgccgccactgttccgcctccggccgcctctgccgcgtctcctgtgcgctggccgacgtcgccaccacctctcccggaaccagaacgccgtcatcttccccgtccaggcgtcgcccgtatttcgccggaacaccgccgtgccgcgccggcctctccatccgccttgccggaatttccccggtcggcccttcctcctcccatgcgctgtcggccacgccaccaccaccttcagcatcgcagcggcgaaccggcgacgtcgtcctcggcatcgcctcccctccatccgaaccccaccgccggtgtccgtcatcgtcttcactgttcatcctcgccggcttgtcgtcccgcggtgctgcctccatcgtcgtcatcacagcggtgtgttccgcgccgtcctcgcatccgtgcagctgctgccggctgccctcgtcgcctcctcgccggttctggttgtcgtcctcccgtcgttctcgatcgtcgtggcgttcgtccctccgtcaagccgcgttcgttcgtcgcccgcgtttcgtcaagtctgctgcagcctcgtcgttgtcttcgtcctcggctccacatcgtcaagccctgagttggcctcgtcctgccttcgtccaaggatcgccggagaagtgtcgtccgttcgtctccgtcgttcctgtccatctctgccgcgccgtttgtcgtcgtcgttcccacgcctcgtcgcgtggtagtaaggatccgtcctctcactgccccgtcctcgtcctttcgttgtctccccatgcccattgtgtgtttgtcgaccccggtacccatgtaccggtgtcggtagtcattcgtgggtgcgtgtggtgaccgtgtttgtgtgtccactcggtagccacgtggtttgcacgtgtgcagcccgcgtggtgtctagtggagtccgtttgtctgccactcgcctcggttggcacacggcgtctgcttccatcgtcccgtggatcgtctctgtgtacttggtctaccgtcgtccattaggttgacatgtggggtccgcatgtcagcagcgcagccttcctgtcttttccaggctagcgcttgcacatgttttataattgcaaaacctaatcataataatccgtaaatctccatataacagcattaaacttcgtatgatcatatctttatcatacgaatcccgaatcgacccgttcaagtctcctaatgtttgttataacctaaagaaccgtgtgctttcttcttatgtattgttattacttctttataggttgtagctttgcttgtttgcttcgtgtagcttctgtcattccggaggtttcggaagcgtgattcgcggtcgtcaccgaaggttcggaaggctgttctctctgagcaaggcaagtctcatcatccttgagcatattgaatcccagtttttaaaattattttaatttaaattattgcattaccattttatttaaattcccgcgttatcactgttttatttagcacttcctattatcacctcgttcaccctaggaaaacaaaaccccaactagtgggtactctattcatggttccactagtatgaacttacgtagatgcttcgctgattaattaggcaacattaggtggttttataactttagactttgggagttctcatgtcatttggacattatggaatggttggcttgtgatggaactgatacacacacctcccctgtcacgcccggaaattcactagtaatttccgaacttatttgtgcataaaaccctcgtccaggaatcagccgaggtacacaaactgacaatttaatatacaaatccatcataataataactttacataattacaaaagaaaagaaaacagcagcggaattacggtctagcgaagctccagctccactcccacaggcagctcaactggggtataaaccatacgtcttctcctttgcaacttgtcttcaactgaggtttgattgattattgcaaggtgagcatatgacatactcagcaagccacacaacaaatatgcaagtgcacaaggataccaaaaggatggcataatatagggctcatttgcaaaagcagcatttagcaaacatttgagagttgtaaaacagtagagtaattaatcatcaatattaatcaacactgaacagcacacccatgctgctcaggcccaaccatcctgaacaaccatacccggctgcacagatctatctccaaaccaggaatgtaccattccaaaccaggagctaaattaattaccatcaattaccacattattattaatgagtagtgtgggactaatcaagaaagacattgttcgacccgcccataaccacgggcacggctattcgaatagttttactctggccagaggtgtaccactgtacccacaagacacaactccacaatatgtcaccatatcatcatgtgcccatgctgaacatgtcaccattagtgtagttgtgacaagacccctcgcataactcaaccaaaagcagtgcaccgttcctggatcgtagtcaccccctcaaaaaccagaggcatggactccccagcgacccttgtgggcttatctccgccacttctcagtctggtgctccgtaatgagccttgttatacaaagtgtccagccgttgcccattctggcttgtggttggcacgggtaatgtttcacaaccgaaactcgtgaaccggtccttaattgtcataagtacgaccatcaaaaccatgtgctcacaacccaccattatcaagttttagttggcacattaattaaccaatcacgattgaccaacgattgaccatcgtgagctatcattaaatatccatcattaagtaatagtgaaacattagttatcccaattgtgtgctaatgtttaacatctagctgaaccaatatataaagctcaactagtcaaattataataacccaaggtatgaaggaatagagtaattaatgcaaattggccatacaaaggaataattcacaccacacggtgacattcgaaaataaatgcacagttgaaataaatagagaatttaattataggatcaacatgctcaaaggaattgtgtttgggatctgtgtgacttgtcttgcaataacatgtcttcaattaatcttcttgaacacttctggcgcactcgcgaaccttcgaaacgacggaaacgacaagctaacacgcaaaacaaagaaaaagactaataaaaaccaaataaacaatacatataaagtaagcaaacatgtaggtcataattttagatgaattatgagacttgaacggcctcattctgacttcatatgaattaattatgaattttacaagatttaatctaattaaagcctatttaaaaaggattaaataaaattaattcaatttatggataatttaatatgtagatgtttattttatacaacttttgcaacttgaaccacattaaaccaagttacaatgattatgaatttataaagattaaactggattaaagcatttatatggattttaattgaattatgacgcaataaagaattatttttgaaaggaaaaagggatttattgcgtcatcaaaggcggtccacggtaaaccgggttcaaagagacggtctacgaaaccaacggccgagatctaatctaagccgaacggacggccgagatcgatccggtccaccacgggctatggatgacgtcagcaatgacatcagcgatgatgtcatcgccggcggcggctcgagaccacgggctcgacggcgaacggcagcgaggcggcgcaaacggaggacaccaacgggtagagctcgactcggcgaactcaccagcggcttggatgatggcaaacgacgacggatgacgacgttggcgaggttgaagcggcggcggtcttcgggtcggcggtgacggcggcgctccgaagggaaatggcagcaacggaggggtggacgaggtgctgctcctcctcgcgatcctgatggtagcaacggcgaccgaaggcggcggctgcaatagcagtgcggcgcggctgcaacagcggccggaggttgaagacgactgacaggtggaccccacctgtccgtggctgagagagaggagggagggcgcggcggattgggccagctgagccggacgcaagcaggccgaggagagggagggagaaacttgggccgactttcggcccaaagccaaaaggggacttttaaaacctttttcaatttaaattattcatgaaatgatattccattgattaaaaatacttccttggctcaaatagatcccagaaaaatctaggaactatagaaacaagagaagtatttaacaaaattttatctagcccacttttatgttgagatttaacaaattaaaattagatcttctcttttaggcttttaagatcatttctaataattccttttaaacaacaatttataatttaaggatttttaaacaagaaaagcacttaacataattataattagatcattaattgattaactaattactgaattgttctttgtattattaaaattagaaattgagctccgaaaaatccgagaaaattccagagagtataattaaccttggagaatttaataaaaattaaatccatccatgctttatatttaggaaattttatttcccacatttaacttcacttgtaaattaatgaacatttaatataaattctattaataatttattaaataaattataaatcctaaaccaaaaaatcaggctgtgacatccccctctattcaaaactcccaaaatggtttgaggctgggctcgaggtgcatggttctgctagtagcacctcggccactgtaaggaccggtcttcgggcctctgttgcaaagcactaccgtactaaccacatgtctaatgggtaaggcttaactcggtgctcagtctagtcctggcaagagtacacggatggagatggacgaagtcagggctcgatcctgcctacctgtctcgggggttccggccataggcggggttgggtcggtgcttttgtcacggctaggatgggtaaaagggttatgccacatcctttatgatgggttccacggccgtggaatgcggagtaaagatgtgtcttgtgggtaaagatgtacacctctgatcagagtataatctattcgaatagccgcaccctcggatatgggcaagcctagcaatgtacccacgttagtggtttaattcttaaaacttgcttaacaactaaaatatggaatggttggcctgggttggcttgggacgagctgggacctgggtctggttgccagttcggtctgaatcatcgtaggccttgggttaaggcatgttcgcgtgggttcacggccttgattaataatattgtgtagctctaggatcgtgtttacaaaatagctttgggcaactatgtgacttttaaatgctgtttactgcagaacctaacccctattattatccccttgtacccccttgcattagtcatgcatctcccggtgtggcttgctgagtactatggttgtactcattcttactctatctttcccctcttcagtaagagaagctttggagaagaagtcctgggtggagtcctggcttataccccagttgagcgcctgtgaagatggagccgtaggcccgctagtccgctgctgcttatttttgtttgtcaggcctgaagtgcctttgtaataatgtaaatattatcgatataataaagatgtgccttttgtatcctgtttgtgtggtgtaccccggcttttcctgggatggggattaatacacttgtgttttggaaaaggtatttttccgggcacgacaagctaatatcagagacatctcgactgtaggataagccaagtggataaaacctaaggacatattttataaacaagactatttgcaaaagttcctttttcctcctttccctaatgctatttgcaaaatgtttactctcttcttcctccttcggattttcaactagtactagatggtcagctttgcgaagaagaagatgtcgctagtggtctgccgaagttctagaaggctgcaggatccactagcgaagcaaaggaagcagtgaagccagatgtgaagcaggagtgaagatcttggagaacccgtcgcagaacctataccaccctttagggttttgttagtcgtgtgtttccttgattgtgtgtgtagcacatggtttgcatcagtggggtgtgatgtaaccatgctaggttgtttgcgtaatcaacctgcagaataagcctaacatatatcataacagaaaaagattagatctgttaaggtcctatccttagtttctgatctctttctttcctccaattttctctttccccctctctaaaccttgtaacagatggctgacaatgagaaaggaagtaaggtcagaaatcagaacaagggtgccccaagctcccgagtgaatgaagcaccagacaccagttgtgtgacagtggtctaacacctgattaactagaacgaattgcttatagagctaccacagcagcatcagatgccaattctagacccgagtcagatgcaacctcaagtgcagttggaggcagtccaatcactcacaccacaagttagcgcaccgccagcatcccaacaagcccatcgtgccatgccacatgtggactcaaaagaagcaagaatcatttgttttatctatgttgaacaagggcactatgcaaggaactgtccttagcagaaaaaaaaagcaccaatgcgaaccgaagatgaggtccgtaagatgaccattaccggcacagaatggcctccaccaggaatgacaaaacgtcaaagaagaaatttcttccgaggtgcaccatagttgacggaacatcttttagctaatggaggtagagtgtctgatagcgaagattcagatcaagtctcctcacgggttgaagatgagaagtctctccaaggtttcaaccagaataaaaaggaacatatggcatgctctcgttgtggagaaatcggtcactttgccagctcatgtgtcaccacttgcgttcattgtgaggaagaccatccacccgacgagtgtccaacaagcaggattacttatttcttgtgcgaatgagctgatcatgtacgaaaagattgtcaattcagttttctgctgatgaagaagatggccaaccaacccgccagttacaacagacagaagcatcaaggcaacccaaatcctcgacaagactacagtttcagcctaactccaatgccaggacagaggaatcaaaatgggaaaagaaaatgccgagtctggaaagatatctgttgtttcaattgtcaagaagtgggtcatttcgccgacaagtgctcgaaaccgagaaacatatttaccaacacgtcagtccatgcaactccgcgcaatcagaagcttgctcctcagcaaattgtcatccatgcatcctgaagcagtcctatagcccaagttgcaatagctcccactccaatgagtgcactaccacaaggtgtcaatgctcaatttcagccccagccaccagttgacaagacagaggccagtatcagtgttgtacctttggatgttccaggacaacagccaagaaatcaagtacaagatgaagaacctgagagtaagaaagttattgtttgttacaactgcaaagaaccagggcattactccagggactgtccctaaccaaggaaaaaaatcggcctccacattttcgccaatttacaagaaacagacatgccaatcgccaagtggtcactggagaaaatgcagtacctgtcaagcctagtgctagtcagaagcaaccataacactcttgtatcgatgttcaagtacttttgttttatagttgttctctaccaaccgtgtaataaggaagaaacgggaaataatcaatgagtttggcaaatgtatgaaggatccatattgagactgcaagtgttgtgagttgtgtacattttgttgatgattaaggagacctagggtcttatttccgtaagctcataatctgttatgaatcaaataacctagcgattgatggcgaagaaaatcaagtgatcaaccaaagagacatttgtttggactaagagtttccgatgtgtcctttttcggatcaaaggcaacgacagtcagtatagcttttgacgaactacttcaaggtttctctgaaaggcagcaggcccaaggactgcattgccccagaagcacccacaacacccggagtgaagagtacctggttgagaaaggtcaaaaggtgattgatggaagagatcggaaaagatgtttggttgctaggaaaatgtcacgtcccaaaacgactctaaaatatatcctttaaattatgcctagaataattaaaatccgtgtgaaagcctctaacaattaaaatgtgcaaagttaaaagtcaaataaggcttagaagatttttgtatatttcctaaaagcctaaaatgtgtaaataaattttagtggaattttcatagcacaaataataattgttaagaaataaacaaagttgaaaaagttttataaaaagaaaaacccttaaagtcccccttccctcccttgggccggcccggcccatctctccttccccccctctctctctcctctccccgcggcccactcggcctctccccgcgcgcgcgccgctgacgggccggcccgcccaccaccctcgctgacgggtagggcccacccgtcatccccgacctcccgccgctcccgccgttccgcccgcgccctagcgccggcgtcggcgcgaatcccgccgccttccgtcgtccccacgtgcaataaagtgggaggaatcactcaacgtgatcccctctccctttccccccattttttccctctctctcttgcgttcaaacgggcggatttgcccccgcaaatctcgccggcgccattgatgggggccgacctcccgcgccggtttctttcttcccagtcgtttcttccccttccaaacctatttaaaccct

SEQ ID NO: 455 - DNA, 6513 bp, Oryza sativa
ataacttggccatttcaactcggaattggaccgttcaagtctctaatttttccttaagaagtcaagaacccatttttgtgctttgttcctgcttgttatatggagtttattagagtaaaagccttttcttttccgttggtcgtggagacgctgcagcttcggaagatccgctcttcgtggaggttaaagccgacgtttgggaaagcgagcaaggcaagtcacatcatccttgaacatattggatcccattttacaaaattcttttgatttaaattattgcattatcgctttacttaaattcccgcgttatcactgttttatttagccatgcctatttacctttgttatgaccttattattattgtcattgatattattaccttgttcaccctagattaaacaaaaccccaactagtggacactctactcatggtaccactagtatgaatttaggtagatgcttcactgattaattaggcaacattagggggttttataactctagactttgggatattcatatcacctggacactatggaatggttggattattgtggaattggattcacacctccccctctattcaaaatcctcaaaatggttttcggacgggctcggggtgcattgttttgatagtagcacctcggccatataaggaccggtcttcgggcctctgttgcaaagcactactgtacttccacatgtctcgtaggtaaggcttagtttgtggctcagtctggttataaacaaaagtacacggatggagatggacgaagtcgggggtcgatggacatctctagggcaaatgaaggctacacgagctgcggcttggtagtcgagatgtcatggcacagggctggtgtcctgctgctaggggctcagtcctgcctacctgtcccgggggttccggccgtaggtggggttgggtcggtactcttgtttatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttggttaataatattgtatagctctaggaccatgttcacaaaatagctttgagcaactaagtgtcttttaatgctgtttactgcaaaccctaacccttatattataacccccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttcccgtttgtctttgtgtgtgctgggccttcgccgcccatgtaataaattaattatttacgcttccgcttggtaaactctgaaatgtatcaacttttggtgtaccttgcctcctgggacaaggaataatacacgcacgtaaggaacgcccgttgggttatttctggtcgtgacagaaaagaattaggtcgaaaggtgattgataaaggataacgaggaacatgatttgtgtcactcgaggaagactcccgatagcaattaaccctacaactgtcaccatgtcatttaagcagaagaattcgcgagtaagcaagatgaccataggtagaagtgattctatgaggacaaggatggaaacttttgtgacatgaccaagaagtcaagaagttaacctgaacagctagaaactaaagctcggttcaaccttgggctgtgtatcagatgctaccagagtaaaagcaattgcactagtatcgttcaacgcactttcctagcgattgatccatctggaaagaacacatcaaggatgaaggtgtaaaggaatatgttgaatgctaaatgacgacaatatgaagagaatagtggaaagtaaaccgattgtaaagaaagtgaatccgagatgtctgttcgtgggagctattcccagttatgaaccaagtgatatgttcaaggataatctacagaggtcagattaaaatcacatccaataaagaagcttcagatttggcaggataacgatcagacaataacaagtctagcagtaaagttatttgggaagacgtcaaagcatgtcaagtgggataagttggttctcgtgggaagcataattcaaagttagagtgatcgaccctcgcattgaatagcgttagtatctagcacccggagactaggaaagctaatatgaggcagttagtggcaagttgtcaatcatggtatccttggtaagcgggatatcatagtctaaagcatttggtggtaagttggaaggaaacgccaagcatggtattctcatgatgacaagctggtaatgacaagcatggtatcccagtaatgacaagttggtatcgacgcataacgtgaagttggtaacttgtatgagattgacaccaagggtatgaattatgagaagtcccggaactgaagccccgtcttcaagtgccgcatcccagtcgaagtcagctcaaggtgcaaccagggacaagccaggtgaaacgaagattccatctgcaacaggagatcaagccaagcagttcagagtggggaagttttgctgggcaagtttgttaaagaaaacgcaatggaagaagtcggaccagaagagaagaccgcccaacctatcttcttgctagccttctcgaatctcgggggcgagattcctgtaagggggtggatttgtcacgtcctgataaattcatcccgaaataaaaatcattttctaaaaggaataatataattaattaaaattcgaatagaaattggcaaacattaaaatgcgtacaagaaaaattcgaatgtggcccggagaatttttgttaaattccccttggtctaaaatgatccctcaaattttacttgaatttccagagcaccggatataattattacgcaacaacaacaattaagaaagtttattaaaaaggaaactaaaaataatcctccttttcctttgggccaagtccagcccaaagttcctttcctctctccctcggcccgcggccgaagtatcacttccctccctctctttttcctcccctctctctccctggcctcccctcctcctcccgggccacctcttccctcctcttccgcttgggccgcccctgccctatcccggcctagccgaccagccgcctccctcctttccctcgcgcccctctgcacgcgcggcgcatgtgcgcgcctcacgcctgaccggtgggtccacccaccctgtcgtcttcaacctccagccggccgctcctctctatcactctcccgaaccctagcgccaccatccttcgatcccgctccactgcgcaagttccggccaaataaattgcaaaaacggaatccccatcccttcctcattatttcccccaactttccccctttaatcccgcccccaatcaccgggatttaatccctcttctttgaccgccattgatgccgccggccacgttctccggcgtcgttcctgtcccctcctgtggtcggcactcccctccattgcctaaaaaacggagccctagtccccctctccttcggttttcccccttcccgagctccctagccacaccgtcgctgacctcctctctctcctacgctgccggccaactccagccgccctgccgccgcgtcagcacgccggccggccgtgccgtcgcctcccccggtgtcgcagtcgcctccccttccccggcatgctctccgtttcccgcggagacctccagaagtgcatccccgccggcaacaatggcgttgccgccactgttccgccttcggccgcctctgtcgcgtctcttgtgcgccggccgacgtcgccaccacctctcccagcaccgaaacgccgtcctcttccccgtccaggccatggcgtcgcccgtatttcaccggaacaccgtcgtgccgcgccggcctctccatccgcctcgccggaatttccctggtctgcccttcctcctcctgtgtgttgtcggccacgccaccaccacctccggcatcgcagcggcgagccggcaacgtcatcctcggcatcgcctcccctccatccgaaccccaccgctggtgtccgtcatcgtcttcaccgttcatcctcgccggctcgtcgtcccgcggtgccgcctccatcgtcatcatcgcagcggcgtgttccgcaccgtcctcgcattcgtgcagctgctgccgactgccctcatcgcctcctcgccggttccggttgtcgtcctcccgtcgttctcggtcgtcgtggcgttcgtccctctgtcaagccgcgttcgttcgtcgcccgtgtttcgtcaagtctgttgcagcctcgtcgttgtcttcgtcctcggctccgcatcgtcaagccctgagtcagcctcgtcctgccttcgtccaaggatcgccgctgaagtgtcgtccgttcgtctccgtcgttctcgtccgtctccaccgcgccgttcgtcgtcgccgttcccacgcctcgtcgcgtggtggtaaggatccgtcctctcactgccccgtcctcgtcctttcggagtcgccccatgcccgttgtgtgtttgtcgaccccggtacccgtgtaccagtgtcggtagtcgttcgtgggtgcgtgtggtgaccgtgtttgtgtgtccgctcggtagctgtcacgcccagaaattcacaagtaatttctgaactaatttgtgcattaaaaaccctcatccaggaattagccgagatacagaaactgacaatttaatatacagattcatcaaaataactaaagcgataaatacttacataagaggcacttagtcctcaccatgaagaaaattgcagcggaaaataaaatctagagaagcttcagctcccacaggcagctcaactgggatataagccaaaggtcttctccttctggatcatttttcttcaactgaagtttgatgattattgcaaggtgagtacatgcaatactccgcaagccacacaggaattatgcaagtgcacaaggataccaaaggatggcataatatagggtttatttgtgaaagcaacatttagcaaagatttaagagtagtaaaatagtagagtaattaatcatcaatattaatcaacactgaacaacacacccatgctgcacaggcccaaccaaacctgaacaaccaaccctggttgtacagatcaaacctccaaaccaggaattatccattccaaactgggagtcaaattaattatcacattgttatcattaatgagtagtgtggaactaatcacgaaaaatattgttagacccgcccataaccgtgggcatggctattcgaatagttttactctggccagaggtgtaccactatacccacaagacacgattccacacatgttgccatgccccgaagtaccaccacggcactgcaaagggggaaatcgtgacaatacccttcgcacaacacaactcaccacagtgcaccattcctggatcataatcaccccctcaaaaacaagaggcatggactccccagtgacccccacagacttctcgccgcttctcagtctggcaccctgtaatgaaccatgctatacaaaagataaagtcgttgcccacgttggcttgtggttagcacggttaatgtttcacaacagtagctcacgaaccggtccttaattgtcatgagcacgaccttcaaaaccatgtactcacaaccaaccattaatcatattttaattatcaattaattatcataacacgattgaccatcgtgagctaccattaactataaccataagtaatagtgaagcatgatttatcccattaatgagctaatgtttctaagcatgactaagcaactgtcataagcatctagctgaaccaaaccaatatataaggttcaagctaatcaatttattacccataggaaaataaagtcatattcggccataattaattgggaaaggctcactacccgatgacattcgaaaacaatgcataagttaaaataaaacaatagctttaaacaggttcaacatgctcaaagggttgtgtgggatctgtgtgacttgccttgcgaacaagcgtcttcgattcgtcttcaggaacttctccaacgaacgaacgatcctccgaaacaacggaaaactaaatctagaacgcaaaacgagaaaaaacactaataagaccaaatgaacagtacaattaaagttcataaaaaggtagagcttgaatttacatgaattatgagacttgaacgaccttattccgagttcgtatgaattagtt

SEQ ID NO: 456 - DNA, 7298 bp, Oryza sativa
  unsure (1)..(7298): unsure at all n locations
tggaaaggaataacagccgctgacgtcagcgatgacatcatcgccggcaacacactggaccacaaggttgatggcactaggaagctcggccgggctatccgagaacaccaacgcggagaggacgacgagacgccctcaccgaggtcggcacgaccacggacgacgatgggagatggccggcgacgagattgaggcggcggcgtggctgtgtccacggtgactgtggcgtttcggcgaggggaggcagcaaccgaggggcggacggtcttcacctcgctcctgcgatcccgagggtagcgacggcgagcgaaggcggcgatggacggcgacgagcggcacggctgaaaacgagtcgacggaagattgcctcgggttgacagcgacgacgaagctccgatggtttgcagcggtggcgaaggggtggacaggcttcggcttggcgttgcgatgccgacgacagcctcggggaggtccggctaccacgggagaagcggcaaagcttcgccggagatcaaaacatggcgatggttcggccttcacagtgacggcgaattccggcggggttcggcgcaaaagaacgggtggccggggtagctctcacccttgcgaagccgatggaagtggcggcgcaagtcggcgacgaccagagaagcggaagacggcggctggaattggtggcggcggtggagagagaaggtaagcgtggcggcggctctagggctagggaaaaaaatcgggaaaaaggaggaaacggaagaggaggccgaggggctgctatttatagccaaaggaggaggagatcggctcggatacaggaagaatcggcgacggattagttagggttcgccggaaaaatggagctcgaaaccgcgtcgaattcacgcgatatacaacggtattcaaaggggtttcttagggataaggtagaggagatcgaggggactccgtttttacaaccaattttggaaacttgctctgtccggaggtagaagatggtactgtagcgaggggacgtaaaacagacttcttgccgggcttttttttctcggcttgattagaagagggaccaaaactggacttccgctaaataagagaaagaggaagagagggctgctgcgggctaaggaagagagagaggagaggagtgggctgaattcggcccagactgaggaagagaatttaattaactttttataatttaaataattgctgaaatgatgtttcatttattaaaaatacttccaatgctcaaataaatccaagaaaaatcccgaaaatacttgggcacataaagtatttaatgaaattttatctagctcaagtttaagttcaaatttcttatagattttattcccacacttactttgattattaagtaatttctaaaaattcctttttcacaacgatttataatttagcgattttcagggtgtgacagtacccgcgtggtttccacgtgtgcagcccgcgtggtgtccagtggagtccgtttgtcggctactcggctcggttggcacacggggtctgcttccgtcgacccgtggaccgtctctgtatacttggtctaccgtggtccattaggttgacatgcggggtccgcatgtcaacagcgcagccttcctgtattttccaggctagcgcttgcacatgttttataattgcaaaacctaatcataataatccgtaaatctccatataacagcattaaacttcggatgatcatatcttgatcatacgaaccccgaatcgacccgttcaagtctcctaatgtttgttataacctaaagaaccgtgttctttctttttatgtattattattgcttctttatagggttgtagctttgcttgtgtgtttcgcgtagcttctgtcgttccggaggtttcggaagcgtagttcgtggtcgtcgccgaaggttcggaaggccgttctctctgagcaaggcaagtcacatcatccttgagcatattgaatcccagtttttaaaattattttaatttaaattattgcattaccgttttatttaaattaccgcgttatcactgttttatttagcacttcctactaatccttgttacagccttatcattgcaattgttattatcacctcgttcaccctaggaaaacaaaaccccaactggtgggtactctattcatggttccactagtatgaatttaggtagatgcttcgctgattaattaggcaacattaggtggttttataactttagactttgggagttctcatgtcatttagacattatggaatggttggcttgtgatggaattgaacacacacctcccccactattcaaaactcccaaaatggttttaggttgggctcgaggtgcatggttctgctagcagcaccttggccactataaggaccggtcttcgggcctctattgcaaagcactaccatctaaccacatgtctaatgggtaaggcttaactcggtgctcagtctagtcctggcaagagtacacggatggagatggacaaagtcggggctcaatggacatctctagggcaaatgaaggctacacgggctacggcgtggtagtcgagatgtcatggcacagggccagtgttctgctgctaggggctcaatcctgcctacctgtctcgggggttccggccgtagtcggggttgggtcggtgcttttgtcatggctaggataggtaaaggggttaagtcacatcctttatgacgggttccacggccgtggaatacggagtaaagatgtgtcttgtaggtaaagatgtacacctctgatcagagtataatctattgaatagccgcgccctcggatatgggtaagcctagcaatgtacccaagttggtggtttaatttttaaaacttgcttaacaactaaaatgtggaatggttggcatgggttggcttgggacgagttgggacctgggtctggttgccagttcggtctgaatcatcgtaggccttgggttaaggcaggttcgtgtggattcacggccttgattaataatattgtgtagctataggatcgtgtttacaaaatagctttggacaactaagtgacttttaaatgctgtttactgcaaaacctaacccctattattatccccttgtacccccttacattaatcatgcatctcccgatgtggcttgctgagtactgtggttgtactcattcttgctatatctttcccccccttcagtaatagaagctttggagaagaagtcctaggtggagtcctggcttataccccagttgagcacctgtgaagatggagccgcaggcccgcttgtccgctgctgtttatttttgtttgtcaagcctgaagtgcctttgtaataatgtaaatattatcgatataataaagatgtgccttttgtatcctgtttatgtggtgtaccccggcttttcatgggacggggattaatacactagcgttctggaaaaggtatttttccgggcgcgatagtcacttctctccccgagcaaaaccctagccgtgcgcgggtgctagcacatctgcgcgtggcgttccgtccatgtacgtgtggataccggtagaggcggcgctggtttgcggtgctgattggcttgggagtacggcgaggagaacgcacgaggaggagaaggtcaagctggtgcgattgactacttcctctacatcgacgcgcgctacttcgcaagagttccttcgacttcttagcgtcttcttcaactgcgcagcgcgtcgagtggtaactatctatgatctaatacttgcatggttcctggtttacgtgatagaaaatttaatttatgctatcgtagcctacgcgtatcccaaccgaggggaccctcatcggaggcgctacacctcggccacctcatccccttcatgttcacaaaataagcattgctcccagtcccggatacaagtgaactgaaatcatttgtcaactagtatttattaacaatcaagatatctcttgtcaggtgctccctccatccacaaaagttacacctatttcacatttgagttttttccaaataagttgtttctatttgtagtctttatgcattcaagacttaaatgaagagataaattaaatgttttattagaacccaaggagtcatctaaatactcattggttgcatgtttacattcactctttgatcttgtaacatccaaggtgatttaatttcttcttggtcttggtgagggagtacttgcaggatgctttcaaggtgccgcaggtgatacagctaaaagctgacgatgaaaagtttatgtggaagaacttgactattgccgaatgtaaaaggcttgcccatgaaaatgccaaagacattatcacctgtggatttgacattgaaaaaactttcatttttacagatttcagttatgttggagggtaagattactagtactccctccgtttcacgatgtaagtcattctaccatttttcacattcatattgttaatgaatatatatatatatatatatgtatatatatatatatatgtgaacatatatatatatatatatatatacacatatatatatatatatatatgtatagaatcgttaatatcgatatgaatatggggaatgctggaatgactttattgtgaaatggaggaagtacttcctaactgtcgattaaaatataaatgtctggctggtcttttttttttcactcagctagcttctattctatgataaagtagtaaccctctatctttttttacagggcattttatgaaaggggcaattgtgtttttgcccttgctttacgattcaattgtgattttacccctgttttttagggtttgtgattttgcccctgtttttttaaatgaaggagccgtctgccccagttttgacagaagtttggtgggtccggaatttcagaattaaacaaagatagaaaatgttattatcatttatgaatgaccattctacccttggttcaataaaagagccaaatccccaatcccttactgtcccgattttcactccaaaaccctagctgggttgcaagcggcggcggcgacgcgcggccagcggcgggcatggaggagtgccggtggggccagctgccgcggaccagcgcccgacggagtcggggcgcgggcagggaggcgctgcggcagcgcatggaggcgcggcgtgncgccctcgcgggtgcacgcgcagggaggcgcggcggccggcggccccgtggccagcgcggcggcggagaggaacggcggctccgtcggccagcgagccagcgagcagcgagcaggtagcttggcggcgggatggcgctgttaaaggatgtaggcaggcacggcggcgtcctcggtctgaagcgcaggctggggaatcagggaggcgcgacttgccgccggcgggctggcgctcctaacttcttgcgggcgcagggacgaggcctaacgctattgcaaatacaggattaggagacataatggagtaaatcttgtgcatggtggaaatctgctgcaaatcccctgttttctttcccattttcatgtcttgtatctgcgagagatttgtttggtgaatggtgatttcttcctggtaaatgtgatgaatctttttggtgaatttttgcacccgatgcaagttctttgaaaatgctgcagaaatgatgttaaattcttccaaaatttgtcaaagtttggtcaaattcgaaatatatgcacattatatcaagaaaggagaggcaaatgtgtaaagggtatacaagtccttctactgctaagttgacgctgttaagtgatgctaacagaataggggcaaaacagggacagaacagagcttcgtttcaaaaaagtgagggaaaaatcacaaaccctaaaaagttagggtaaaatcacaattgcaactcaaagtgaggacaagaacataattgcccctactaaatatgcttgaagtttccaaccgtgtgacatataacaatgtgagaactattctattaagattgttctctgctcttggtgttcttgcttaaatatttgtgaacaccatggagattcattacttatctttaagcgtcatgttttctaatactcttactcttggatgacagcttaaagggatatttggaattagtccggaagatcaaattggcaaggtcagctttcctcctgtgcaggctgctcaatcattctcatcatcgtttccacatctctttcatgacaatgatgaccatctgccgtgccttatcccatgtgctatagaccaggtatgatatctctggtctgattatctcgacagtacaacataattgcttttgtatctacttgctagtatactgataatatatagatttttcagcacaaaatttggacttagtttgtttcttcttgttcttttccatctctaaatttgaatttgacccactcccatacgcaaaagccaagtttagagccttgacttgtaaacatttgcatttaaagataccaaaatgttctacatgtttgtatatagccgtatcatccatgcatcgaatatgactgtcaacattcggaaatatcaatcattaatgttggaaataacccaactagcgttataccacatgtaataaaccagtaaaaagaacttccacgcaaggtggtgtctgagaaagggaatttctaggcagcctgcccttatctgacataattggttgtatatcttcttattggcattaaaatatgtagagagatttatctggcagctctaaatttgtactgagtgcttgtcaagtaaatatttttccaatacttgatttagtgatctactatcatgaaagcatatccgatatttctcattaaaggtactggagtgttggtacatatatgtatttagtttggcatattttgagttgcctatttaatcttaatttatatttatgcaggatccttattttaggatgacttgtgatgttgctcccaaacttggttttcagaaaccttcactgattgagtcaagatttttccctgcacttcaggtatttcttttagggagagcttggatgtaggactgaacattagagctggtgcaatttgacgacttgtaattaacttgctcagaattttttttggttttacttcgaataatcataatttcacgtgcattactttatgtcgattgcttgatttccttttaacagggggagagcactaaaatgtcggccagtgacccaaactctgcaatatatgtgacagataattctaaacaaataaaggcaaaggtttcatctggaatatttactcaatcacacgctttagttcggccatttaaattatggtatcttgtagttctattatttcat

SEQ ID NO: 457 - DNA, 659 bp, Oryza sativa
gatacaaggcccataatccgtgacagtttatcgatttcgtcataaaccggcccaaaacctgttacgttataacaatttcgtcgcgatttaaatacttcaaaaccatataagagatatgcaaattttgcaaattttgtgaagaatgttactatcactttatcggatgaagaaatgaccaaaataaaagttatagatattgatgagttatacaactttgatgttgatgactttttcaggtgaaataatttagtatttgaaaatgttgtttgcagttgtcataatttgaaattcaaattcaaattattgaaacagagtcatataccaaaatgaccaaaacaaaagttgtagatattgatgatttatataactttgttgttgatgacttttacttgtaaatgttatttgaaattgttataatttgaaattcaaattcaaattattgaaacagagtcatatagcaaaatgaaaaaaacaaaagttgtagatattgatgatttatataactttgttgttgatgactttttcagttgaaattatttagtatttaaaaatattatttgaagttgtcataatttgaaattcaaattttatatagttcaatcaaactcggatggagaaatgaccaaacgaaaaatggtagactaaatgatttctacaac

SEQ ID NO: 458 - DNA, 2272 bp, Oryza sativa
tcagagtataatctattcgaatagccgcgccctcggttatggccaagccgagcaatgtacccaagttagtgttttaaattcttaaaacctgcttaacacctaaaatgtgaaatggttggcctgggttggcttaggacgagctgggacccagggtcgggttgccagttcggtctgaatcatcgtaggccttgggttaaggcaggttcgtgtgggttcacggccttgattaataatattgtatagttctaggatcgcgtttacaaaatagctttgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttatactctgaattgtatcaacttttggtgtaccttgcctcctgggacaaggattaatgcacgcacgtaaggaatgcccgttgggttatttccggtcgtgacacaacccaagacggtttcagagattcgtagtttccttggtcttgtggggtactaccgcaggtttattgagaacttctccaagatcgctagaccaatgactcgactgcttcagaaggatgtgaagtataagtggacggaagagtgtgagtagagttttcaagaattgaagaaaaggctagtgactgcgccagtgttagtcttgcctgatccaaggaaaggttttcaggtgtattgtgatgcgtctagacttggtttgggttgtgttttgatgtaagatgggaaggtggttgcctatgcatctaggcagttgcgccctcatgagaataactatccaacacatgatctagagttggcagctgtggttcatgcattgaagatttggcgccattacctttttggtacccgtacggagatgtatacggatcataaaagtttaaagtacattttcactcaacctgatctgaacatgcgtcaacgaagatggttagagttgatcaaggattatgatatggaaattcattatcatccaggtaaagcaaatgttgtagcagatgctctcagcaggaaaagctactgtaatatgtcagaaggtcgacatctaccttgggagttatgccaggaattggaaaagttcaacttgggaatagtcaacaaaggttttgttgccgctttagaagctcaacctactctttttgatcaagttagagaggctcaagtgaatgatcccgatatccaagaaatcaaaaagaacatgagaagaggaaaagccatcggttatatagaagatgagaaaggaactgtgtggctaggagaaagaatttgcgtgcccgacaataaggagttgaagcatactatcatgaaagaagctcatgaaactttgtattccatccatcctgggagcactaagatgtatcaagacctgaagcaacaattctggtgggccagcatgcgacgagagatagcggaatatgtggctctatgtgatgtgtgtcagcgagtcaaggcggagcatcagaagccagccggtctgctacaaccgttgaagataccagagtggaaatgggaggaaataggaatggattttatcaccgatctacccagaacatcagaagggcatgattctatttgggtagtggttgacaggcttactaaagttgctcatttcatacctgtcaaaacaacctacacgggaaataagctcgcagagctatatatggcaagagttgtatgtttacatggcgttcccaagaaaatagtgtcagacagaggtagtcagtttacttcgaagttttggcagaagttacaagaagagatgggtactcatttgaatttcagtactgcctatcaccctcaaactgatggtcagacagaaagagtaaatcaaattttagaagacatgttgagagcctgtgttctagatttcggtggaagttgggataagaatctgccgtacgctgaattcttttataacaacagttatcaagctagtcttcaaatggctccatacaaagcattgtatggtcggaagtgtcgtacaccgctcctttgggatcaaactggtgagcgtcaagtttttgggataga

SEQ ID NO: 459 - DNA, 5460 bp, Oryza sativa
gttaatcaattttctagatttttctggtaattatttgagcaaggaaagtatttttaataaggcataaatgaaacatcatttcacaaattattttaattgaaaaagtctttaaaaccatcccctaggccgttgggccgtttccggcccaactctcctcttcgcgcgcggccgtgcggcccaagccgagccgccgccccaccctctcctctcaagccgccgacatgtggggcccacatgtcggggtcatcttccacctctggccggccgagccgagcccaagcgccgccgcctccccttcgattccgccctagccagccatctccgagttcgattgcttgaggggaaatcatctcatccttatcctctccctttcccctaatgtttcggagatcaattttgcccggataaaccgaatcgaattcgttttgagtttatctctccaaactaaccctagatttttccggctcaaatcctctcgtttggagtccgatctctctaatccaagcctatataaagcatcccctagtcgtcctctacgtttctcctcaagtcccaagctccaccgttgctcgtagcgccgccgccacgttgccctagcgccgccgccgccgacgccgttccagccgtgccgcgccgccgctatagccgtcaccgccggcttccgtcgccaccaccgggttcgtgaggaagaggagcaccccgtccgccccttcgcagccgctgaagaccgtcagagcgctgtcgtcgacgttgacccgagccgagccgccgtcggacctcgtcgccggccgtcgttcgtcgtcgtccgtcgtagtttcttgcgccggtgagttcacgtcgtcgtcctcttcgcgtgggtgttctcggatagcccaaccgagccctctatcgccggtggtcgcgtcgtcccgtgccatggccggcgatgatgtcatcgtgacatcataaatcttttatttaattcgtaataattttctgtattagatgaaaattgattaaacttcggaaattcataactaaatcatcgtaactcggattcgagtggttcaagctgctaaattcatctaaaatcaagatctacatgttaaaaatatccacatgtactttttatgcttgtttttgtactgttttgttgattttgtttatttgctttagtttctgacattccagaggagagcgtttacgtcgaggaaggttcaggagtggttgaagaagctcaaggcaagtcacacagatcccaaacaaccctttgagcatgttaaacccgtttagacctaatgttttatttcaacttatgcattatttttgaatgtcattgggtggtgagcctttcccaattaattaatggccgaagatgactttattttcctatgggtaataaattgtttagcttggaccttatatatcggtttggtttagctaagtgctatataggtataattgcttagccatgcttagaaacattagctcattaatgggatgaatcatactacattattaattatggttatatttagtgctagctcatgatggttaatcgtgttatgataattaattgataattaaaacctgcataaaggtgggttgcgagcatatggttttgatggtcgtgctcatgacaattaaggaccggttcacgagctactgttgtgaaacatttaccgtgccaaccacaagccagcgtgggcaacgactttaccttttgtatagcgtgattcattatggggtgccagactgagaagcggcgagaagtccgtgggggtcgctggggagtccattacctctggttttgaaggggagagtacgatccaggaacggtgcactgtggtgagttgtgttgtgtgagaggtattgtcacagctcctttccaaggtaccgtggtggtatcgaggcgcatggtgacatcttgtggagctgtgtcttgtgggaacagtggtacatctctgatcagagtaaaactatccgaatagccgtgtccgcggttatgggtgggtctaacaatgtttttcatgattagtctcacactactcattattaatgataatactgtgataattaaattgactcctggtttggaatgatatattcctggtatggaggtttaatttgtacaaccagggttggttgttcagatggggttgggcctatgcaacacgggggtgttgtatagtgtttatttaatattgcttaattacttaactgttttactattctctcaaatgtttattaaatcttgtttatgcaattgagctgtattatgccatcctttgttatcctgtgcacttgcatatttgctgtgtggcttgttgagtatgtcatatgctcaatcttgcaatattcattcatcagaggaggagtacttcagtgaaggtgatgatatggaggattaggttttgttcgggtcaagttgcttgtggagtggagtcgccatacctgttccgtctattgtttttatttccgctgcgtagaattttattcttttgagaggaactatctacctctgtaataattatttatttcgcgagtattaattagatatttgatagtactctattatcaatttgttattgtgtgcctcggctgattcctggacgaggatttaacgcacgtgtaagcgtttggaattttggataaaaattccgggcgtgacaaagaatcatccaatttggagttcatatgattgagataaactagtttatttttgcagacggctccttaaaatgctcgtatggaaaaattgattttttcatgtgggctcttaagtaagccgcatgcaaaaatgagctcatttttgcatgcggacctcttaagaggcccctatggaaatattaattttcccatacaggtgtcttaaagagtcgtatgtgaaaataaagatcaatttttgcagacgctgtcacttacggtccgtctgcaacctaaaggggtccttgtacagaaaattctttttttagtagtgagattattcaaaataacaacgaggataaactgtgttggaagcatacttctaatggcacatgcaacacaaaaagtgcatacaaggagatcattaaaaaggggagaaactgtgttggaagcatacttctaatggcatatgcaacacaaaaagtgcatacaaggtgcatacaaggagatcattaaaaagggggagaatcaaaatctgcagcaggtaagtgctcaaactacttacgtaatcaagaaaatttagaaggatgaactcacccttccaaaggtcaacgtctttgcttggagacttatcagagaggcccttccaacagctcaatggctaaatctcttagaatttctgatattttggctgctgcttgttgtagacgtggtcaacctgaaactgatttccaccttctctttggttgtccctgtagtaaattaacctggagaatttctgaagctaatctatctgttggcaactttttgtgacaagtcgaagcacgatcgcagcaccaaaacgccttgtggtgatatggagtcgccaactacctcgatctagccaaacggccaaatcaagatgggttttgtagaaaaatagctaaaccggcaagcggagccgatttagatatcaaaatcagcctctaggccgatttagatctatatgatgagaactatccgtctcgtgggcaaaacagaaggttttcaggacaaacctacaaataggtgtcgcactctcgcagcggcagcggacgatttacggcgcaaatcgacaaaaatggactacaactagagtaaagtagaaaacgtgattcaagtagattgtgtgttcggggtattacaattgaaccggccttgtcccttaaataggggttggtcttgccctctataggcccttctccacgtccaactcgggatagaaaccaaaggaatcccgaaacatgctttcccgagcaaggaaacccgagacccgacgaaaacagactcagactcggaccctgacagtctgaccggccatatacctacagtcagaccggagttcaggccgcggtcagaccgcctacatacttgcggtctgaccggctctgtgaaggaaacccggcactttccaaactttggcaattttcccctattttgtcgatagatgccaaatttggatgtaaacactatctactgacatctttactgataatttccctctggctcatattattgcttatattgcctctaatagctcacatcagttgggtttaaatagaactctcatcttaatgtggcagatgtggaaagccaggaatgacttgaaatttcagggaaagctgaaagagccaactaaagtttgttttgtatctgaagctatggcaaatacatacaccattttctctgctcataagtctttgcaggatgatcatcaggatatggagcaagaaagaagaataaaaaacattcccaatggaaacagatgctatgtggatgctgcatgggaaaatggcttcaccggcacaggaatcttgtttcacatgttgtcttcacataatgctcttttcatgctttgtggctcattcatctttgcaagccgaactggtgggtttgcaactgacaatgcactactacaatagctatttttccgtgcggttgttttgattttggcgtgcggttgttttgcccgtctggaacattgcgtctgggaaaatcgtgattttcttgtgcaggtggcgcaaccgcacgtgaaaaatccgattttcgcgtgcggctgcttatgcgaaaataaaaatccaaaaaaaaataaattttcaaaaaaacaaaccctaaccctagatctagatccggcaccccaccgccgtgccggccaccaccgccgccggatccgggcgggggactgccgccgccgccagatccgggcggggggcagtcgccgccaccggatctgggcgcggggagggcggcgctgctcccagccctgccggccaccgcctcctcccgctcccggcacacgtcgtcggcccgctcccggccgccgccttgccgccggtgtcgtcgcgcgcacgccaattcaggccaccacctcgtcgtcgtcgtcggccgcgtgcacgctgctccgagccgccgcctcgccgtcgtcgtcatcgtcgtcggccgtgtgcacgctgctcccggccgctacctcgccattgtcgtcgtcgtcggccgcgcgcacgctgctcccagccgcctccccacgtccgcccgccgctgccgtgagcccgccgcgagccctctgcgcccgctagccaccgtcgacccctccgccgagagccgcccggaggagaggaggagaaggtgagagagagagaggaaaatgagagaagaggaaactgagaagataagggggagggagagaggagagaggtgggcggggggagagagaagaaaagtccaattttttttgaataggatgggagggaagtgctattttcctatgcggttagattaggaggcccgcatgtgaaaatagagctttttttgtgtgcggcc

SEQ ID NO: 460 - DNA, 5458 bp, Oryza sativa
atgcaacaattactgacagtgccaaggatgattttgatacaggtcattggagtcttaggggctgtttggatgcttgcttcagtttaccaaagttctatagctaaggtgtggcatgccacaatttatgtggctaagaaattcttgaccacaagttaggtaaatgttggcaaaggtatgtgcctatgacaagtagggtcacaaaattaaaaagtgtggcatgataaagatgtggcaatcaagcaaacactaggctaaattggtcaaagtagcttgccaaagttgtggcaaagtatggtcaccatccaatcaaccccttagacttctttgaagccaaattaagagtgtgatcccagaaaatcctatgcatgtggtttggatctcaagaaaaatcaacagtgtagctgataaaatggcctaataagctacttcctccgtttcatatcataagactttctagcattgccaatatttatatatatgttaatgaatctagatatatgtgtgtctaaattcattaacatctatatgaatgtaggcaatgctagaaagtcttataatatgaattggagggagtagaactcagcataacactgatccttctcaactgtaacatctcgcacattgcatctcgcacattgcttatcctaatagagattgtcatgctagaaatcttcaaaatgatttcgtttcggtgaactatactattaactatgtactacctctgaaattactattaactatgtactacctccatttcaggttataagattttctagcattgcccatattcatatatatgttaatgaatctagaaatatatatatgtgcctagattcattaacatttatatgaatgtgggcaatactagaaaatcttataatatgaaacggaggaagtactatgtttcttaaaaaaaaaggggagagacgtgagaggtggttgaacatagcttatagctatgttcccaacccctctcccgcattttccgcgcgcacgcttttcaaactgctaaacggtgtgttttttgtagcaaaaaaaagtttctatacgaaatttgcttaaaaaatcaaattaatctatttttgaaaaataatttagctaatatcgctccgttttccgtgtgggagggtaaggttcccaaccatgcccagcaaacacaggcatagacctctagagcgcggcggacgaccccatccacgtggtaggttccatatattgccttaacaccctcagaatgttgggattcaaaagattaaaaagaggtgccgccacacatgattttttatctaacaaggagaacttttacctctaagaacttttatctaataccggcctaattacggtgtaaaagcacaagagaacttttgaagaccgcattttccccattgtagatatatcacctctatatttttaccacgtgtcatttaaccattgggagccatttaaactgcctgcaaacaacttttgcctcttgtatacaatgatatgggaccatactgcaaacagcaaccgtctactatgtacatgccacccctaacaacttatccctaaaccgaacagaatcctatcatataactacaagaatttatttaatctatgacgaaaaaattcgtcatggatcactgaaaattcgtcacaggaattttcccatgacaattatacttatcgtcatctattgagcgtcaaagattaaatttgctgacgttttctccgaaatcgtcacagatcagcacaatctatgatgttttttaaccgtcataaaatgcttatgggctcgtgtagtccagcccaggcccaacctttgtgacgaaattaaacgtcatggatggttgccatgtggcggctaacatggcagttgacgtggtcgtttggacacgtgtgcgatgacatgtcactgatgacgtggcagctgacgtggttgttttgacacatgtgcgataacgtgtcactgatgacgtggcagctgacatcagcaattgttttatacggcccgttatttttttgacggcccattaatttttaaacagcccattaatttttttaactggcctattttaaaataggcccatttcagaactagcctattttgtcaaccaactatcagatcaaagcccactaaacagacccattaaatttgagcccaccaaattcaatccaatttatcatacaatctcagattcaaaccaacacatctcaacaaacatccaatacaacacaaaatttacaacacagttaacagccaaatctagtcacaatccaaatacaatcacagtaaccaaaatttcaccggatgtcgcatgaccaagatcttccaagtgagcttagcagcactgcatatgcacaagataaaacatcaataactgccatatcatcctagtttcttctactgttcaagcacttaatagatgaataaaaaatattcatgcagttactgatgtcacggacatgctgcaatgtcaggatcgggaggagctgtctccctctgtatgttatctccacctgcacttcgcacatttctgaaattttcagttcatctcagttcagcattttgtaacaaagaaactaagcatgctcagagatcaggcaaaacaatatatatatatttaccccttttcactgtggaaataatggttttcacgcatgagggagaggcaccctcaaatttccttactaaagtaacagttataggtgaaaaaaacaaccctacttccgatcctgctaccaaataaatagcccagttctttcgtgaactctgaaaagatattgaaatgcttttgcacttgtacagtggaaaaattggtaaacaaaaagaactgccagccctggtttcttcctattatcccttaatttaaaaggaaaagactgacatcatgctcacaaatttccaaaaattgggtataaactgaggcatcttaaactgcaatgcaactgcttagcatagtataacatgagaaagcacagccaaaagtttgctagatagccaaaaaaaccacttcacatgttaggaagaaacatgccactacagttttgacattcctgagcaccacatatggtggcaaccaatcctttttacatgaataagataaaaggagtcatcagatttgacattcataataggatttcacttattactttctaaaaaaaggtgaccataggactcataggaactcaccaaaagtgaccatgggaaggatgaaagttgaagcaaactcagcaattcgcacaggaaaaacagcctcatttcaatttggagcacatccaaaacctctacacagcacaccaatacatctctagttgcatctgtagcccatctaccgcagcaagaacagcaacaatcacgagggggaaggaagattagggaagcgagtagggtggatataccttgatgtagatgttctctgtttactgatagtttgctattactgtttgttaaaaggaaaaggaaagatggctagtcctgtttttgtagaatatttttgcagcatgcacatgtttaattgctaattgcaaattgcagtacataaaaaagtggtaatcttttatttcaggtggatatgatccagatatatatggactattggagattagtacttttgatttcatcttactgttaacatttatatatttcatattttctgaaagtacgttgaagtagagtttaccattcgatatataggaattgtgaaaactgctcaagtgatggataaataaaacactacataatgcaagtctcttgttcaaaagatcatgtcttacagctatatgatattatattggtttctcattctgcttgcaggtcagatgataattcattgaggttgattgccatagattgataattctacaggttaggagtagtacttataacgtatagatgcaattcagtttcaacagtcatgaagtgttgatgaattatgaagagctcaagcaatacatctctagttgcatctgtagcccatctatcgcagcaagaacagcaacaatcacgagggggaaggaagattagggaagcgagtagggtggatataccttgatgtagatgttctcggcagccttttcctcctcgccgagcaccttgccgccggaggagaggagccgccacagtgtgagccacgccgccagccttgcctgaaccccctcgcattgactcccttgcctgaaccccctcgcattgactcccttccgccgccgtaccaggtcaccgccacctccaccgaccccatccacgccggcccgcctccgcggctccgccaccgcctcgctgccggcctgcccgacgggccctccgtctctggcgcgccgctgtcctccgcctctgcgacggcgccaccagatccgccggagcaggctgtcactgtgcccgccgcccgccgccgagagccgagctccttcctagggcggcggatccggccttccctaggacggcgccgccaaatccaccgccgcaggtcgttgccgccgcgcctccttgctgccaccgccgctcccgctagagttgggacgccggcgagattgccgaagaggggggggacggaggagcggcgagaggagcggagggggaggcggaaggggcggcgagatccgagggggctgtggatggtgggcgaagggaggaggacgatgaccacggcgtggtaggcggcggtgtgagggtggggaaagagaaggtgaagaatggatggctagggtttggatatatgtataagaagctatgttgatgcgattttaccagaataaccctggtatctggaaacctattatacaagttacttggacaaaatggtcatttaacgtggaaatttcaaaattttgaaacttcaaatcgaattttatcataataaatgaacttatgtgaaaaagttgtttgaaacaaagttgtataacttactgagatctaccaattttattttggttatttctccatctgagtttcattggcctatataaaatttgaatttcaaattatgacaacttcaaacaatattttcaaaaactaaatgatctcaaatgaaaagttcatcaacaacaaaattgtataactcatcaatatctataacttttattttggtcatttttctatatgactttgtttcaacggtttgaatttgaatttcaaattatgacaacttcaaacaaaatttacaaatactaaatgatttcaactcaaaaagtcatcaataacaaagttgtataactcatcaatatatataacttttattttgatcatttcttcatccgacgaagtaatttgtaacattgttcacaaaatctacatatctctcttattttttataaacgtataagagatatgtacattttgtgaacaatgttacaaatcacttcgacgaatgaagaaatgacccaaataaaagttatagatcctgatgagttatacaacattgttgtgatgactttttcagttaaaatcatctagtacttgtaaatgttgtttgaagct

SEQ ID NO: 461 - DNA, 5127 bp, Oryza sativa
tagcatactaaatgaacatatgtgaaaaacttgtcaaaaacaaagttgtataacttattgagatctaccaattttattttggttatttctccatctgagtttaattgacctatataaaatttgaatttcaaattatgacaaatttcaaacaacattttcaaatactaaataattttaactaaaaaagtcatcaacaacaaagttgtataaataataaatatatacaacttttgttttggtcattttgctatatgactctgtttcaataatttgaattgaaccttgctatacacacgaagaaatctatacgaaattcgtacgaaaactacctgcttacgtgatttccatggctagaacactagaagcccacacaagatcacaggcctacaacactctagattattcaataagaaaagcccatatcaaattgacaggttcaatatcatgctactcattcagacttcagagcttcgtttgagtggagatgcagaaagcaaggatagaataaattcaatcagttctaaaaaaaatcaattcaatcaagcatatgagctaggtggcggctatatgtctaggccttaccgcctcagctgccgccacaatcagggtttacgattccgacaggcccttctatttcgggcactggcggaatttggaatttcgcgaaatccggtggaaaaccggtaaattccgaacaaatttcataaaccaaaatttgaatgcaaattccctgagtttgttgacaagttctcgaaaacctgtcggttttagcgaaattctgatcaaaatttcgatctgtaacctgtaatttggaccaactactaactgggcctagtacatgcaattcgggccatgtaagtgttttcttttttttaattctttattcttttctttcctggtgtaagttttagtaaatacacacaatacatcattttttttagaatatttatatcccaatatgttctatgaatatcatagtatttataagattttatttgtttttttcttttttttatcaattcaaatttgaatttggatgaaactcctcgaaatctcatacggtttctactttcgagcctcgtcggaatgtcgaaatttcgcgaaatccgaccggactttgttggaatcgtaaaccctggccacaatacgagcagtattgctttgcttcctgcataataggtacgatctaccatgcccacactaataataaaggcaaattttgtctacaggacactgtaatttcgtggttttagccgtaggacactgcccgaactcacttttggaggaaaacactctataaacatggtaatttggcaatagacatcgtgctgattaaaataataatttttggttgaagaggagagagaaatggcatgaaagttctaaaatacccttgggcccatatgtcatatcttccatctcttatctctatccccgctgcgccgccgcctcgatcgaggacctcagcgctgacgtcttccaggaacagcttgggcatcaccgcgctgcccaccctgaacgacgacgacccatcctccttcctgacgtcggcaaagctcaccatgaccatgagcttggtcgcccggccatggccgagcaggagcagcacggggtagaggctgtacagcagcagcagcagaagtccgcggaagagtcccccgacctccagcgcgacgagtatgaagtacgggaaggtcgacggcaacatgagctggccgccctccaccttgcacaccgtcacgtccgccgccgccgccggcagctcgtaaacgacgacggccgcctgacgacgcgtggcggcggagacggaagatgagcatggaggaccgctgctcgccgacgacacacggctgccgctgctcgccgactacgcgctgctgcagggcgccgtcatcgactatgcggcagcgccggcgacgatggcctcctgacgacgtgttgtggcggtggaggaggatgtgcatggaggaccgctgctcgccgacgacacgtggctgccgctactcgccaactacgcgctgctgcagggcgccgtcatcaacgccgccgcggcgccggcgatgacgacagcctgacaacgtgtggtggtgggctggcggcggaggaggatgggcatggaggaccgctgctcgccgacgacacacggatgccgctgctcgtcgcgctgctgcagggcgccgtagtggacgctgctgcagcgctagtgtccgcggagtggagcgccgggagcagattcaccggcatctccactgacccggccaccgccacggcatcggccatggaagtgtgggaggtgaggatagagagatggaagtatagttggccatatggcccgaggcccgatggcccggcccaagcacggcacggcccggtagcagtcgggcccgtgccggcccggcacgactattgggccgtgcctgggcctatggctgggcacggtgggccggcccggcacggcacggaccgaggtcggcacgatgggccggcccggcacggcacggcccaacggtcggcacgaccacggcccgtaccaacggtaggcacgagcacggcccagcccaacagacagccaggccgcaccgcgtgcgcccgcatatataagccagcgaacgccgcgtcgccgcccctcccctccccagtcccctctcgcctctcgctctccgcctctccgcctaaccctaaccctagccgccaccgctcaaccgcctccgccgatccgcctccgacgctccaccgcccaccagatctcgtcctccaccgtccgccgctcactcgctcagggcctcaggcgcgcaccggtgagactcaccgagtcgcctcccttccactcttccagatccagccttcctcttcgtctccgatcgatgcctcgcctgactcgcatgaggggcgcatgaggatgggggccaccggccacgcatggtcgcctgagtcatcgtccttccactcttccaaatccagccttcctcttcgtctctttcccgtttgttcttcttcgccagatcccttggtcttctcgtagatccgtgagcctatcgtcttcaacggcaactccggtgctccggctgcgcaggtacaagcatggaaccattgtttttattttttttttctccatttccgaccctaaccttgagtgttgttggctgcttgcaggtcacaagcccgttgcttagcggcagccgccgttgagggaccagagtgcctgcgatggatgacgatcctacctctgtcaactacgagttgaggactatggggatgcgcggtgatgacgatgatgatgtggaggaggatcgtgtggaggtgttcggcaatacctccgacatcccgatccatgtgaatgtcgatgacgacgacccgccggtcgacgacagtggcaatgggacgtcgactggctctagtgcgacttgtaccaacaagaagaccaaaacctccaaggtatgggatgactttgaggaactttatgaaacgaccaatggtaatagggttcgagtctctactaaatgcaattactgtcataaaactttgagtgctcgttcttctgctggcactggacatttgcttaggcatattaagtcatgcaaacctagaaagcttgggtctaatgctttgcctcagtccatgcttagatttagtgcaaatggttctgttattccatgggaatatagtcctgaagatgctaggtttgaattgtgtagattgattgctagagaggatcttccaatcagttttggtcaatctcctgcttttgtgaactatattaaggctgctcataaccctagatttgttcctgtctctagacaaactactaccagagatttttataagttgtttaaggatcgtcgttctgttattattgatcgtctcaattctgctagctctattgctttgacatctgatatatggtctggtcatgctaaggaagattatttgagtgttgtagctcactttgttaattctgattggcaattagaaaagagggtcttgggtcttaggcttattgatgagtcacatactggtgctaatattgctgagcgtgtgattgctgttgctgaagaatatggtattactgataaggttttctctattacattagacaatgcttctgctaattctaaagctatgatcacccttactcctgctctgtctggttatattggtgatttatttttgcatcaacgctgggcatgtcatatcatcaatttgattgttaaggctggacttgacaagttcaagcccatgctaaatgacattagagctgccatttcattcttgaatgcatctaatcagcgcattgctacatataaaaatgtttgcattgctgcgggttatcgtcctcgtatgtttggtttggacatggatgttagatggaattcaacttatctaatgcttaagcatctcataccacatagggaaccattcacagtatttattagtacacaacatccttttgttaatgaccatccattactcacagacttacattggacatgtgctgaatctgttttgtgtttccttgaacaattttatgattcaactgttgttttgtctggtgtttattatccaacatctccattaatcatgcatcacattttagagattgctggacatctaaacacatatggcaatgttcaaaacatcgcaaatgttgttggtcccatgaaaactaagtttatgaactattggtctaaaattccaattctttattcatttgcatttatcttggaccctagggccaagattagggggtttagtaaagtgcttcagattatggctcaactcattggtgatgattattctgcttatttaacaactgttagagcttcattgtttgatacttttgctaagtatgaaaaaaagtttggttctgttagattgcatagttccactattccaggcccttccactggtaagaaaaggactgcatgggggaagatttttggttctgttgttgctgctgggcttggtgctggtaatgcaggtgccagtccaggtgctggtaatgctggtgccagtccaggtgctgggcttggtgctggtaatgctggtgccagtccaggtgctgggcttggtgttggttcattatccaggatgacatctgctactgctttgcttcaggcagcttcttca

SEQ ID NO: 462 - DNA, 623 bp, Oryza sativa
agccttgttgagtttcctgtaatcgatacacatcctccatccggttacggttcgttgcgaaattagttcattttgagcatttgcaatgaccgtcattcctcccttctttggcacaacctggactgggctaacccactcactgtatggtacgggatagataatcctggcatgcaggagtttcaagacttctgtctttacaacctatcgcattgcattattgagccgtcgttgaggttccatagagggagtaccctcggggtcaataggaacacgatgggtgcaaagcgcgggattaatccccctaaggtcctgaagcgagtagccaagaacagaacgatgcttctctaacacggtgagaagacgttgagtctcgtcttcagagagcttatcactgatgatgacaggggcttctctgtcattgtgtaggaaggcatatcgtaggcctagaggtagaggtttaagctcaagcggaggtcgaggtggcggttccatgattggcaggtcgagagtctcaccgggatctgcttcttccttgatgaattccgggacctcatcttccagaagggccctcgggagactcatgaggaaaaaatgcagtaacctctttcactgactcaatttct

SEQ ID NO: 463 - DNA, 698 bp, Oryza sativa
gcagggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggt

SEQ ID NO: 464 - DNA, 1183 bp, Oryza sativa
aattttgaacaactgttgtctgtatttgtggcgctaatgtgtagtgtgtgtgaattttgggcagcaaagaggtgagtgggatttgattgactcttgtcaacatgtgcattaatgtcattgtaaactacggaatgtttactctttctttgtgccaatcatttgctggcaagcttgttgtcacgcccagaaatttagcccaaatttccaaactattttgtgtattaaatctctgtccaggaccagccagggtacacaaaacgacaagtaaatatacatatccaaacgtaaataaagcgtaaaatacttacagaagaggcacttagtcctcacactgagatagaatgacagcagcggaaaaggcgatcctagcggggcttcagctctactccacaggcaaaactcaactggggtctgagccttggtcctctaacttcgtcttcagctcagaagcactacacttctgaaaagggggaaccatagcaagactaagtacaaccaccgtactcagcaagccacactaatgatgcagacgtgcaagggcatacaaggacggcttgtggctatttgcataaaggcagttgtaaagcattttattgagcaaaacagtaaaacaatagagtaattaaggtaatattaaatctccactgaacaatgctacaccatgttgaacaggcccaaccattcccacctgaactaataagtgcattgagtcgatttactaggggtgagactaatcacggtgaatctggtcgatctcccataaccgcgggcatggctattcgaatagttttactctggccagaggtgcacaactgtacccacaagacacaatccaccggcatgtcacagtgtcatcatgtgcccatgatgaacaggtcaccacgtcgagtgattgtgagaagacccttcatataaccccctctaaccaatcgcaccacacctcaggtttcgcccccgcccccagcaggcaacgggcagccccccctcgtgccacagtgaatccggaagccgatcaaccgaacaccccagccgacccaacttcatcacgcccaccctagcctaagaacgttagccagaggaaagctattgtcacgcccagaaattcccgaatagaatttcaagcagaatgtgcattaaattccccgtccaggaccagccggggtacacaaacgacaatgttgac

SEQ ID NO: 465 - DNA, 1018 bp, Oryza sativa
caccacgacacaccggaaagaggccgtgacaggacccttcgcataaccccctctaaccaagcacaccccacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggagagctacactacaagcctagccgttgcccacgctggcttgtggtaagtacgataagttcttccagggcatcccgcgaaccggtccttaactgccatgggtgcgacttgctaaaccatgcacccccagcccaccatgtggttaattttaattaaccaacaccaaagcggtgtcactaatccaacaaagccattagaaccaacagtctaaacattaatgtgattttccccattgtgaactagttgaactaagcatggctaagcaattcctagtccaaagtctattcatgttataacccaagctaacaaaggagcatggtatcaaaatagcatggctgtaacaataggtaaacatcccatagtaacattataaaacaatgcaatatttgaaagaaaacaatagagcatttgcaatataggatcaacatgttcaaatgacaagcatgacttgccttgctctgctgctggagaaacctcggcgactatttcgaagtacaccggagcgtcggaggaaccggaatctagcgacaaacaaagcaaacattgcaaacaggctataagactactgaaacagagaacaaaaccatttttaatggattctacacatttttcttgatttactgagacttgagtgggcttaaacggagctcggatgaattagttatgaattttagaagattcactgtgtttattactatacaagaaaaaccttaaatcatttattgcgcaataaatcccagggctgacgccagcacggagggggcgcggcgccggcaagcgggccccaccggtcagcggctcagggggagcg

SEQ ID NO: 466 - DNA, 4413 bp, Oryza sativa
  unsure (1)..(4413): unsure at all n locations
aaaagaaaaagaaaaaggaaaaaggattttccctggaattaaaatattgcttgctcaattttaattggttaaaattatttctagggctctgaaaattccactaaaaatcctgttagtgaatttcgacatgtagaactcaagaaaaattccacatgccaaatccgattattatttgcattactttcttagggttttctcttgattgcacctgcattttcttggggttgtttataaattaaatttaggcttgggaggagaacttcggggtgtgacagctatacttcaagtcaggcagttacctattcccgcttgtggcaagcactgtgtgtcttcaagggtttcaagcgaaccggtccttaattgccatgggtgcgactagcaaaaccatgcacccacaacccaccattcagtcgcattttagttggataattacgaccatgaaatatggccagatgtctcgagcacgcagctcgtcaagatactgaaaggtctaatactgcaattatcccatcaaatgagctagtggtaattaagcatggctaagcatatagttctagctaggtcacataagtaacatgagctagtcgatttattacccaaggttgacaaaggatagatatcaagtaaacatggcaaaagcgagcagataggtaaaccctgatcacatgcaattagtaagacatgcaatttttatttgcaaacgataaaacatttataaattaggatgaaaatgctcaaggagaatgtgtgacttgccttgcttcttcactttgatcttctgaactattttcctcacaaccgcgatctttcaaaacgacggaaactactcgctggcacgcaaaacgaggaaaaaactctaataaaaaccaagtaaacagtacataaaaagtaaacaaacatgtagagctcaattttagatgaattttgcaagttgaatggtttaatttggagtttgtatgaattagatatggattttagaagtttcgagccatttaaatgaatttctagaattattattgatttattgcgcaattattatatatttttcttaaaggaaaacaaaagttattggctcagcagtggggcgggcgtggaccgagtccaccaaaggtgggccccacacgtcagccaaaaggggaggggcggcgcaccatggaccaagaccacggggtggtccacaggctaccaacacgagcggcatggcaagggtgcgggttggctcgccgaccaactcgaggcggcggcgcgtggccaaatggcgaccgccggcgacgacactagcaccgagcggcggcacgggaaacggggaaggaggggaataaatggagaggaggaggagggagggcggttcaccgaaaggcgcggcgacggagggagtcggccaacggagctcagggcagagggaggcggcggcgcttcagtgactaactgcgacggcggagggacggccgaggggcagtggggcgcggtggagatgatggtggtggaggcgctacgtggcaacggctatggcggcggtggtgtgctaccggagtcgtcaaagcggtggtagagctcgggttcacagtgaaatggtggttccggcgaggatacagggaaatggagtaaaggccggtgtccgcgaggggtggcggagctagtggtgccggtggtgcaaagcggcagcgattggagcggcggtagcggccaggactagcatacgattgaaattttaatgttatggttaatgagattattccatgtatgccacagactaacgactggtattactctctttggttcatattataattcgatttaattatttttccagttaaattgttttatgtttaattaagtttttaataaatatagtagtattttaaaaaaacgaatatgttgttaaaatatattcaaagcaattataatatggagtaaaaggagtactaatttagaaaaaaacgaaggacagaaaagaaaggaaaggaaaagtaaaagcaaacgacgattcagacagacaggctcccttccatgcctccccattgctcctactctcccttgaggccttgacccacccccaggaaaagcaagggaagcatgcccagcaaaatcgaacccacaaaacctcaggaattaccatcgcctagcaaggaatcaacaatccgtggtcaatccatggcagatcaggatgtggccgagccatggggcttgtcggcatggccccccttgacctccctcctcctccgagccatgaggaagcggcgcacctgggcggccctcttcctcgccgtgtacgcctctctgctctgctcgtcgtggcgcctggtggagtccgtgcgcgcctggtactactccgcggccggcggggctggcgccgtcgcggcgtggccggcggctttctacgcgtccgtgatgtacggtgccgtcttcgggctcctgtcgatgggagccgcgttagccgtggcggcgccggccatgctcatcacatggatcaccgtgttggtgctactcgcgttcgccggaaacccgcggaggtcgctggtcgcagaggggcggcgcgccacggccgatatcgcgcggctcgcgctccgcgtcttgctgcgcgagggcaacgcagtcgctgcgctctgcgccgccgccagcttcgcggccctcctcctcggccgccgcgacgacgacccggcggaggggagcggcagctgatgtgacgcttcctgcaaaattgttcaattccatgtttttttctttcagttaatatccgttttggggtttcagtgtttcaccaaccacccctccctcaccatccttttttttttctgtagaggtaaattatggagaaaaaacagattaattaacagtactacataattgctaaattgcaatcacagtgttgatgccgtcttttctttgctttgctttgtgtggagattatgggtaccccatacccacacggcatgattatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcatgagacaacctgatcgtcagatcaatacacactcggcggattcaaatccccaaacaggagtagggtattacctctcatcgagagggcctgaacctgtctaaatcctttgtgtctgcatccatccactttaggtctcgtacgcaacccccttttattattgccgaattcatgtttcgacagttggcgcgccaggtaggggttgcgtcgtattacccgtcgagaagtgcgatggaattaacttcaaaagaaacgttgagatcaatttcaacgtgttcaatggctcgtcaaatctttgatcttcatccgggtttgccgctccaatttattttattattagattaatttctaacaacagattgatcgatgatttgttttgcgagatgacatgctcaacagcgcacgtgggcacaccatcgctatcgcatcgattttgtgcatggcgaactgttccatctacatggcgccgcgagagttgccgccgggtgcactgcatcacgtcaggagtccagccggccgctgtgtgctcgccctggccctggtcaaagactattggttctttacagggttgacttgcatgcacgttcagcacctgcaagaggatggataaacccatgttgcatatttgcatgcatgcatcgatcaacatatatacttattgagttgtttctgtagttgctactaatttgatcaatctgggtttttttggctggctggccgattcttctggctgcttctactgctgcagggaggcctcaccatctcagtgtcgattgcttgattagtcctagtgacacagtgcaacaccaacgaccaattttctccgtctcggagtgagtccggtcgaggaaatcaatctcggcgagttgaatgatttaatcttcgactttgctaggtgatctatgctggtcatggactcgagacgtcccagctattcggtcaattggccgcgagtccactccgccggcttgcctttgccaccgccgctgatagcaacaacgtcttcaccgaccggcctgcctccgtcgccgccgactggtgtcctcgcctatacggttggttggtcacaccaccgttcatgggcgttcacgtcttcaccaaccggcttgcctttggcaccgncgctgatagcaacaacggntttaccgaccggcctgccttcgtcggccggcgactggtgttctcgcctatacggttgggtggtcacaccaccggtcatgggcggtcacgtcttcaccaaccggctttgctttgccg

SEQ ID NO: 467 - DNA, 9302 bp, Oryza sativa
tcatcattattccttgattatatgtttggtttgttcaattaaccacatagtcgggggttacacctattaggtgcatctagtcgatgcatctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatgattatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcatgagacaacctgatcgtcagatcaatacacactcggcggattcaaatccccaaacaggagtagggtattacctctcatcgagagggcctgaacctgtctaaatcccttgtctccgcatccatccacttttagatctcgtgcgctacccccttttattattgccgaattcatgtttcgacactcggcgagttgaatgatttaatcttcgactttgctaggtgatctatgctggtcatggactcgagacgtcccagctattcggtcaattggccgcgagtccactccgccggcttgcctttgccaccgccgctgatagcaacaacgtcttcaccgaccggcctgcctccgtcgccgccgattggtgtcctcgcctatacggttggttggtcacaccaccgttcatgggcgtccacgtcttcaccaaccggcttgcctttgccaccgccgctgatagcaacaacgtcttcaccgaccggcctgcctccgtcgccgccgactggtgtcctcgcctatacggttggttggtcacaccaccgttcatgggcgtccacgtcttcaccaaccggcttgcctttgccgccgccgactggtgtctctgccgacacggctagcctattatgtcgtcgttggtgggcatcttcgctttcaccgtcgaccgccttcgtcgccgccgactggtgtcctcattgttattgatggactgtttcgttcccacatcggctacttctgctgccaccgagggaatacgacaaagctaagtcatcatttattttattctttatatgatatttttccttttcctctgcctcactacaccaattggtcttccattgagtagtgagtcgggggctacagatgttatatcatattttttataatatttatcttgattgcttgagatgtaatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagacatgcataaaagggattcatggctttaagcttatctcttacgctccaggaatggatcagtcagaacatcaccaaccggcccgcctcgtctgccgccgactggtgcttccgcctgcacggctgacttattatgccgccgttgttgggcgtctacgtcttcaccgaccggcttgccttcgccgccgccgactggtgcttccgcctgcacggctgacttattatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttgtccgctgccgactggtgcttccgcctgcacggctggcctattatgctgccgttgttgggcgtctacgtcttcaccgaccggcttgccttcgccgccgccgactggtgtttccgcctgcacggctggcctttatgctgccgttgtttggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatttggtttatacagctaccactactgatggacatcatcatcttctgtcgccgactgattatgccgccgccgactggtgcttttatcttcacaactgcgcatcttcactaccagtttgcttctgttgccgccgactcgtattcacttcatcacggcaatgcaactttgtcatcatgcctcgacatctcggcatgcgatgccatgttgttttactacaacaagaggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgccaaattttatgtcaagctgaagaaatcaattcatcaaccaacgagtcaactccaggagtcattatcttcatctttgattcggagcagacattctacttcaacaacttcaaatatttcggtttggacgagttagacaacaacatcaactctcctccaagtgaagcatctacaacagccataacattaatttgatggattattgtcactgacatcatcaccagcacctctgcttcatcggccctgacatctccgctgttgctaatggatgattatgttttcgccgacttattatttcaccttcacggttgacctactatgcaaatgctgatgagcgtctttgtcattatcattggttgcgacactgctattgactggatcgccgacatcatcatcttcatcatgtcggttgcgtttgtcgtcgtcaactattttcttcatcttcattgttagttgatctgtctgccgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcgatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataatcactcagatcagaagctattcatatgagctacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgcttttcgccacgtaagtgtgcatttttattgaccaatattatggcttaggctgattatatattgtggtcatttttcaggcggttggtgaatcctttatgagtttatttactcggattttataccacatatgccatatatttccaggtgtggtggaaccatgtgtcttctagggacttaagcacatctgttaaagcagtgtgcgcatggcgtatgcccaatactatggaaatttctttattcacaacatacaagcttctttatagctgttttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggttggttagattatttattccttgattatatgtttggtttgttcaattaaccacatagtcgggggttacacctattaggtgcatctagtcgatgcatctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatgattatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcatgagacaacctgatcgtcagatcaatacacactcggcggattcaaatccccaaacaggagtagggtattacctctcatcgagagggcctgaacctgtctaaatcctttgtctctgcatccatccactttaggtctcgtacgcaacccccttttattattgccgaattcatgtttcgacactttgctttcctggtaggtatggcatctgttgcaagacttcacccttccgacagctagaagaaagccgtgcagactgcagaacagaggatccaaatgggagatctcggcctggaaggtactaggcgtagaagaaacaccggttgagtccgttaggacatccctgatggaagccacgtgtagtagactagtagtagactcatgtaagccaatataatctaggattaagggccctttgaatcaaacaaattatggaggaaatttcataagattgaaatcctaccggaaattttcttatgtagctctttgatgaaaaggattgaaatcctacaaaattcctatggaatggcttgttgcatataggttttggagaggtccaatctcttggtaaaaatcctttgagtttatctctctcatccgattcctatgttttttctgtggtctaatcaaacgatcattcctgtgttttttctgtgttttgcaatcatttgttttacactagcattcctgtcagaatcctatatttttcctatttctccgtttttttattcctacgattcaaaggggccctaattagattcataccattataaatttgctcgttataaaatataccattataatttataaaattggaaccacaatttagtaagtatcgaagatgtgccaatacttacccctttcaatacaatttctgaacaaattaccgtcgtcttcttcctccatcctcctcctgttccttccccgttctttccctcctctcagcttcgagttccgatggaacaagaggcaggaatggccgtcgttggcttcattgtacaacgtgcagcatgcatcatcactcccaccactgtagtgatatgccctagaggcaatcatacagatgattgtatcacatactatgtttatatatttatccaactttgttctttgaaatagataactcattattggttaatgaatatgtggttctttcattagactctttatgttgtttgttactatttcttaaggatccatgatcaaatatcatatgtggaacaaatatgtttaaatgatcagcacaagtattaattgatgatcatgtctcatggatcatagtacagagataccaaattaataatgtgaacacatgttggggaacatgttgttggatagacccaacatgatacagtgcaagagccatctgtgttgtgtcatcagtgatctcatttagtgttggtgttgaatccttagacctgagattatcatggttcccaacatgtgtcgtagcttacttagggactgctaaacgctactccgtaattgggaaattataaaagtagtttttgggtatgctgtgaaacatgtagtggaatatgaataatcaagatgggattggcccctcctatggagagatatctctgggcccctcgatgttatagattatggaagtgcatggccatgccaaaagtgattgaggagtcaatcacaagttatataatctatctatcacagattcgagtgaatgattgagctattagaggatggcacatatcttttcttgagcttaatcgatatcgtgaggcaaaggggttcatacaagtatacgctagaggttcagctgatatgatctttatgtatgctcggtgggtcaatacgttctgctaggggccgctgttgacacgtggagcgaaaaggagttttcgggttacagccgagtgtacatgaacctacagggtcgcatgcttaatgggccggaataaggggattggatggagatccaatatgagcttaattcagatagggatccgaataggagtcctacgggccttggaggcccgagtgatggattctatatattcgtgagaggtgtgaccagcggagggatcgcatcacgtgagaaaccctagccgtcactcccctcccggagcaaaaccctagccgcacgcgggtgctagcacatctgcgcgtggcgttccgtccttgtacgtgtggataccagtagaggtgccgctgatttgcggtgctgatcggaatgggagtacggcgagaagagtacacgaggaggagaaggtcgagccggtgccatcgactacttcctctacatcgacgcgcactacttcgcgagaattccttcgacttcttagcgccttcttccgctgcgcagcgcgtcgagtgataacgatctatgatctaatacttgcatgggtcctagtttacgcggtagaaaagttttgatttatgttatcgtagcctacgcatatcccaacaaccatctcctccaggtcaatgggctctagaaaactccataggtgtccttcctgggagctgtacaaactacaaaacacagatatacacatactgacataactaaagcagtctaattgggggaagaatacaactatgtgaggatggggccgggccccagcaactcacttctggagaattccgccagaacaacaacaggaagacgatcttgtaggcgtcgccgacatcatcgtctccgggagcagcatcatttaggtcgttgctgcacattacggtggcggagtctctgagacataggtcatcacctagccatcctgcgaagttgctgacctctactcagtcttgccatgtggtggcaaggtccggcggtggcgacgttgtaggacagcctcaaaacgagggcaacccccggatcttgttctatcgagcttgaagctgagagaagagagaaagggaatgaagaggatgaacaagaagacaagggtaatttggtcagaaagaagtaaaatttgtattgaaatggtaagcaatggcacatctttatggtaaattgtaatggtatggttccaatttcatgaattataatggtatatttcaaaacaagcaaatataatggcatgaatcaaattaaccctataatctacgataatacatgagacgctacacttccattaaaagatattcttaaaaggaataagttcacgtgacatccctcaattgtacgccgagtctgtctaaggtcccctaaccgcaataccagaaatgtgtacccctcaactatataaaaccatccaaaaaaggtcccgaggtagtatggatgcccggtttcgctaacatgtgatgaggatatcaacaccatcgatacatccacgtccccacaagtacaacttcatggtcctattacccgcgctcgtgcacgtcaactgaacaattaggtgagttctttcttgagttcattttcctcttctttataccccgaagacgcgtgcactcttgttttactcaggaacgatggagaggatccaaaggggagaggatttccgccggttggattcagattacaggacagcaccaacatcggacggtcttcacaatttcatgcgatttcggcgtgcaagtacttcatggaaagcttatcaagtctactttcaaatggatccagccacatgttcatatctgttctggagcggccgcaatcgtcgttttagtcccaactgctttctgtccatggtgctgcgtcacctcctttggcccaatgggttgtgtatcaagttgggcccattaggggtgcgtcctagggttggagcacgaccctgtggttgttcttcccctcttcttatacctctaatcgccgccaagaacacttgggttttgatgatagagttagctacttgctaccggctcgcagcgtgcatgttggctaaaccgcctgtctgcatgtaatcagaaccccaccatattgtgtttttgattgtgaaaactttcatcgtcatctagcaattcagtgcttgttctacttgttcttgcttgttctttgattgtttgcaagatgagtgccctcgtggcagggttgacgcgcaccacaagttcgcggtgaccattg

SEQ ID NO: 468 - DNA, 2308 bp, Oryza sativa
actcagcatgaaaatgagctgcaagtctgtagaaatcttgtgcaatgatatgctagcatttttccatgaaataaccattgaaaccatctgggccaggggccttgtcaactgggattatagagatgagattatcaatttcttgtgtgtagaacatgtcaatcaagcactccaaatctattctaggaacaaaaagctcgttcaaattgaaatctatagttggggagcaagagatacccatcctattcttgaaactttgatagaacaagtttgccttttgatcatgcaagttaactatctgaccactttgattcaaaacttgagaaattgtgttcattctgtacctttctgtggcaatagattgaaacaaattggtgttttcttctcccagcatcatccatctattagtacaatgttttttcaatatattttcctgtattccagaagttttaagatatgatgcttaactgcctccctgaaattccactaaataaagagaggcttttgtcttcttccagaagatcatgaaaatcgatcactttattgcagttattcaagagaagcatgattctggacagattcttactccagagcttaagctttttccccaaaattttcaacttgaaggagatacattttggaggatcatcaaaaccaggatctagcatccaatcttgctgaaccacatcaaagaaaccctcagcttcaacccaaaagttttcaaatctgaaaaatggagacttggggatttttgtatcaatctttaccacacatggaacatggtcagagatattcctggtcaaagggagaactgttgtattggggaaggttaaagtccatgaagcagaggtgaaagcccaatcaagcctttccagcaaaggattttgttgcatattgctccaagtgaaccttctcccttttaaggggatttcaagcaatcctagggtgctaataatctcattgaaaataaaaatgtcattcatatcagctcccactttatttctgtaaatagatctgtagaaattaaagtcccctaggaaaagccagttctgatgagcatcaatctggatatttttcaaccaggtcacaaaatctgatctttaaggcccattacatggcccatacacacaagtcaaggaccagacttgggaggtaaatctagaagttaattccactgtcacagataaagggttaacttctttgggtgtcccactgaagactcttgaaggccagacaattaaaattccccctgatgcacccatggagggggcaaaagcaaaagagtcaaagcgcttgggggcaaatttcttgatgtcagaaagatcaaagttctcctttttcgtttcttgaagacacaagacctggcaactactctcttcaattttctgtcttaaagacagaagcttattttcaacattcattcctctgatgttccagcacaagacattccaaggtttaaaattactattcattatcacaccattgagagaggggcaaaagaaccaagcctagcacagctaaccgaaaatgaaccaaaagacaatcacaccagtcttgacatatgatgagggatgttaggtcaagatcttccgataggtattgataaacaacgatttgggcggagtcgcgacacaactcgatccggcttctgaacgaacacgctactgagccccgcaatcgtagcaccacgtctcctctggttatcaaccgtgcctaaacccggttgacctcgccgagaaggctaatccctgcatgtgaatcgaagaacacaagcaagaacaagatagattgcaaccaaattgcatatgaatgattaagcactcgaatttggggttccacaaaccgatctagcggcgaaactgttcttgacaggataatccaagcaaaacccaactctaaatgatgacgtctactgaattaatatgattagggatgtcctagggttgccctagggcgcacaccgccttgggctaagcccacgacacaattacaaggcccaaaactcgtgtcagattcggactggatgagatacatggcttgttttgcagattcccggtagctcggtaggaattttgacatgggactaaaaccatctgaaagtagactccataagctttccaacaagtactcatgagcctcgaaattccttatagatcagtggctaggtccgtttgaagttgatgctgtcaggaggcccgaatccgaatccaaaacgtgtagaactttatctcttttcttctatggaccaaaaatgacgtgatgagatggaagtggacttggagaaggtcttgatatggtccccaatcaactt

SEQ ID NO: 469 - DNA, 7747 bp, Oryza sativa
gcgctcaatggtgtcaaggattttcactggcctctccacgtaggtcaagtcttcgcgaacttcaatctgctctgagtcggcctgctcggacggcactcgaaggcatttcttgagttgcgacacatggaacacatcatgcacgttgcccaaggaggcggccagctccaactggtaagcgacttctccgcgccgagcaatgatacggaaaggacccacgaaccgaggtgcgagcttccctttcgtctgaaacctgtgtacaccccgcaatggcatgacccgaaggtacacaaaatcgtccactgcgaattcctgattacggcgttggttatctgcataacttttctgccgggactgtgccacctttagattatcccgaatgattctgactttagcttcagcttctctcaggatatcagtcccgaacacttggctttccccaacttggtcccacaatagcggtgtccggcatttgcgcccatacaacgcttcataaggtgccatttgtatgctggcttggtagctgttattgtaggagaactcggcataggggagactcttatcccaggtcttcccgaaatctaggacacatgcgcgaagcatatcttttaggatctgatttagactctcggtctgtccatctgtctgcaggtgatacgtggtgctgaaatttaatcgggtacccagctcttcttggagcttcttccaaaagtgagaggtgaattggcttcccctatcagatacaattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaagtccatcccaatttcatcccatttccattctggtacttggagaggttggagaagtccggccggtcgttggtgctctgccttgacacgctggcacacatcacacagggccacaaactctgcaatttcccgcttcatactaacccactagtatttctccttcaagtctaagtacatcttcgtactgccagggtggatggaataaggactttcgtgagctacctgaagtatcagctgtttaagttctctgttatctggaacgcatacccgctttccgttccatagggttccgtgttcatcctctgtgaaaccagcagctttatcctgtttcatattcttgaggagtccatgcatgtccggatcattcttctgagcctcgcggatttgatcgagcaaggtaggcttggcttccaacgcagccaagaatccacgaccaactatgcttaggttcaaggcttccatctgttgactaagttcgggtggaatgccacggacgttaagagtgttgcaatggctctttcgacttagagcgtcggcaaccacgttggccttaccaggatgatagtgaattcccacatcatagtctttgatgagttctaaccatctcctttgccgaagattcagatccgactgggtgaagatgtatttcaaactcttatggtcggtatatatttcacagcgattcccaatgagatagtgccgccagatttttagagcatgaaccactgcggctaattccaagtcatgggtagggtagttgccttcatgcggtcgaagctgacgggaggcataggctaccacatgaccatcctgcatgagcacgcaccccaatccttggcgcgaagcatcacaatacaccatgaagtccttgcgagtatccggcaagattaacaccggcgaggaaactagcttttccttgagagtttggaacgccttctcgcattacgggctccacacaaatttctcttctttcttcaacaactgtgtcatgggtcgagcgattttggagaagttctcgatgaacctccagtagtatcctgccaaacctaagaaactgcgaatttgagtgactgtcttgggttgcttccaatcggtgacggcagtcactgtttcggggtccacagcaactcctttagcagatatcacgtgccctaagattttgacttcggacaaccagaactcacacttgctaagtttggcatacaattgatgttcccgcaacttccccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggtttaaccgaacgacatcaccgtgaattcatacagtccgtatcgcgtggtgaatgcggtcttcggaatatcttcttcacggatgcgtaattggtgatatccggaacggagatcaatcttggagaatacagtggcacctttgagctgatcgaacagatcatcgatccggggaagagggtacttgttttttatggtgacttcattgagagctctgtagtcgacgcacatcctcttcgtcttgtctttcttctctacaaaaatcacaggagcaccccatggggaagtactcggacgtatgtaccccttttctttcaactcttccagctgtttctttacttcggccagttcatttgctgccatacggtagggtcgcttgtacagaggagtggttcctggagcaagatctattcggaactcaatctctcgcttgggcggcataccaggtagttcttccggaaacacatctccgaactccctgacgatgggaatttctgacaatcctatctgatgaagttctgaacttctgacagaggttgggggtgcaaagaaaacaaccggttgttctggccctcggtacagagtgacagtgcgtctcgcgcaatccactactccttggaattgagccaaccaattcattccaagaatcacatccaagttcttggtgtctagcagaatcagatccgagggaaaaggaattccctgaatttctatagggacggcagggctataatactttgctgtcataacccctccaggggtggtgatgagcagagggttcctaagcctttctacccccaattgatttctccccacgaatggcatagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggctttgggcatttatccgcaaagtgcccaggctcgaagcagttgaagcacagacactgcggaccttgaacgtccctgcggccttgaccaggctgcacggctggcgtaggaggacggggcgcacgggtcccttgctgactctgctgttgttgcggctgtgggacgcgcaccacgaattgaggtcggggcgcggagcgaggttgctgctgctgttgctgctgctgtgaggaggatccccctggatagggattggtgtagcggaccctttggttagccccctgttggttgcggaaactcgccaagcgacgcttgtgcgactctagttccttgtgcttggcttccaagcggatgctcttgtccaccagacgttggaaatccggatagtccccggagactagacggacggacagctcagggtccattcctgccaagaacttctcttgcttctcctcatcttcacgaacatcctccggggcgtaccgggccaggttgttaaactcatgcaaatactccatcacggagcggttgctttgcttcaactctcggaattcccttttcttaagggccatgactccggcgggcacatgggttcttcggaaagcggcggtgaagcgggcccaagtaataggttgcccctctggctgcgtagccttgaaatggtcccaccatagagatgcgggcccctgcagttggtgggcggcgaagatgactttctcctcatcgctgcactgcacggtgtctaactttttccccacggcatgcaaccaatccaacgcatccacggggttattggagctagagaaggtaggtggacggatgcggaggaactcggcgagtttagagtgttgtgggggtggtggtggagcattatgttgtggcggattttggatgtggtggaggaaagcagccatcatgttggcctgctgggcgaggatttgggtgagaatggcgttggtgtctggtggtggtggtggaggcggtggaggaggtgaaggtgggttgccctggtggttgtggttgctgccttcggggtgactgccatcaccggtagcagcatttttcctggtcgtcaccatctaaaaaccccacacagaaccagcaaacagagagagctgacaattaaaactaaccacccacgactaccataaatcttgaatttattactgctattaaattggttcattaaagttcaagttgcttaagcaaataaaataaagacaggctccgacatatttataccacacaccggcataaccatgccccatacgactctagcagaaaaacaaacaagaaaaacacacgcgcaagcctactaactgcttgtctacagctgcgataggccaggacggaaggtgagcatcagtgctgccaacgccggaggctccatcctcctgaggaaccacgggcgcgggctcggcacgaggggtctcgacgaaacaggtccacgccagggactgacgaacaagctcgggcctggaggtactcttgtgagcggtgatcttctggctgcggcagacgcggcgacgcttggggcgacagacctctccctgggcgatcttgagctgacgcagctgcgcctccactgcgtctaggtccttcttcagctgcagattctcctgacgcagctccaggatcttcatgttgttctcgaccaacccgcgacgcaccatctgatggaagtcgatacgagccgcgtcgtacgcctccaccatgcgcgctagatgcatgatggtagcgtcatcctccgagctagcatcccggaaggtggcgtagtcgcgggctcctccgcgacgagggtggtaacggtagggcgagtgctgcaactcgtccgggtagcgctggtgaagagtaccgatggtgaggagtgcggcgttctggcaagcggcggagaaggaatctccacccgcggtgactgccaacgaagtcctctcgggtgagccagtgaggatcactgcagtaacctcccaagcagcgtggggctctgcatcgtcaccctcctgctccgagagctgcttgccctggtagtccactccatgcggataccccaggacaacgcacatgccccgcagctccaaaacgaagccagtcaggtccagaccaccacggttgatgctgccggccatctacaaacaaaaacaaaaagaaaagcaacattttaaaggtcagattttgacgataaatgaagcagcaggacagagagagactagaggattttcacaaataagacaggatttttattttgaaaatattgctaaggcttgggatctacggctcgtcctagggtcaagggggctctgataccaacttgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcagcgaaggcccagcacacacaaagacaaacgagaaacaacggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagggcagaataaatgcaagggagtactagggagttataatataaagggttagggtttgcagtaaacagcattaaaagacacttagttgctcaaagctattttgtaaatacggtcctagagctatacaatattattaaacaaggccgtgaacccacacgagcctgccttaacccaaggcctacgatgattcagaccgaactggcaacccgaccctgggtcccagctcgtcccaagccaacccagggcaaccattccacattttagttgttaaacaggttttaagaattaaaacactaacttgggtacattgctcggcttgcccataaccgagggcgcggctattcgaatagattatactctgatcagaggtgtacatctttacccacaagacacatcttcctcacatgtaaccacgtgccacataccaccacggtatacggacagaagacgtgacatagtctccaacccatcctagccatagacaagagtaccgacccaatcccacctacggccggaacccccgggacaggtaggcaagactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttttgcaacagaggcccgaagaccggtccttatatggccgaggtgctactatcaaaaccatgcaccccgagcccagcctaaaaccattttggggattttgaatagagggggcggtgtgaatccaattccacattaatcaaaccattccatagtgtccaggtgatgagaaaattcccaaagtctagagttgtaaaactacctaatgttgcctaattaaccagcgaagcatctacctaaaatcatactagtggtaccatgagtagagtgtccactagttggggttttgtttattctagggtgaacaaggaaataataataataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaaccacgacgaagagcggatcttccgaagctgcagcgtctacacgaccaacggaaaagaaaagacttttactctaataaactccatataacaagcaggaacaaagcacaaaaatgggttcttgacttcttaaggaaaaattagagacttgaacggtcaaattccgagttcaaatggccaagttatggctatttgaagtttatatgctctttaaatgaatatttgcgaatttcttcatttaaatttaattaaaaaaaggtttattgcgtcagccgaggggagggggcgcgcggaccgggtccacgggagtggggcccacgcggcagccccacggtccacggtggaccgggcgcacccgggctcacaccggccggcgccgtgggtcccacgcgtcagccgcacccgagggcgcgtgtcacatcctgattttttgtttcaggatttataaattatttaataaattattaatagattttatattaaatgatctttaatttacaagtgaagttaaatgtgggaaataaaatttcctaaaaataaagcatggatggatttaatttttattaaattctccatgattaagtca

SEQ ID NO: 470 - DNA, 6380 bp, Oryza sativa
aattgttgtttaaaagggattattagaaatgattttaaaagcttcgaagagaagatctaattttaatttgttaaatctcaatataaaattgggctagataaaattttgttaaatactttgcttaattctataattcctagatttttctgggatttatttgagctaaggaagtatttttaataaatggaatttcatttcatgaataatttaaattgaaaaatgtttttaaaagtccgttttggctttgggccgaaagccggcccaaaacctctcttctctctctccctcggcccaagtcggcccagttcgcaatcagtccgagccgccgctctcctctctctctcgctgccgctgacaggtggggcccgcctgtcggagccgtcttcctccttcggccgccgccgcccgaaaccctagcgcaagccgccgccatctccttccaaattcggccgcgtctttccttctccggtgaaatctttagaggggaaatgatcttctcgatttcctcttccttttctcttatggaatcaacggctaatttcgtttggaaattcgtggattcgaggtcgattcggatcggtctctccctcccgaaccctaatctttccttctcgtcgccggccgccgtgggcctttgccgccgcctcctagcccctttaaaaggatccccggtgtctcctctacccgccgccacccttgctttcgcctctcgccgtcggaagagccctagcgccgtgagacttcgcgccgccgtcgtcgccgtcgctccagccgtgcgccgccgccgtttcagtcgtcaccgtcgctcgggaaggccgccatcgtggtcgccaagtcgtcgccgtcctcgtccgccccttcgccgccgccgaagaccgccggagaaccgtcgccgccgtcgacccgatctccgccgccgcttctttctcgtcgccggcgctgtctgttgcttttccgccgccgttttggtcaccggtgagttcgccgcgccgcgctctacgtcctggtgccctccgttctcgtcatcgcgccgtcgttcgccggcgagcttgcgctcccgagccgccgccggtgatgacgtcaccgctgacgtcatcgtcgccgttcccgtgagccggtcgtggaccgattgatctcggccgtccgttttggataggatcgatctcggccgtccgttcccgtgaaccgctgccgtgcacccggtccaccgcaaaccctagccgctgacgcaataatccttcttttccttttcaaaaataaatcattattgcgtcataattcaattaaaatctatataagtgttttaatccgatttaatctttcaaaattcataactaattcatcttagctcagtttaatgtggttcaagttgcaaaaattgtgtaaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtctttttctttgttttgcgtgttagcttgtcgtttccgtcgttgcgaaggttcgcgagtgcgctggaagtattcaagaagattaattgaagaccgattattgcaatgcaagtcacacagatcctaaacacaatcctttgagcatgttgatcctatatttaaattctctatttatttcaactgtgcatttattttcaaatgtcattgggtggaattaacctattctttgttatggcccttttgttcttgattactttattccttgataccttgggtgattataattggactagttgaactttatatatattggttcaactagatatcagatataattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccagttcgcgagctactattgtgaaacattaatcgtgccaaccacaagccagcgtgggcaacggctttacctttcgtatagcatggttcattgcagagcaccagactgagaagtggcggagataagcccacaggggtcgctggggagtccatgcctctggttttgagggggtgattatgatccaggaaaggtgcactgtggtgggttgtgttatgcgaggggtaatgtcacagctcctttccgaggtaccgtggtggtactgaggcacatggtggcatgttgtggggctgtgtcttgtgggtacagtggtacacctctggccagagtaaaactattcgaatagccgtgcccgcggttatgggcgggttgagcaatgtttttcgtgattagtctcacacttctcacaataattatggatgttatacctggtaataatttgcttagctcctggtttggagattagatctgtacagccgggtatggttgtttcagaatggttgggcctgagcagcatgggcgtgttgttcagtgttgattaaaatttctgattaattactccactgatttacttctcttaaatgttttgctaaatgctgcttttgcaaatgagactatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttatttttccgctgcagttttcttcatggtgaggactaagtgcctcttaagtaagtatttagcgttttaattaatttgatgaatctgtatattaaattgtcagtttgtgtacctcgcctgattcctggacgaggattttatgcacaaataagttcagaaatttattagtgaatttccgggcgtgacagcgcgggcggctgacggtcgggcccacgcggcagccactcggtgcgcccggaggcggccacgccggcgcaacggcgggaggcggcgtgcccgcgcccctatggtcgccggcggcggccataggcacggcggagcggcggccgaaagaggggagggaaaggggaaacgaagcggcggtccacggctcaccccgggtcgacggcgacgacggaaacggcaaccggagcggaggaaggcggcggcgcggctcgggtggacggggtcgacggtgctccggcggtcgcgaccgaaacgaagaggtggacgaggtcggcgaggatgcggcgaacccgaaggagccggcgccgaggtggaaggtggtccgggtcgacgacggcggcggacccgagctcggcggtgacggtggaaagagagagcgacggcgcgagctcgattccggtggggagagaggcgggtgagtggcggaaacggtggtggggagctcggggagggtttatatagggttgggagtgaaagagggcggccggaagagggggaacgggcgcgggagacccggccgccattaatggcgtcggcgacgttaggggaggggtttccaaacgaatccgggggagagagagagaaaaatggggggaaaggggagggaatcccggggaataattccccccactttattgcgcgcggggacggcggaaggcggcgggattcgcggcggcggcggcgctagggcgcgggggaggcggcgggaacggcgggagaaaggggatgacgggtgggccccacccgtcagcgagggtggcgggcgggcccgcccgtcagcggcgcgcgcgcggggaggaggccgaatgggccgcggggagaggagagggagggggaaggagatgggccgagccggcccaagggggagaggggcggaaaggactttttttagagcttttctttttataaaaccattttaactttgtttatttcttaatatttattatttgtgctctgaaaattccactaaaatttatttacgcattttagacttttaggaaatatacaaaaatcctccaagccttatttgacttttaactttgcacattttaattgttggaggctttcacacggattttaattattctatgcataatttagaggatgtattttagagtcgttttgggacgtgacatttatagacctttcgagtgtttttcacttgggtttctttatatattttttcttggtatattaaagctaaagcagtcggctggatgttttattaaacgtcacatctgctcagctacataatcactcggattggatgatatttgttgcttgactatatgtttagtttttaactaatcacatagtcgggggctacacctaattaagtgcatctagccgatgcacctgactttttctatttttcagcccttcacagtctttactcgggagatcaatgcagaaggaattgaagagctcggattatcatttcgtcgactgtaaaggtctcaggggctactatgaagattatggataacccatacctacacggcatgtatagtccgactggatatggggtgccatgtatagatagaatatctttaagaagacttgggttaaattctaaacttgtatatcaaggaaatacccaaaatcctagtcggttacgattgtattttatctgtaactatatattctgttagggatatggactgtattttgtaatacggaccccttcccctatataaggaggggtccgggtgcctctagaggcacgatttttctcctagatcatacaatcaataacacactcggcggatcaatccccggacaggagtagggtattacttcttgaataagaaggcctgaacatgtataaaattccttgtctcttaacacatccacttttccaacttgatagccaccccctttagtattgccgaaatcttgtttcgacagtcggtctcttttccttcgcccaagcaagtacctttgcaaacaaaaacattggaaactcattgtgtagcaacgtttgttcaaatatataacatgtaaatctaatgtagaacatatgcacctttggttgattaatacataaggtagtcatggttatatccgagctagttgtgtcctcatcaacatactgacaggacaaatatctggtaaaacaactttgacagtaaacaaattacagacccttggaacatgataaatgtaaaacttaggcctgacaacaatactgaatcttctgtcattaattatcctccatgtttggcctggggatcttctgtcttctttcaccccccaagctggatttagccacctcctcaggagagaggctgcacatgtctacccccatcttctgtatgaccgaaagtgaacaattagagggagaggagtcagagttcatatcactataagaagtttcattgaaatcagactcctacatactgctatcaataaagagttttgcaatacctgcaaattccttaatctttttaacagactttccccttggcttcccaatgcccattcttgggtccatctgcaattctttggttgcattaccctgcagaagtcttgagctttgtcttctgtagggactatagagaatggccttcccatctttcctctttgcaggtgccttggggggaagtagggcaacaggggccacactgattgggctagccacactgattgggctagatgggggcctcacattgattggtagaacatcctcaaccacccttttcggctgagggggtgaaatagactcaaaaggttgcaaaacccattcaggttcatgctggcccactgaaggagaggaatcaaagatggacttccttggcaggagcaatgtggagaaatagttggacattcttaaagcagcaggaataggcttgccctggatcaaagtctgcatgatgccctttgctttacagaggaagtcaatcttgtccaatattcccttcataggataaaagtaggggtgccttggagcttcatttctggcaattctattcagccgagctagaaattcctggacttgggggtctagaacaggatcctggactgatgtcatcctagctgaagggagaggtgtggccatctgctgaggtagaattagttgtcctgggttttcctcaatctgccccattggatggtcttggccccaggcatcttcttgttgttcatttgcagcctgctgttgctgcactgcctcatcccattctcgagccccctggttcccagggttgccaaactgccagacattaccatcatcg

SEQ ID NO: 471 - DNA, 941 bp, Oryza sativa
taaaggggctaggaggcggcggcgaaggaccacggcgaccggcgacgcgaaggaaacctcggggttcggaggaaagagaccgatccgattcgacctcgaatccacgaacttccaaaacgattaagccgatgattccaaaagagaaaaggtggaggagatcccggagattgttccccctcaaaagatttcaccggagaaggaaaggagcggccggatttggaaggggacggcggcgcggctcggctagggtttcgggcgccgccggccggaggtagacgatgggtccgacaggtgcgccccacctgtcagcgaccgaacgcgcgcgctcggcggttgcggtctgggccgacttgggccggggagagagaaaaagggttttgggccgactttcggcccaaagccaaaagaggattttaaaaaacctttttcaatttaaattattcatgaaatgcaattccatttattaaaaatactttctttgctcaaataaatcccagaaaaatctaggaattatagaattaagcaaagtatttaatgaaattttatctggccccattttatattggaatttattaattaaaattagatcttctcttctaggctttttttaaaatcatttctaaaaattccaattaagcaacaatttatatattttgaattttcagggtgtgacaaacctaccccccttaaacagaatctcgtcctcgagattcggaagaactggcgaacaaatgcggatgagctgacttcaattcatcttctcgttcccaagttgattcttcttccgagtgattactccattggactttgcaaaagcggataactcgatttctggttcttctctcatctatttccaagatacggattggtttctcaacataggtcagatcctcttggacttctatctgttcaagattagcttcttcggtaggtacccttaa

SEQ ID NO: 472 - DNA, 515 bp, Oryza sativa
gtctacgtcttcaccgaccggcttgccttcgcccccaccgactggtgctttccgcctgcacggctgacttattatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgcttccgcctgcacggctgacttattatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgtttccgcctgcacggctggcctttatgccgccgttgtcgggcgtctacgttttcaccgccggccgcctcgtccgccgccgactggtgcttccgcctgcacggttggcct

SEQ ID NO: 473 - DNA, 2206 bp, Oryza sativa
acatttcttgatgaccatatgattggatcctaaaatctttgtagtcgaaaaactacaacactccccttcttgcaaaccaacctgtaactcatttaaacaactagaggaactagatagataattacttatattcatgcggtcctctagacaatacatttcatcatgaaaacgaggtatagtcaaattcgaacaaatatatactcgatgcactttatattctcctttactatcataattgccaataatatgaaaaatcacatcagaagggcatggcaattccaatctagcaaatagtttcttctctaaatagttgagtgaacaaagaacatcaaattgaatataaccccaagtatttaaagaagatagcaatttaaactcttcattctctctagcaatgtgaataacatgtttaaactcaacacatagtggttctactatagaattaacatgttcattcactagttggggcatggatataagtgaagcatcacacaactcttctttatcacaagaaatatgaagcaaattattttgtgacaaaggtatttcaacaattgtttccactataggttgctctaacgtagcataagtagtagacataggtggcacatcataactatgcataccttgagtagttgtagcaccattatcattacctttattattctcatcttcataaattataggtgcttttccaattgaacattcttcaagcatgcatggagctatagataggtcttttttctcttcgtctttcttctcttcctcctcattaccttggttgttctcagatgcctgcaaaatattagtatccaaagcaataggcacaacaaaacattcattttgtaataactcacacttagctgaatgcatcgcaatattagtatctttcctgggatctttgaaaatctcatcgattctaattttttgtcctttcaatactatctttgaaattttcctcgattccattttttatcctttcaagattatcttcgaaaatttcagtaaaactcatgggtaccagttttattttccgaccattatgtctaaatgtgtatgtattagcaacaaaattatgcgaaccattattattatatacccatggttgaccaaacaacaaagaacatacttgcatagggacaagatcaaaattggcagtatcatggtaatttccaatcgaaaagtttattctcacaattctatttatcttgaacttaccacgagagttgaaccatttgatgtaatatggatgaggatgcggttgtgtaggcaactcaagtttctcaaccaaatctgaactcaccaagttattgcaactctcagccctacccgtcagcgagggtggcgagcgggcccgcccgtcagcggcgcgcgcgcggggaggaggccgaatgggccgcggggagaggagagggagggggaaggagatgggccgagccggcccaagggggagaggggggaaaaggactttttttagagcttttctttttataaaaccattttaactttgtttatttcttaatatttattatttgggctctgaaaattccactaaaatttatttacgcattttagacttttaggaaatatacaaaaatcctccaagccttatttgacttttaactttgcacattttaattgttggaggctttcacacggattttaattattctaggcataatttcgaggatgtattttagagtcgttttgggacgtgacaaacctaccccccataaacggaatctcgaccccgagattcggaagaactggcgaagagatcgggatgggctgccttcagctcgtcttcacgctcccaagtagcttcttcctcggcgtggttgctccactggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttgcccaaggaggcgggcagctccagctggtaagcgacttctccgcgccgggcaatgatacggaaaggacccacgaaccaaggtgcgagcttcccttttgtctgaaacctgtgtacacctcgcaatggcgtgacccgaagatacacaaagtcatccactgcgaattccaggtcacggcg

SEQ ID NO: 474 - DNA, 12469 bp, Oryza sativa
tttatttcttcttaattattatttgtgctctgaaaattccactaaaatttatttacgcattttaggcttttaggaaatatacaaaaatcctccaagccttatttgacttttaactttgcacattttaattgttggaggctttcacatggaattttaattattctatgcacaaatttcgaggatgtattttagagtcgatttgggacgtgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcggagacacttcttgagttgcgacacatggaacacatcatgcacgttgcccaaggaagcgggcagctccaattggtaagcgacttctccgcgtcgagcaacgatacggaaaggacccacataccgaggtgcgagcttccctttcgtctgaaacctgtgtacacctcgcaatggcgtgacccgaagatacacaaagtcatccactgcgaattccaggtcacggcggcggttatctgcataacttttctgccgggactgtgccacctttagattatcccgaatgattctgactttagcttcagcttctctcaggatatcagtcccgaacacttggctttctcctacttggtcccacaagagtggtgtccggcatttgcgcccgtacaacgcttcataaggtgccatttgtatgctggattgatagctgttattgtaggagaactcggcataggggagactcttatcccaggtcttcccgaaatctagtacacatgcacgaagcatgtcttctaggatctgatttagacgctcggtctgtccatctgtctgcgggtgataggcggtgctgaaattcaatcgagtacccagttcttcttggagcttcttccaaaagtgagaggtgaattggcttcccctatcagatacgattttcttgggaacgccatggagactcacgatcctagcgaagtagagttcggctagtttgttccctccataggtggtcttcacaggaataaaccgagctaccttggttaatcgatccacaactacccatatagaatcatatccaccttgggtttttggaagtccggtgatgaaatccatcccaatttcatcccatttccattctggaacttggagaagtggaaaagtccggccgttcgttggtgctctgccttgacacgctggcacacatcacaaagggccacgaactctgcaatttccctcttcatactaacccaccagtatttctctttcaagtctaagtacatcttcgtactgccagggtggatggaataaggactttcgtgagcttcctgaagtattagctgtttaagttctctgtcgtctggaacgcatacccgattcccgttccatagggttccgtgttcatcctctgtgaaaccagcggctttaccctgtttcatattcttgagtccatgcatatccggatcattctgctgagcctcgcggatttgatcgagcaaggtgggcttggcttccaacgtagccaagaatccgcgaccaactatgcttaggttcagggcttccatctgttgattaagttcgggcgggatgccacggacgttaagagtgttgcaatggctttttcgacttagagcgtcggcgaccacgttggccttaccaggatgatagtgaattcccacatcataatccttgatgagttctaaccatctcctttgccgaagattcagatccgactgggtgaagatgtatttcaaactcttatgatcagtatatatttcacagcgattcccaatgagatagtgccgccagatttttagagcatgcaccaccgcggctaactccaaatcatgggtagggtagttgccttcgtgagtccgtagctgacgtgaggcataggccaccacatgaccgtcctgcatgagcacgcaccccaatccttggcgcgaagcgtcacaatacaccatgaaatccttgcgagtatccggcaagattaacaccggcgaggaaaccagcttttctttgagagtttggaacgccttctcgcattgcgggctccacacaaatttctcttctttcttcaacaactgtgtcatgggtcgagcgattttgaagaagttctcgatgaacctccggtagtatcctgccaaacctaagaaactgcggacttgagtgactgtcttgggttgcttccaatcagtgacagcggtcactgtttcggggtccacagcaactcctttaccagatatcacgtgccctaagaatttgacttcggacaaccagaactcacacttgctaagtttggcatacaattgatgttcccgtagctttcccaacaccagacgaagatggtgctgatggtcttcctctgattgtgagtatatcagaatgtcatcaatgaaaaccacaacaaacttatccaagtattccatgaacactttgttcattaagttcatgaagaaggcaggtgcattggttaaaccgaatgacatcaccgtgaattcatacagcccgtatcgcgtggtgaatgcggtcttcggaatatcttcttcacggatggcaactggtgatatccggaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatacggtagggtcttttgtacaggggagtggttcctggagcaagatctatccggaactcaatctctcgcttgggcggcataccgggtagttcttccggaaacacgtcttcgaactccatgacgatggggatttctgacagtcttatctgatgaagttctgaacttctgacagaggttgggggtgcaaagaaaacaaccggttgttccggccctcggtacagagtgacagtgcgtctcgcgcaatccactactccttggaattgagccaaccaattcatcccaaggatcacatccaagttcttggtgtctagaagaatcagatccgagggaaaaggaatcccctgaatttctatagggacggcagggctataatactttgttgtcataacccctccaggggtggtgatgagcagagggttcctaagcctttctacccccaactgatttctccccacgaatggcatagatataaacgagtgggaagctccagagtcgaacaaaatggtagcagggatggaatgaatgaggaacgtaccaacgatgacgtctggagttgtcagcacgtcctcggccgtcacgtgattcacacgaccccgaatgacatccttcccgccgttgttggagcggggaggagcttggccttgctgacgccttggctttgggcatttatccgcaaagtgcccgggctcgaagcagttgaagcacagacgctgctgaccttgagcgtccctgcggccttgaccaggctgcacagttggcgtaggaggacggggtgcacgagtcccttgttgattctgctgttgctgcggctgtgggacacgcaccacgaattgaggtcgaggcgctgggcgaggttgctgctgctgttgttgctgctgcgaggaggatccccctggatagggattggtgtagcggaccctctggttagcaccctgttgattgcggaaattcgccaagcggcgcttgtgcgactccagttccttgtgcttggcttccaagcggatgctcttgtccaccagtcgttggaaatccggatagtccccagagactaggcggacggacagctcagggtccattcctgccaggaacttctcttgcttctcctcatctccccgcacatcctccggagcgtaacgggccagattgttgaattcatgcaaatactccagcacggagcggttgccttgcttcaactctcggaattcccttttcttaagggccacgactccagcgggcacatgggttctccggaaagcggcggtgaagcgggcccaagtaatcggctgtccctctggctgcgtagcctggaagtggtcccaccagagagatgcgggcccctgcagttggtgggcggcgaagatgactttctcctcatcggtacactgcaccgtgtctagctttttccccacggcatgcaaccaatccaacgcatccacggggttgttggagctagagaaggtaggtgggcggatgcggaggaactcggcgagtttagagtgttggggaggtggtggtggagcattctgttgtggtggattttggaggtggtggaggaaagcattcatcatgttggcttgctgggcgaggatttgggtgagaatggcgttggtgtctggtggtggtggtggaggaggaggtggaggtgaaggtgggttgccctggtggttgtggttgctgccttcaggttggttgccatcaccggtaacagtgtttctcctggtcgtcaccatctggaaaccccacacagaaccagcaaacagggaaagagctaacaattaaaactaaccacccacgactaccattattcttaaatttatcactgctattaaattggttcattaaagttcaagttgcttaggcaaacaaataaagacaggctccgacatagttatgccacacaccggcataaccatgccccacacgactccaaaaagacaaacgagaaagaacacacgcgcaagcctactaactgctcgtctactgctgcgacgggccaggacggaaggtgagcaacagcgcatcctccgtgctaccaacgccggaggcttccccctcctagggaaccacgggcgcaggctcggcacgaggggtctcgacgaagcaggtccacgccagggactgacggactagctcaggcctggaggtgctcttgcgggcggtgatcttctggctgcggcagacgcggcgacgcttggggcggcagatctctccctgggcgatcttgagctgatgcagttgcgcctccactgcgtcgaggtccttcctgagctgcaggttctcttgacgcagctccaggatcttcaggttgttctcgaccatcccacgacgcaccatctgatggaagtcgatacgagccgcgtcgtatgcctccaccatgcgtgccagatgcacgacggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgttctggcaagcggcggggaaggagtcgccacccgcggtgactgtcagcgaagtccgctcagaagagccagcgaggatcactgcagtgacctcccaaccagcgtggggctccgcgtcctcaccctcctgctccgggagcggcctggcctggtagcccactccatgtggataccctaagacaacgcacatgccgcgcagctccaagacgaagccagtcatgtccaaaccacgacgggtgacgctgccggccatctaaaaacaaagaaaagaaaagcaacattttcaaaggtcagatttttggcgataaatgaagcagcaagacagagagagactagacagttttcacaaataacaaaggatttttatttttgaaaatattgctaaggcttgggatctacggctcgtcctagggtcaaaggatgctctgataccaacttgtcatgaccggaaataacccaacgggctttcctgacgtgcgtgcattaatccttgtcccaggaggcaaggtacaccaaaagttgatacaaatcagagtttaacaagcggaagcgtaaatagttaacttattacatgggcagcgaaggcccagcacacacagagacaaacgaaaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtcaacacgatcctagaactaaacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaataggttttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatatcccaaagtctagagttgtaaaaccgcctaatgttacctaattaaattgcgaagcatctacctaaaattaaactagtggtgccatgagtagagtgtccactagttgaggttttgtttgctctagggtgaacaagggaataataataacaatagcaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaccgacggcttcgacttccacgaagagcggatcttccgaagctgcagcgtctacacgaccaacggaaaagaaaaaggcttttactctaataaactccacataacaacagaaacaaagcacaaaaatgggttcttgacttcttaaggaaaaattagagacttgaacggtccaattccgagttcaaatggccaagatatggccatttgaagtttatatgctctttaatggatatttgcggatttcttcatttaaagttttaattaaaaaatctcatttattgcgtcagccgggagagggcgcgcggaccgggtccacgggagtggggcccacgcgtcagcctctcggtccacggtggaccgggcgcacacggctgacggcggccggtgccgtgggtcccacgcatcagccgcacccgcgggcgcgggcggctgacggccgggcccacttggcagccgcgagggcacgcccgaaggcggcctcgccggcacggccgacgggagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggatgacggcgctccgtcggtcggcgagcgaaacggaggcgcgaacgaggtcgacgggaacgcggcgaagccgatggaggtgacgccaagtggggaggaagtccggagcgacggcggcggcgaaccggagcttgtcggcgacagcggagagagaggaagatggcgcgagcacgaatgcgacggtgagagcgagcggcgaacggcggaaacggaggagagaggcacgggagacgtttaaatagggccgagaggaggagagagcggccggaggagatggaaaccggcgcggagatctcggccgccattgattgcgccggcgaactttgcgggcacaaaatcggacgaatccgagggagagagagaggggaaagtgggggaatcgggagagggaatcgcggggaatgattcccccctcattatggcgcgcggggacggcgggatgcggcggaatccgcggcggcggcggcgctagggcacgggcgagcggcggacgcggcgggaggaaggcgatgacaggtgggtcccacccgtcagcgagggtggcgggcgggcccgcctgtcagcggcgcgcgcgctgggaggagccgttgggccgcggaggagaggagagagagggagagaagtgggccgagccggcccaagaaaggaagggggggaaagaggacttcttttagggtttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacaggaattttaattattctttgcacaaatttcgaggatgtattttagagtcgatttgggacgtgacaattcacccccacccccagcactaagaggatcaaagaggacaatctttctcggcacagaatcctggtccctgtacttagccataacaaaaacccttcccaacattctgtcagcatcctcccaaaaagtttacttaccaaaagaggtaactgcctggtgcacatgatggcgatcaatgaaatcaagcgggaaatctaggaacatgaaccagccttctctatggtagttagccgccctccaattaggacattggtcatgattaacaaaaataacagagtgaaccccatcatagaactcgggcggggagaggaccagagcatccctattcatggcagacctcatctggaagaaacctactacagacgggtaccagaagctgttacaaacctcatagtgtagctcatcttgaacgaagtttgcaatgagggcccgatgatgatcccagtcctgctccaaggggattggctctacaatggccacatagaagtcttcatggcgccgagcagggcgttgcgggacagtgaggtcaacccgcgggatgcggaagtcacctccagcatgaacaacaagaccatgcattaggaagcgcagcggattagggttgagattggccattggggtggagggaagctttgggtgggaagcactgtgcgtttgggagaagaagggtttcggggggaagaagacgagatttccggagaaatagttttagccttccaaacagcagtagtccgagccgacggtttcggatttttagggtgcggggcttttgtgggcttagtggtcaaacaataacgggctaaatggcccggcaagagacaggctcgacatctaagcggcccagaacaagaagcccgagaatgacccttttccaggcaacggccgcaaggagtgttttccaaatttgaattgggcgacaaattaggatcccgcatacctttggcatgcgtaattaactccattgccggaatgaacgacggcgagacgttagccaccttggaggttgccggagaagtgactgaaaccgttttactctgcttaaaccactcttgattacaaaggttattccagctattgcctcttgttgaccgagagaagatgtagggaagaccatttggattcagcaagacaatgcacggacacatattctaccaaacgacgaagcatttgccctcacggtggcccaagtaggctattgacgagtgttaaatgtcgattctataccgccaacatctgcataaagatcagataataaaacatccaacatagtgataggtgcttaatctcacatattccacaagtgttggtctatatttgtatgcagataataaaccctgaagttgggaggaaaattagactaatgtgaggagaattatgtaatcatacaaggaggggttgtgaacttcatcgaaacattagtgaatcaacccaaaactccgagaaatggacagaggagagcctagggagtccaccgactgaaggctaggccaggaggggccagcccaagttcgaccgaaccacctggttcgaccgaacccccctgatcaccgctgatcctagggtttggcgaggacgctccagatgctctcccaatgacggttgaggggcagttcggacatttccccttcgcgaaccgtcatacctacccctatataaggacatcatctcactcacttcaacacatacttccaagcttgagctaaattataagaggctttattgtactatattgtatactaaaataggaagagcgtagagtaggagtcggaagaattccggagttgtcggtaatcttctcctatttcttttattctatttattactctgaatttaatataatattcttcttgagtaatttagatttatcttgtgagaattatctcttggttagttcctaaatagcatacggaattattgttcactgtaatcaactaaaatatagtgattgctttgctgagttataaacactaaagtagatagtaattgcttagacgtggtgtttaggtaattgttgtccagtaattgctgcgtataccacagtacgttgaggtgggtgtagaggtggtgacaaccctcgagatcactgaagtcctccctgtccgggtacgtagtagagcgacatctgggaacagcgggttgccagttcctgaagtactgcgttaggattaaaattaagctttctctagacactgtttctcactaataaatcctctctatcctagcctatcatttgcttggtgtccttggatgaaccggaggaagctctgatcacacacgttcccttggattcgatacccttggaatacaccgtaggggaagtgttacatcggtatatctgtgcacttacggattttatctgtaaccgtatcaaataccaagaagcatttctagcaccgttgctggggaacagttgctgatcatttccgaacccagttcatcctcggatcttttttcattttttttattctaccttcacccctgttatcctagagaagtattcttgtcaactcttctcgaccatggagcaacctctgtttgagttgtctactcctcggggcgaattctatgagccacctccttcatcggagcccatttgtacaactggctatgaaattcgtcccgagctaattagtatggttagggaaaatcctttttctggttttgatctagaaaatccctaccatcatctgcgagactttgaacaagtccgctcatgccttaagattcgtggcatgagacaagaaactgtgtggtggaaattgttcctgttctctcttcaagagagcaaagcaatggtacacctctaccgttggatgtgtaaatggtagctgggaaaagctgcgagacagattctgttttgccttcttcccagttactcgtatcactgcccttcgaatagaaattctcagtttcaagcagatcgaaaacaaatcaatcggtgcagcttggtccatattcactaatttagagcagtccggaccaaccctgtccttacccgagtatgtgcttctccaagatagaggaacctctaacaatcgagccacttgctgaaccatccacttctgctagctcaattgatgagaaggttcccgagcagccgtccatcgagaatgaagaaattcagactccggattgtgccgcaattatgttcagggacggttttgacgaagactatggcaataccctgaactattttagcaagaggaaaccacccgttcctttgtcacctcccgatcctatggaactcgggttcctatgagaaattgtccgggaattgacatccataatgagcaatgaatggcttagggaggcagagctttcatccgaagta

SEQ ID NO: 475 - DNA, 8883 bp, Oryza sativa
gtattccggataccatcaaattcccatccatccggaggaccatactaagactacgttcacacgtccatatggcatttatgcgtatcgtaggatgtccttgggactgtgcaacgctcctgcatctttccaaaggtgtatgatgtctattttctcggatttgatcgaagatatcatggaagtcttcatggatgacttcttagtttatggaaagactttcggtcattgtctgcagaatctagacaaagtcttacaacgatgccaagaaaatgacctcgtgcttaattgggaaaagtgccattttatggtctgtgaagtgatagttcttgggcatcaagtgtccgaacgaggaatcgaagttgatcgtgctaaaatcgatgttatagatcaacttcctcctcctgtgaacatcaaaataatccgcagcttcttgggtcatgctggcttttatagaaggttcaccaaggacttgtctacaatcaccagacccctgaccaatctgctagccaaggatgcaccctttcagttcgatgacgcgtgcctaaaatcttttgaagttctcaaaaaggcactcgtctccgctccaattattcaacctcctgattggactctgccctttgagattatgtgtgatacaagtgacttcgctgttggtgagtcttgggccaaaccaaagataaaaagcatcacgcaatctgttacgctagcaaaactctaaccggagcccagttgaattatgcaactactgaaaaagagctgctcgaggttgtttttgctatcgataagtttagatcttacttagtaggagccaaggtgataattgatactgatcatgctgctttgaaatacctgctcaccaagaaagatgctaaacctcgtctcttaagatggattttgctgctccaagaatttgacttagaaattaaagataaaaagggagtagaaaattccatagcagatcatttgtccaggctgcagatcactaacatggaggaacagccgatcaatgatttcttaagagatgatatgctgatgacggttcgcgactccaacccgtggtatgccaacatagtgaactacatggtatccaagtgttgatgtaaaaacacgaggcctgggagatctgcttaactccagtgcaagtccaaaacttgccttcgggtatgctagcgtgacagttgatttgatcctgcaatcaacaagaacaaggacaaagaaaccgcggttaaatccataaacgatagccgatcggccaggtgccgatgacatatcatttatcttcgagccgatgtcatatttgcatcgatcggcaggcattaataaataaaacaaaactaaatctactcgatcggctgtagatattaatgatatataatccttatatcgatatatacttaaatcaagtgattgggatagatcagtcgccatgccgagacagtataaatcacttagatcgaagtatatattaataatgagattatatatattcgtaacatagccgatcagatagatctagcatgtatcggctaatactctgatactgctttatactaagatatcaaagcaaatagaatatatcaaacaaaggcctaatatacttaaatgcaacaagatcttaacataaagggcagattcaacatatcaatgaagcacatagggtaaaaagtagttaaatcaggtaagatcggctgaaaccccaatgttaccctaatcggcaaccaagaagcaggctagaaattgagattctaatcacgacttataggatcaaactgaactgatgtagctataagtatgaaaaatagcacaatatctagacaatcaagccgttggatgtgtcatagagtggtagataccttatataatctaagccaacatcaatatttaacagaggttagccaattataggttagatagcgatattgccagagattatgtaagatatatgataactcgacgaattacataaacaagattagagtgtcatgaagatggaagcactaatcccgagaacgcaagccgccataacaagttttacctcttgttgaagatcgaaaccgatgcagctcaacccaaaagcaagaactcgtcgaaacaaaacgaaagtaaaatgggtggcgatgtgctgagattgtattgaacgtgtgttaattcgattacatgggggctcggggtctatttatacacgagaattacaaaacatgtccatatcggacatgactcttatctctaacaaactctaagataccataagtctttgcagcagacttttgcccaaacatatctctaaggaaattacataaaatatcctaattaatagatacaattgccttcttaggactctatccatgtgtggcaatcatcttgaaacatatcaactcaacctgatgatgtataccgagttgtattgtcggaatcgactgtatcggcttacctagtctgactcggacacagccgatcctgatcgtagccgatttggactctagccgattcttactctgtttttgaaatgatcttcgtctttgattccgcctcgatctaatcttcatctccaatgctgatattaccaaatttggtcgataacaccaagtacataccaccaggggaaaatcaatgaaaactgaagtatgaaagtcgccgtcacatatgggatgagccatacctatatcgggtctgctccaatggcctactacgaagatgtgtgccaactaaagaaggactgaagatcatagaacgatgccatgcctcaccttatggtggtcattacggtgcattccgcacccaggccaagatttggcaaagtggtttcttctagccaacaatgtacgaagactcaaaagaattcgtcagaagatgcaccagctgccagaggcaaggaggaatcactgctcgcgatgcaatgcccctcacatacaatctgcaagtcgagatattcgatgtttggggtatagacttcatgtggcctttccctaagtctcgcaactgcgagtacattctggtggcagtcgactatgtctccaagtgggttgaggctatgccgtgcagcgctgcggatgcgaagcatgccaagaagatgttcacaaaaatcatcttccctagttttggtacccccagaatggtcataagtgacggaggttctcacttcattgacaaaacctttcgagacctcctacaagaaatgagagccaaacacaatgtggccactccttaccatccacagaccagtggacaagcagaaacatcaaacaaacaaatcaagaatattctgcaaaagacgatcaataaaatgggaacaggatggaaggatagattgccggacgcactgtgagcatactggacagcatacaagacacccattggaatgtccccatatcagatagtttacgggaagccatgccgactacccgtaaaacttgagcgcagagcatactgggccattaggaattggaacatggattttaagcgagctggagaatggagaaaaatgcagatcgctgaacttgaggaatggagagaaaaggcttaccacaacgcaaagatatacaaagaaaggacgaagcgcaggcatgacaaaaggataaagatgaagaaatttaagccaggagacaatgtactaatgttcaactccagggttaagctttttggccacggaaaactgcgcagcaaatgggaaggaccgttcgacgtcatcgacacctctttgcatggggcaatcacacttcgcgacgaataaggtaacatatttaaggtaaacggtcaacgcctaaagattttccttgagccaaatgaaactttagatgaagaagtggatgttactgaattaatttattatgaaccatgatgatctcatctattgcatgcttaaaaccctgtatagttgtcatttttgtacttaaaataggttttagtgggcctatgaaaaatttggtggcatgtcgaacccaccattgttcagccgaacatgatggttcggccgaaccagggcggcgcccgatcagccccaattttgaacctcagtctcccccgctcgtccctagtctatttagatgcgtgtttggaggtagaacgttcggatcacaccagaacactccttcctcttttcctccacatttgcacactctcctctccaattcaacacaattcctcgaatttccactcatatccaccaatggctggcaaatccctaatcccattcatcggcccttcctctaattccacttataacctcaccggagagccgacaccagcgaatcaattgatcccgatggaagaatacaccatggaaggggtaattgcacagtgggagcagcccctcgcagcagtgctgggctcccctgcgaatctggagcccgtcggcgagctccttggttcggccgaacccttctcggccccaatcggcctcccgttcggcagcgcgatccctctcccctcgctatgttacaagaacaaaaatccggggggattcgcctgcacgacggccgactacggcagaactcagcttgttaaaggcacgatgtcttttccaagatgacgggaaggccgcaccgcctcccgccgagcgctatgtgggcgccctcttcaccaaggcaggggatgaggtgctccacaagtataccacacccaccgctactccatccaccccaaaaggggagcgtttctgcattcagggagtgtgaactcccggcggtgggtatggcaaaggtttactccggcctttgatggcatcggagaaggagagggcagcggaatcccgtagccttccacctaagaaggtgaagtatcgtttgacgccccctccaattgtgagggctctcggccaattcctagaggatgaggtgaagtcaccggagccctcgatccacaagctcgccgctcaagtgaagaaactccgcaaggagaacgtagagcttagggattgcaatgcggagctaggggtagaacttgctgaaattagaaataatttcgatatccttagtcgcggtttgcgcgctaagatcaagcgtgcgttcatagagatgggaaaggaaaataagtattatgctaattagatgtttcctttcccatgaataaaatagtagtaggtgcttagttttatttttgcaatcatgtaagcacttgctatgaataatgtggcacattggtgtttaccccaatgtttgccaaagtttgttttttgtttaataaaattcaggttttgaataagtgtgggggcgatatcccagcttctgacgtgcatatgctctgaaaattgttgaaatatctgaacacctggaagcactcaactctgcagaaaattgcagaggaatcgggcaccagagtggttcggccgaactaccaggttcgggcgaaccagtgctggccccagtccctctcatcttcacaggtaagcaggtgagcacgtcctttatctgtatatctccaccatggtatagtactagagctgcaaatttagaaacaattggttcaagcataagtgaaagataaaatttccaactattgaaattcttcatgtgattgatcttttatattcattattctcagctgaatttgtgcttgtgaacaccatccatgtttagggaaccttatacatctaggtaattgctttatgtgagatgattaagatgaaaggactccttgtaactttgttgtgactcttgggaatttgttttcaaaaataaactgttttaaaagctctatcctccaattgactttaccttatacctaccaaggccatatgcaagcggcggggaaggaatctccacccgcggtgactgccagcgaagtccgctcgggagagccagcgaggatcactgcagtgacctcccaaccagcgtggggctctgcgtcgtcaccctcctgctccggaagcggcctggcctggtagtccactccatgtggataccccaggacaacgcacataccccgcagctccaagacgaagccagtcatgtccaaaccacgacgggtgacgctgccggccatctacaaacaaaaacaaaaaggaaaacaacattttaaagatcagattttggcgataaatgaagcagcaagacagagagagactagacagttttcacaaataacaaagaatttttatttcgaaaatactgctaaggcttgggatctaaggctagtcctagggtcaagggggctctgataccaacttgtcacgaccggaactaacccaacgggcgttccttacgtgcgtgcattaatccttgtcccaggaggcaaggtacaccaaaagttgatacaattcagagtttaacaagcggacgcgtaaatagttaacttattacatgggcagcgaaggcccagcacacacagagacaaacgagaaacagcggaagactagggcgacgaccacaggcgcttgacggcaggcacgagctagacaccgaagccttcatcctccaggaactcctcttctggggtttgggaaaaattgggcaagactgagtacaaccaccgtactcaacaagacacacccagaaatgcagaataaatgcaagggagtacaaaggagttatactataaagggttagggttgcagtaaacagcatttaaagatatttagttgctcaaagctattttgtaaacacgattctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgattagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacctccgggacaggcaggcaggactgagcccctagcagcaggacaccggccctgtgccatgacatctcgactaccgagccgcagctcgtgtagccttcatttgccctggagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccatttcaaagtgtccaggtgatatgaatattcccaaagtctagagttgaaaaaccacctaaagttgcctagttaaaagcgaagcatctacctaaaatcatactagggataccatgagtagagtgtccactagttggggttttgtttattctagggtgatcaaggtaataataacaataacaataataatagggtcataacaaaggtaagtaggcatggctaaataaaatagtgataacgcgggaatttaaataaagcgataatgcaataatttaaatcaacataattttacaaaccgggattcaatatgttcaaagatgatgtgacttgccttgctcgctttcccaaacgtcggcttcaacttccacgaagagcggatcttccgaagctgcaacgtctacacgaccaacggaaaagaaaaggcttttactctaataaactccatataacaagcagaaacaaagcacaaaaatgggttcttgacttcttaaggaaaaattagaaacttgaacggtccaattccgagttcaaatggccaagttatggcatttgacgtttatatgctctttaattgaatatttgcgaatttcttcatttaaattttcaatttaaaatcagatttattgcgtcagccgaggggaggggcgcgcggaccgggtccacgggagtggggcccacgcggcagcctcacggtccacggtggaccgggagcacgcggcttgcgccggccggcgccgtgggtcccacgcgtcagccgcacccgcgggcgcgggcggctgacggccgggccccacatggcagccacggggcgcgcccgaaggtgacctcgccggcacggccgacgggaggcggcgcgcccgcgccccgatggtcgccgccggcgaccaccgacgcggcggagcggcgcccgagagaggggagggaagggggaagcgaaagggtcggtccacggctcaccccgggtcgacgaggacggcggaaacgacgaccggagcggaggaaggcggcggcgcggctcgggttgacgaggacggcggtgttccggcggtcggcgggcgaaacggaggagtggacgaggtcggcgaggacgtggcgaagccgaaggaggcgatgccgaagcgggaggaggtccggggcgacgacggcggcggaccggagctcggcggcgacggcggagagagaaggggacggcgcgagctcgaatccgacggggaggagagaccggcgagtggcggaaacggtggagggaggcacggggagtgtttgtatagtgttgggaggggcagagaccggccggatgagggggactcggccgcggaagatccggccgccattgatgcgccggcgaagtttgcgggagtgtttccaaacgaatccgagggagagagagagggaaaagtggggggggaaagagagagggaatcacggggagtgatctccccctctttattgcgcgcgggggcggcggaatgcggcggaatccgcggcggcggcggcgctagggcacgggcgaggcgg

SEQ ID NO: 476 - DNA, 26821 bp, Oryza sativa
ctaggagtatgactaatgatcttcttgagtccatatttttggctttgcaatatatatgatgtaggcatgtcaccagtttatccctaccaagcttcacatatcagccttagaataggggtaaattcttgcacactttgcgttggtgaggatccaaatgaaaatatacatctttgagagataagagagaaagtcaaatatgaggaaaagagatagtttgcgaaaattcataaaaatcccatgagtttgacagagaagcaagaaggactgaaatcaagatcgttccatcccaaaaatccttcttttatttattaggagagggcatgattacattttttttaacattatgctcatgcttgatggagcataaattctttttttttcataaccatgcctttccctcctttctttttttttctttcaaaaggatttttctttttttaggagaagaaagcacatgaaagcatggagaatttattttggtggtaatatgcatatggaatggaatattgcttagctcccagtgtaggagtttagcatgtgcatatatgtgggtgtatgatcttgatcatagagcatgagaagtatctacacaagtcataagagtttgacaaagttcaatggaaagtcaagcaaccaaaatgtatatagtttaatcatgatagcatatttttggctctggtaggaatttatatcaaatgaggaactttcaattttatcattttgaaaacaaatcatcggaatttaagtcaaactagtatcaggatcatagctactcttatttactatctcatatctcacaatagcttggacttaaatcagcaagtgcagcccatttaccttaggttcccggataattattggctacttatattcaatctttgagagagcacttaccaagaacccatatataagagatataaaacagagcaacaattcatcatttcaacaaagagaactagctagtcttacctagcatgactcaaacctatcctatctttttggtattttctattttgcaaatttttatgttttttttgagttttataagatgcaattggaaagcaagtatgcaattggaaagggaaatatgcaatgggatacaagttaccttagtggggggagagatgtctccctccaagcttgccttttgctcagggtccttgataaggattgaacccctgaaatcgaaagtacgcgtgaaggtcatcatgatgttactgcatcatgttgttgatgttggcgaactgagcattagcagattgttgccattcttgtgtttgagctatgtgttccgtgaggttgtactggatctcccctgtctgcacatcaagggtgtccattgtcctagtgatttcacccaagtcccaacgagaggaacttgagcaccattcacttggagatggaggcacaccacttgatctagagggttggttgtccccccagtggatgtcatgaggcgcatgccaccggtcctcactggcgcttgaccaggttgagactccgatgctatggcgtggagcttggatccatccaggtgcatccctagttggtgcccaacctgcctcatacatctgcacgggtgtcgaggatgatgaactttctcgttcgttccttgtcatgttgcgcgtctccctgtatgttccacctgcacgagattcttctatggtctgcaggggaatggttagttcatggcagttgtacaaatgataccccgcatttggcaacaggatttcatttgtaaaaccggggaaaaagtatatcaaaaattcatctgctccatgtttcaaaatatgcccttgcactagataggcctcatcaatacgcggacgagcggctgagataaaagcaatttggtcgctaacgacccctagcacgagcctaagtgtaggattatggatatcatttgttgtcaaagccacaactgcatacgtcgaaagacgtggttactcaacagtagttggaaaagaagtaaaaatgttttaaaatgaaaaatttttcttgggatccccctattacatggccctatggggctagttataaccccattacaggttcttactactaggggtttggttatatagggaatttacatggttgcccgtatgaaaaggacatttacacgggtacacagtgtaatttaggttcatgggccccctacgggccgttaggcgattgttgaccccattatcccctatgctttttgtgcccgaataggttttttgggcccccccggggcgaacttgctacggcaaagtcgtctcccttcggcatatacttttcgccctacatccttcgcccaggaggcctctggcttggtgaagtacccgtgagattccctgcctttcgccgttggtgtttcatagtcttcgccatgggggacttcgccctgactaaccttgacgtctcgggcttgaatccccactggtcgcatggtttcagcaggtttggtcaaagggcctcatgccatatcgccaacaagcccctcacgggcaagggtgagataggagcttcggccgagaccgtgcaaaccatgtggtatggtatgtggcgccccctttcgactggtgctcctgccccccattctctttttcaccgccacacttgtcattttcaccgcgcgcgctttcttcctctgttcttcctctcacggcgccccttggcccttcagacctttcactcgctctctctgttcgcaactgcacactcccttcgccatggctccccgcaagcctaacccctcttcggcgaaagggaccgaccccggccggattgacgacgacaccaccgcctatttggggatttctctgatagacaacggcgagttggcaaagttggtcagctctagggcgttggttgagggacaggctttcgccctggggaaagccgttgtaccgaagcccgtcgacaaccggacggtggtgttcgccgtgttttttgaggcggggctccggtttccatgcaactcgttgttgccggagatcctttgccttttctaggtggagctcccacagttgagcccgtcggcgctggtccggatcactatcttcgactgggcgtgccgaacttccgggtttgagcctaacgccgaactcttcgatgccatatttttcgccaccgtgaattcgaagacggtgattaccccggccgggatgaagaagacagtgttcgggagcgtgaactttaatgttcgccccgagcactccaatctctggccggtgaatgccgccatgtcgaagtgggaccgccattggatggcgaggtggtttttccacatcatccccttcgaggctggttccgagtcagcgaaggccctccggtgccggcgcaaggcgattgcacctaactggaaacccaagatcgccgtggacggtgctatgaaggcgtggttcgctctgctgcgtaaggtttgttcccgccttagctgtcatgacttggtggagactgcatgcttcgcatctttcccctctcccagtcatggcaagtcgcggttgaccaaggcgaagaggttgatggtctgtcaaagttggttctccctaaggggacgaatggtaagactgcactttcactacgcattcctgttcttggttattttgcttcgttcgacacttaatgtggctgcaccctctattttttttgcagtgttgaccctcaatcaggccgacgccgaagcccggaagatgatcggcgacgtgtcggtcgtagagtatagccagctcctgacacgataggcggtcggccgggcgaaccgggtttataacggcgaattgcctcccgggcgaacccccacaaggccgacgacgatgcagggccttcgcgaaagtggacgcgcggacaagtgaagcttgcccctaggaagcgaagggttcctgcttcctccgattccgacgccgatgatgaggacgacgtcgaagagcgtgacggcaagtaggaaggggaggaaaaagaggaggcggaggccgtggccgaaaaggccgcggacgaggcggtcgaaaaccgcgtcgacacccctggctacactcctactccaagtccaggtcacaacgagactggggtggaatcgaatagctcccttcttcatcgaaaggatttggagggggcgaaggcgctagtagcgttttcggcaggcaaggcggcgaagggaggcccagttaaaaagatctccaaaaagaaaggactcgtcgatgtcgctcgcgttttcagcgacgacgagtcttctgacgagactccgacttcgcccgctggccacagcttgtacctttcgaccgctcccattcttccgctcgacgctagtggggcaggtggtagcgccgccgctggggcttcaacctccgctgaccggatcgtgatggctgcggcgagggttttcggaagccctctgcgtcagccggttgtttcaccgctagtaaaggcgaaggggaagggggctgccgtcgaaacatctgcctcggagtactccctcgtggtgccccacttcgcccctggtgatttcgagacccgggcggatcttattcccttcgtcgagggagtaagcaatcttgtcttacctgcctgcacccagagcctattcaccgagttgaacgagttcgatgaagggtgttccgctattaaaagcttggcggttcgggtacgccttttcgctctctttttgattttcctctccttttttacatgtcccataattaacatttattctcctcgcccgctcctgtcttggatctagattcttgcggcccactgttcgacagagcgaactgtgcgggcccatcttgatggatttaagaaccgtcttcgggccaaggatgacgaaataggccgcaagagcttgaagatggaggccattgccaaaaccctcaaagaggcgaaggccgaaaacaagtggctccaaaccgaattggagaaaggaaaagaggctagggccgaggtcgatcgcctcaaggccgaactggagaaggggagagaggccagagctgaggttgatcgccttcaggctgaactgaagaaagaaaaagcccattccactatgctgaccgactattataacctcactaagccgaagatggaggctcttcgtctggaggtcagcaaggctgaggcgagcactgtggaggagtcacagcggttttcacgggagatggcgaaagccaccgaatccgcaagaacggcgtgccaaacgctccgccttgcccttactgacatgggtgcaagggtgcgaggagtccctgccgaagacgcctcagccttcaacttcttcgagtggactcagcaggctggtggtgcggtttcgaactgcgccactacatacagcgattgttgtgtgcacgtatcagcggccttcactatgggccttatgtagcagttcggctgtgagcacgtcaccgagttccctaactatacgaagggggactgggaggtaagtgcgcagaacgtttcgccgacgctccgtgtgtggcgaaagcagttctggcagaacgacggccgatccaccgccaaggcgcgcctgctggagcaattggcgaaggcagaggcggcagaccggtgtgaagaagaggacgcggcggccgaagggggtggaggcgatgcccaggatcacctagaggtgtgaggccctccgccctttccttagatttttgtagtttttcttcttccttttgtgtttgccgagagaggcgaatgatgtaaattcggcgggctggccctaaccctccttattgtagccgaaaaaggccccttggatatttggaatgtttgactcaatcttagccactttttatggtcgatgcctttggcgtatatgattacgccactttcgcattatgtaatatttgctcttttttcgcccattcttactatccaattcgtcttttgccctttctgcattgtctaccagggtgtttgctgaaaattgtgcattcggcccccttctgggagttggcgaagcaaaaacgagaaatttgtggcgttgaaggatctgctaaatgtacgatgcccgtttcggcatgtttatcgcgagatggtgataaacggccacagctataaggtttttaaggttgctggctggctacgggcgcaccccgggcgaaccttagaagattatgatcttgttcattcaaaacgtttggaggatatggctagcttttggcaaaaccatcagaagactgatcggcaggaggcgatctcccagcgtcgttacagtctagtctgtgtttcgcccccttctcctcttagggtcgtgtatgatattagtagtgatgacgaacccagttcgtctgaccattccttagagagagagagagtgattgtgggggcgaagatgtaatttatctgtaagctgggctgtaaaaccattgctttttcttttacttgtaccatatttttctttcgaagttaacaaagatgtgttttatttccttttcgctatgcattgtcactttgcgtgctttcgttgggtcagaacgtgttggccctttgcgtatattagcgaaataggttttggcttttcagctttcggcttccgttttcgatccattttgttctacattgtaggaagcactcgtgcattccttttgatcgagtgtaacggtgttcggttagttgttccccgaaacaagctgttgcggtttcaacgttcggcgagcgatgcttcgaccgatttgtttcgcccccatggcctttttcgctgatcaggcgtttgccttggggtttttccacaaattatcaatcacacaaataaataagacgaaggtggaggacacagagattttattatggttcaggcctccatggtagataatagccctacatccagtttttcgtctttttacattttcctcttttttttctttttttccttttttcttctttgccgaaaggtttacatagtgtcgaagggcttacataacgatacatacatttttacaatttggcgatttgggtgccacccgttctagacatagaaaagcttgagagaggcagcgttccaggaatggtcgaactcttcgccttccagtgtcaccagtcgaaaggatcccatactggacttgtccttgatgaggtacggtccttcccacttcaattcaagcttgccaacagctatcgggttcgcctttggcaaaggagatgcagcgaagcaagggttggagcaccccggagcaatatagctggctcttcgcttctgcttcatcctccgggagccaaccgttcttgaggtattttacgaacggggttcaccagtcctttaggtcttcacacagctctgcctggtcgattgccatgatgtccaggatctctatgggcacacttggtgcgtacaggacctcaaaaaagatgtctggcgaatgcgggcctccacaagcagtagatttcgccagggcgtctgcttcttcattctggcctctaggtaagtgttcgaccgttatgccggcgaaacacttttccatagatcgaacagcctcaagatacctcttcatcccttcttcttctgcctcaaaggatttgtcaacatgacttgccaccaatttggagtcagttcagatgagcaagcaccgaacccccaaagctttcgccttttttaggcccaacagtatagcttcgtactctgccgtgttgttggttgtgtcgaactttagccttgcggtgtactgaatcgacacgccccctggcgaagtgagcactgccgcaacgcctgcccccttgtgtgaccatgagccgtcggagtacatcacccaaggttgttcgacaggctagggttcaagggcgaatgtcggtgtccattcggccacgaagtcagctaggacttgggacttgatggcagtgcgggcgacaaaatgcaagtcgaagggagataactccgctgcccacttgctgagccggccagtaatttccttgccccggagcacttcgcccaaaagatactgcgatggcaccgtgactttgtggccctgaaagtagtgttggagcttgcgcgaagccatcactagggcgtaagcaagcttttccatttcgatgtatcgtatcttcgccccttgcaaagtttcgaagacgaaatacactggtttctggcctgactctgtttcttgaacgagggctgcagtgaccgccactggcgaagctgctaggtaaagtagcaattcacttcccagtgctgggctgaccaaagcagatgtgctctgtagatattgcttcagctcgtcgaacgctgcttggcattcgggtgcccaggtaaattttcccgcgcccagagggtcttgaagaagggcaaacctctttcggctgcttttgagaggaatcgattgagtgccgcaattcggcctgcgagcttttgtacttcacgtacgctcgacggggggttcatttgctgaatggcatcgattttttttggggttcgcctcgataccccttttagaaacgagaaaacccaacaacttgccctcgcgaacgctaaccactcagggtggtcgatctcctggatcaccctagccttgcacagcatttgcacctcggctttcgctgcttcttggcgattagcggacatcttgcgcagcttttgtttccttggcttggcatccggcttgcccgccagatgatgcatgatgaggtctgtcgaaacacctcccacctcgtcggggccccaggcgaagatatcaatgtttttcttgagcacctctaggatgatctcagcttctcttacgcccatgtcaccccccagtgatacaagtcttgtgggataggcgtcgtcgacctgcaccttgatcaccctgccgtgaggggcgggcttcggcacgtgcttcacccggtcatgcggttcggcctcaacattgtgcactgctctgttgattacggccaaatcgccctttgatgtagccgaatgttgaagccccttgaccacgatcactccttcagggccaggcatcttgagcttgagataattgtggtcggagatggcttcgaacttgttcaaggttgcgcggccgaagattgcattatagttgtacgggatgtccacgacgtcgaacagtatttgctcttcgcccctgttttcacctgtgccgaaggctaccaccaagtgtgcttggcctagaacttgaactgcttctccgctaaaaccacgaagccgccggtgcttgggtgagggctaagataggcaaccccatcgtcgaccgaacttcctccgtcgactaggattcgctgaacttcgaagccagtacctcggccaagatagctctatcttgatgtgggaacagcactccttcggcatcttctggcccgaaagagatctgctggttcaaatatcgcggggcccctttgcctgccgaagtgatgttgtgcaccattcacagctgcatcttcttttgccgtcttgacagttgattcggcgggtcggcccttgtaatcacttggattactctgcactgcacatcttgccactgttcggctgggggtgcttgttcttgaataccttcgtgaggcgcttcgactgctgctccttgctgcggccttggatcttgcacgttgccacgctgcagaatgtttcggcattgctcggtggtgtgcgaagagcatccgtggaaggcgcagtaaaggtcttttctgaccttcttgcgaacgggctgttgatggctgcttgcttgctgggcgttgaactccttgcggagtgcttgaatttcttcaacagccatcacggccttgcctacacggtcgtttctgaatttcctccaagtcatgggagcttgacctggccttggcgattatccttggttcgctggctgtggctagcgaacagcgagaggagccgattcggcgacctgtgcttgtgcttgggcttgagcagcagcgacagaggccttatcatactcagcttggattgcttgccgtcgcttggtatcctcttcgccccttgcgtatccgtcaatgatgcgaagcaggtgctcgagtgtctgcggctccttattggcgatttttcttatgagttcgccctcaagcaacacagccgaagcggcgttgatgacgaacgcctcagttatgtcctaaacatggcatcgggcttgcgagaagcaacgtatgtactcccttatcgactctcccggcctctggcaaatgccgagtagatgttgctgcggctttggcttctcataggtgcctcaaaagttaaggacaaagacgtcgcacaattgctcccatgagtaaatgctgttagctagtaaattgaagtaccaagagcgtgcgatgccatctagagcgagatgtattacctttgccttggtattttcgtcaccatgagcggcttcgatcgtggactcgtagatggacaggaactcttttgggtccgtttcgcccgagtatcgcggaatgggtgggaacttgaattggggtggaattggacgaatcttgattcccccacttagcggcagccccgtttcgccccccgtctttctcacggcaccttgctgcggaggaccgtttggatatggcgtggcgaagtgcgatgtgatggcttgcacgtgcagttgggccatagtgttcggctgcccggccctaaatggtgacgcttggtgtgccgccatggatgggtcgaacgaaggctgggtccatgccatggcgatcttgttcggcgcctgattcgctccgaagcttggtgtcggtgcctgtggtcggatggttggtgcttgagtagcattgctgaagtcgaactacggtccttgactccatggcgaaggccctggaccaggaaggttcgatggtagccaactgggtgcaccttgacttgtgtttccctccagctggaccgaaggggttgcttctgaaatgttttagggttggttgagctactgaagaaaagcttggagctgcgcctgcaaggccgaagccccttctgccattgcttgcgacatctgaccaagtggcggggggcgtacttgggctcgaccagccgaacttgtggctgtacaagaagggtcgggtgtactgttgcgaccgaacgctgtccggcgcagtacgctggtgcttgcacagcttgtgacggaagggcttgaatcggcgcttgcaggtagaccttgggtgggatgtccgccgaatattggagaatggggaccgaggcgaccttggcttgccgggccgcttcgtacgcctgctgttgctcttgcatttgacgaagcatgtcctagagtcgcgccatgttctgacgcatggcccccatgtcggcttcagcttgcgcttcgaggttggtgttgacttgtgcggcggtaagcgcggtcgaagttgtagcctgctgcggcgaagcagcttggggcaccaccacttcacttgtcgaaaggatctccgccctggtctggagcgcccttgtcgttgcagccgcctttgccgtatcaacagtgttcggcgcctgccccgtcgaagcggcaggagccgaaggtggtggttgcggcgtaggggccgaagtcgatggagccacaccagcttcggcaccaagcaccgaaggctccgctccctcttcgactgccatctccactcctgcttcactctccttacaccttgcaaccttctcctctgcgaccttcttcggtggcattcgctctcagtggtttccctcagaggtccccacggtcgacgcctgccgcttgtcgaaatgacaaccgcatacgtcgaaagacgtggttactcaatagtggttggaaagcagtaaagtgtattaaattgagaatttttcttgggatccccctattagggtttaggttttacggggaatttatatggtttcccttatgaaagggacatttacatgggtatatagtgtaattgaggtacatgggcctctagtgggccgactggcaaacgctggcccagtggcccctgggcttgatcggctgagatggcctcttgggcctccttgaagttgaacttgttatggcaaagccatccgccttcgccatacattcttcgccatatagtcttcacccaagatgcctccaaccttgtgggataccagcacgatccttcgcccttcgccgtctttgcttgataatctccgccatggggacttcgccctgacagactcgacgtcttgggcttgagcccccactggttgcatggtttcggcaggtccagtcgaagggtttcatgacataccgccaacaaatatagtgattgctttggtgagttataaacactaaaatagatattaattgcttagacgtggtgtttaggtaattgttatccagtaattactgcgtatgccatagtatgtttgaggtgggtgtagaggtggtgacagccctcgagatcacttcagtcctccctgtccgggtacgaagtagagcgacatctaggaacagcgggttgccagtgcctgaagtattgcgttaggattaaaattaagctttccctagacactgtttctcactagtaaatcctctctatcctggcctatcaattgcttggtgtccttggatgaactggaggaagatctgaccacacacgttcccttggatttgatacccttggaatactccgtaggggaagtgctacatcagtatatccgtgcgcttgcggattttatctgtgatcgtaagaaataccaacaagcatttctggcgccgttgccggggaacggttgctgatcatttccgaacctggttcatccttgtatcctttttactttttattctaactctacccttgctatcctagagaagtattcctgtcaaactcttctcaaccatagagcaaactctttttgagttgtctgctcctcgggtcgaattctatgagccacctccttcatcggagcacatttatacaactggctatgaaattcgtcccgaactaattagtatggttagggaaaatcctttttctggctttgatctagaaaatccctaccatcatctgcgagactttgaacaagtctgctcgtgccttaagattcgtggcatgagataagaaactgtgtggtggaaattgttcccgttctctcttcaagagagagcaaagcaatggtacacctctaccgttggatgtgtaaacggtagttgggaaaagttgcgagatagattctgtcttgccttcttcccaattacttgtattaccgccctaccagtagaaattctcagttttaagcagatcaaaaacgaatcaattggtgcagcctggtccagattcactaatttagtacagtccgaaccaaccctgtccttacccgagtatgtgttactgcaacatttccatacgggtttggataaggagtccgcattctatctggacataaccgctggaggatcgttcatgcacaaaacgccgtcggaaggaagaataattttggatcgcattctagaaaatacttccgtcatgacgaaatccaatgaacccagccggaggcatccgtgtccaagatagaggaacctctaatgatcgagccactcgctgaaccatccacttctgctagctcgattgatgagaaggttccagagcagccgaccgtcgagaatgaagaaattcagactccggatcgtgccgcaattatgttcagggacggctttgacgaagactacggcaataccttgaactattttagcaagaggaaaccactcgttccttttcgacctcccaatcctatggaactcgagttcctacgacaaactgtctgggacttaacatccataatgagcgatgaatggctaagggaggcagagctttcatccgaactaattcagataaataccgctccccgaatcattctttgccatttggaagggaacgacatcggtattctctacagtccaactgtcggggccaatctagtttctgagtcttttccattcgcgtatttaagcgataaggcagtgaccccaactgacaaattcttcaaacatccaaacggaaatatcattgaaggatttgggattgtacaagatatgcctgtctactttgaagactgggaggtgatcttggatttccacatctttgaaattcaagatttcgacatcctaatcgggctgcccattgtgcaacttctcattaacacacctcgattagaaatcctcaaaataacattgggagggaatgaattttcagttccattctcatgagcaaggatcgccttgaccgattccctcccagaaattgagtctgtggaggaggttattgcagttctccctcatgagtctctcgaggcccttctggaagatgaggtcctcgatttcatcaaagagtaagcggatcccggtgagactctcgacctgccaatcatggaaccgctacctcgacctccgcttaagcttaaacctctacctccaggcctacaatatgctttcctacacaatgacagagaagctcctgtcataatcagtgacaagctctatgaagacgagactcaatgtcttctcaccatgttgggaaagcacggttctgttcttggctactcgcttcaagacctcagggggattaatcccgcgcttagcacccatcgtattcttattgaccccgagagtactccttctagggaacctcaatgacggctcaataatgcaatgcgagaggttgtaaagaaagagttcttgaaactcctgcatgctgggattatctatcccgtaccatacagcgagtgggttagcccagtccaggttgtgcgaaagaagggaggaatgatggtcattgcaaatgctcaaaatgaactaatcctgcaacaaatcgtaaccggatggaggatgtgcatcgattacaggaaacttaacaaggctacaaaaaaggatcatttcccgctacccttcattgatgaaatgttggaacggctggcaaatcattcctttttctgtttccttgatgggtattctaggtatcatcaaattcctatccatccggaggaccaaagtaagactacgttcacatgtccgtatggcacctatgcataccgtaggatgtccttcggactgtgcaacactcctgcatctttccaaagatgtatgatgtctattttctcggacatgatcaaggacattatggaagtcttcatggaagattttttggtctatggaaagaccttcggtcattgtctacaaaatttagacaaagtcttacaacaatgccaagagaaggacctggtacttaattgggaaaagtgccatttcatggtccatgaagggatagttcttggccatcgagtgtccgaacgagaaatcgaagttgatcatgctaaaatcgatgttatagatcagcttcctcctcctgtgaacatcaaaggaatccgcagcttcttgggacatgccggcttttatagaaggttcatcaaggacttttctacaatcgccggacctctgaccaatttgctagccaaggatgcgccctttgagttcgatgacgcatgcctagaatcttttgaaattctcaaaaaggcacttgtctccactccaatcattcaacctcctgattggactctgcccttcgagatcatgtgtgatgcaagcaattttgctgttggtgcggtcttgggccaaaccaaggataaaaagcatcatgcaatctgctatgctaacaaaactctgactggagctcagttaaattatgcaactaccaaaaaagagctgctcgcggttgtttttgctatcgataagtttagatcttacttactgggagccaaggagataatctatactgatcatgttgctttgaagtacctactcactaagaaagatgctaaaccacgtctcttcagatggattttgttgctccaacaattttacttagaaattaaagataaaaagggagtagaaaattctgtagcagatcatttgtccaggctgcggatcactgacacgcaggaacaaccgataaacgacttcttgagagacgacatgctgatgacggttcgtgactccaacccgtggtatgccaacatagtaaactacatggtatccaagtacataccaccaggggaaaatcaacaaaaactaaagtatgaaagtcgccgtcatatatgggatgagccatacctatatcgggtctgctccgatggcttactacgaagatgtgtgccaactgatgaaggacttaagatcatagagtgatgccatgcctcaccctatggtagccattacggtgcattccgcacccaggccaagatttggcaaagtggtttcttctggccaacaatgtacgaagactcaaaagaattccccagaagatgcacaagctgctagaggcaaggaggaatcactgctcgcaatgcaatgcccctcacatacaatttgcaagtcgagatatccgatgtttggggtatagactttatgggaccctttcctaagtctcgcaactgcgagtacattctggtggcagttgactatgtctccaagtgggttgaggctatgccgtgcagcgccgcggatgcgaggcatgccaagaacatgttcatagaaatcatcttcccaagatttggtaccccagaatggtcataagtgacggaggttctcacttcattgacaaaaccttccgagacctcctacgagagatgggagccaaacacaatgtccttaccatccgcagaccagtggtcaagcagaaacatcgaacaaacatattaagaatattctacagaagacggtcaacaaaatgggaacaagatggaaggatagattgctggatgcactgtgggcataccggacaacatacaagacacccattggaatgtccccatatcagatagtctacgggaagtcatgtcgactacctgtggaacttgagcacagagcatactgtgccatcagaaactggaatatggactttgaaggagcaggagaatggagaaaaatgcaaattgctgaacttgaagaatggagagagaaggcctaccataacgcaaagatatacaaagaaaggacgaagcgctggcatgacaaaaggataaaaatcaagaaattcaaccaggagacaaagtgctaatgttcaactacagggttaagcttttcggtcacggaaaattgtgtagtaaatgggaacgaccgttcaacgtcatcgatacctctttgcacggggcaatcacactccgcgacaattcaggtaatatattcaaggtaaacagtcaacgcttaaagattttccttgagccaaatgaaactttagatgaagaagtggatgtcattgaattaattgattatgaactatgatgatttcatctaatgcatgcttaaaaccctgtatagttgtcatttttgtgcttagattaggttttaatgagcctagggaaaaattggcagctagctggacccactagggttcgtccgaacctgctggttcggctgaaccagggcggcgcccgatcagccccaattttgaacctcagtctcccccgctcatctatagtctgttgtgatgcgcattcgggggtagatcagtcgtatcagacccagaaccctgtccttcctcctctctcccacttttgcaaacctcctcttcttctcatctcaattccattgcttcatcaccctcaattcaccagtggctggcaaatctttgatcccattcatcggctcttcctccaactccacatacaaccttgacggagagccgacaccggtgaatcaattgatcctggtggagcattacacgatggaaggggtgaatgcactgtgggcacaaccccttgcaacagtgccaggctcccctgcgattctggagctgatcggcaagctccctggttcggccgaacccttctcggccccgttcggccccccgttcggtagtgcgatccctctcccctcgccatgtcacaaggacaaaaattcggggggattcgcttgcgcgacggccgacaacgggagaactcgtcttgttgaaggcgcgacgccttttccaaaatgatgagaaggccgctccacctcccgccgagcgctatgtaggcaccctgttcaccaaggcaggggatgaggtgttccataagtatgttacacccaccgctactccatccactccgaaggaggagcgtttccacattcaaggagtgcgaactcctggtggcgggtatggcaagggtttactccggccgttaacagcatcagagaaggagggggcagcggaatcccatagccctccacctatgaaggtgaagcataatttgacaccccctccaattgtgagggctcctggccaatatcaagaagatgaggtgaagtcgccggaaccctcgatccataagctcgccgcacaagtgaagaaactccgcaaggagaacatagagcttagggatcgcaacacggagctaggggtagagcttgctgaatttagaattaatttcaatagccttagtcgcggtttgtgcgctgagatcaagcgcgcattcgtagaaatgggaaaggaaaataagtattacgctaattagatgcttcctttccatgaataacatagtagtaggtgcttggttttatttttccaatcatttaagcacttgctacgaataatgtggctcattggtgttaaccccaatgtttgccaaaatttgttttgtttcatgtttaataaaatttaggttttgaataagtgtgggggagatatctcagcttcttacgtgcacataatctgaaaattacttaatgtctgaacacctggaaggcactgaactctgcagaaaattgcagaggtattgggcaccagagtggttcggccgaaccaccaggttcggccggaccagtgttggccgtagtacctcccagttttcacaagtaagcaggtgagcacgtcttttatctgtatatctccaccatgatatagtactagagctaaaaatttagaaaacaattggttcaagcatatgtgaaagataaaatttccaactaatgaaattcttcatgtgattaaacttgtatattcatcattctcagctgaacttgtgcttgtgaaccaccatccatgtttagcgaaccttatgcatctaagtaattgctttatgtgagatgattcaagatgaagggaatccttgcaactcttgttatgactcttgggaatttgttttcaaaaataaaatggtttaaaagctcaatcctccaattgacttcatcttatacctaccaaggtgtcacaccctgaaaattcaaaatatataaattgttgcttaattggaatttttagaaatgattttaaaaaaaccctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaatcctcttttggctttgggccgaaagtcggcccaaaacccttttctccctccccggcccaagtcggcccagaccgcagccgccgagcgcgcgcgttcggtcgctgacaggtggggcgcacctgtcggacccatcgtctacctccggccgccgccgcccgaaaccctagccgagccgcgccgccgtccccttcaaaatccggctgctcctttccttctccggtgaaatcttttgaggggaaacaatctccgggatctcctccaccttttctcttttggaatcatcggcttaatcgttttggaagttcgtcgattcgaggtcgaatcggatcggtctctttcctccgaaccccgaggtttccttcgcgtcgccggttgccgtgggccttcgccgccgcctcctagcccctttaaaaggatccccaagctcttctctacccgtcgccactctcgccttcgcctctcgtcgtccgtagcgccctagcgtcgtgtaagctagcgccgccgtcgtcgccgccgctccagccgtgcgccgccgtcactcctgttgtcgccgtcgctcggggaggtcgccttcgtggtcgccgtcgcatcgccgtcctcgtccgccccttcgccgtcgctgaagaccgccggagcaccgtcgccgtcgtcgagccgaaggtctccgccgtttcaacctcgtcgccgtcgccgtccgctgctcctccgccgttgctttggtcaccggtgagttcgccgcgtcgcccgcttcgtgctggtgtcctccgttcgcgccgcagcgccgtcgttcgccggcgagcatgcgcgcccgagccgcccgagccgccaccggtgatgacgtcaccgctgacgtcatcgggactgtccgccgtgagccggccgtggaccggttgatctcagccgtccgttttggatggatcaatctcggccgttcgtttccgtgtgccgccaccgtgcgcccggtccaccgcaaaccctagccgctgacgcaataaatcccttttttcttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctctttcctgcttagattctgacgtttccggagagtccgttttcgcaggagaagattttgaagagttctaaggccagcaaggcaagtcacacagatcccaaacaaccctttgagcatattgatcccgtttaaagctattgtttcttttcaactattgcatttattttcaaatgtcattgggtggaattaacctattgtttgttatagcccttttgttctggattactttattccttgatatcttgggttattataacttgactagttgagctctatatgttggttcaactagatgtattagatataattgcttagccctgcttagaaactttagcacactattgggataactttatgactcactattatttaatgatggcttattgatagttcacgatggtcagtcgtgattggttaattaattaatgtgccaactaaaacttgataatggtgggttgtgagcacatggttttgagagtcgtgctcatgacaattaaggaccggttcacgagtttcggttgtgaaacattaaccatgccaaccacaagccaacatgggcaacggctttatcttttgtatagcatggttcattgcggggcaccagactgagaagtggcagagataagcccacgggggtcactggggagtccatgccttgtttataagggggtgattatgatccaggaaaggtgcactgtagtggattgtgttgtgcaaggggtattgtcacaactcctttccgaggtaccgtggtggtattgaggcacatggtgacatgatgtggagttgtgtcttgtgggtacagtggtacacctctgatcagagtaaaactattcgaatagccgtgcccgcggttatgggcgggtctaacaatgtctttcgtgattagtctcacacttctcaccataataaatgatgctttaattgataataatttgattagctcctggtttggaatggtatattcctggtttggagatagatctgtacagccgggtatggttgttcagaatggttgggcctatacaacagggtatgttgtatagcgttggattaatattgtttaattattacttaacagtttcattaaattctgaaatgtttattaaatgctgtttatgcaaataaaaccctactatgccatcctttgttatcctgtgcacttgcatgtttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcgccgtttatcttattttccgctgcttagatctttattgattgagaggaactatatacctctgtaatgatattttattcgcttattaattagaataataattgtactctattatcaatttgttattgtgtgcctcggctgattcctggacgagggattcacacacatgtaagcgtttggaattttggatagaaattccgggcgtgacaagttggtgtcagagcccccttgaccctaggttatgccaaatggttacccatagaagccctctaaaaattattggaaaagtagaactgttctcctccccttctcttttaattaaaccaaactaatggcacatgcacttcataatctcttttaatggttctcattcaaaatctattccagtgttattagtactgtacatctattactgtactaatggctcattttaccagcaaaagttttacaatattgttttatttaatcttgatgcaaggaaataaatttagcatgttatttaatcttttggaacctgttgttcaaaagtacaaaatttgtaaccctgtttccaactgtttcaacttatcttgcaagcttggtttattttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgctcctttttatgctcagattcctcatgatcgtcatgaagagaagtgccgagtcaaagtcaccttgaacagtaatagtgaagatgtcccctcagtgatgttcgaagctagaggaagaaactacaccatgcatgtcaggaggtggcaaggatcgccataggagagctccgcgatcgctatagtgatcagttggccgacactgagtatcgctaccatcctcgccaaccccagggaagtgaccgtggcagctacctagagactgaaggaattgagaatgatgctaccacaaggcatttggttgagatgctgtgggctgtggatgaaacccgtgcggagactgtattagcagctcaagatcgtgaagaccggaatcgtggaaagatttgcaagctagaggacaaggtggatcgtttggagaaggaattagccgcattgaagggagaagcaccaccgcagaaggccaggattcgtcttaccgcaaggaagagagctctttttgtccctcgctaccaattggcgccaaaggtccgtgtggtggaaaaagaagttaccccagttctagtagatcctccggtcatcaacgtaagtgatgatgaaggagaagaatcgaagcacactcattccaagattgagtggagagcaactcaagatgatgaagacgagccgaacgagccttcaatcaactccgatgcccggaagaactagaatgccatgtcaagccgttgtcttagatcgttgtgttagcttgtttgtttaagtttggttgtgtgggtcttgcgtgtaatttacatcagtggtgggatgtaagtgcatgcgtttgtttgcttctgagtgttaggaagttggtgagtttagtggtgtgagagtcttcagttttgtaataatgaaactcacttaagatcaataaaagttaaagtaattctctgtcctaagtagttttccccggtttctcttcttgtgtcctgcccatgccagatggtgctcactcacagcaatgggaatggcccccaacaacaataacaacaacaacaacaatggagagaatcccacacttgcccaagtcctggctcaacagacacaacttatgaacatgatgatgcagcaactccagaaccagcagaaccaggggaataaccatgcacctccccagaacaagttagcagaatttcttcgtgtgaggccgcctattttctctagtaccactaatcctgttgaagctggtgattggctgcatgccatagagaagaagttggatttgcttcagtgcaccgatcaggagaaggtctcatttgcatcacaccagttgcatggccctgcctctgaatggtgggatcactttcgccttaacaggactattgctgaacctatcacttggcttgaattcaccgctgctttccggaagacgcatatagcatcgggagttgtgtctctcaagaagaaggaattcaggtcgctcactcaggggtctcgctctgttacggagtatctgcacgagttcaatcgtctggctcgttatgctccggaagatgtgcgcaatgatgaagagcgctaggagaagttcttggaaggacttaatgatgagctttcttactcactcatgactggggattatcttgatttccagaagttagtggataaggctattcgtcaggaggacaagtacaatcgcatggaacagaagaaacgccggattgctcaattcaagacacaacaggggaataatcaaagaccgcgtcttactttaggaccccaatccatgccacagggaggttcttcgtctgttgttcgtccgcagcgtcagttcttcaacaacaatgctggcaacaacatccgtaatcaagctccacgccctgttgcagcttcgacacagcaacaacctgccaagaaggagcaaggcagcaagcccgtggtgtgtttcaactgtggagacccaggacattacgctgacaagtgtccgaagccccgacgcgtgaaggttgtccctgcccagagcaactctaccgcaccagcgccaaaggcccgtgtcaatcatgttgctgctgcagaagctcaaggtgctccagatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattaaaggagtaccatttctggccaatcttatcctgttagaatccaaagaccttgatgtcatcctagggatggactggttagccagacataaaggtgtgatagactgtgccaatagaaaagtaactctcaccagcaatgatggtcgagttgtaactgttcatgcattgtcttctgagtttttaaggtcgagactgaaccaaataactttggaagagattcctatagtccgggagtatcccgatgtgttcccagatgatttacctggtatgccgcctaaaagggatatagagttcagaatagatttggtaccaggaacaactccgatccataagagaccttatagaatggcagccaatgagttggcagaagtcaagaggcaagtagacgatttgcttcagaaaggatacatcagaccgagttcatctccatggggagctccagttatttttgtggaaaagaaagatcatacccagaggatgtgtgtggactatcgtgcactaaatgatgtgactatcaagaataagtatccgttgcccagaattgatgatttgtttgatcagcttaaaggtgccaccgttttctccaagatagatcttcgatcaggatatcaccagttgagaatcaaagaggaagatatacctaagacagcttttaccactaggtatgggttgttcgaatgtactgttatgtcttttggactcaccaatgcccctgctttcttcatgaacttgatgaataaggtgtttatggaatacctagacaagttcgtggtggtctttattgatgatattcttatctactcccgaaccaaagaagagcatgaagaacatcttcgccttgcactagagaagctacgaggacatcaactgtatgctaagtttagcaagtgtgaattttggttgtctgaagtgaagtttcttggtcacgtcatctcagccggaggagttgccgttgatcccagtaatgtggaatccgtaaccaactggaaacaaccaaagacagtttcagagatccgcagtttcctaggcctcacaggttattatcggaggtttatagagaatttttccaagattgctaagcccatgacacggttgcttcagaaagatgtgaagtacaagtggtcagaagaatgtgagcagagttttcaagagttgaagaatcgcttgatatcagctcctattttgattttacctgatccaaagaagggtttctaagtgtactgcgatgcatccaaacttgggttaggttgtgttctgatgcaagatgggaaggtggttgcctatgcatctcgtcagttacgtccgcatgagaagaactaccctactcatgatcttgagttagctgcagtggttcatgcgttgaagatttggcgtcattatcttttcggtactcgtacagaggtatataccgatcacaagagtttaaagtatatctttactcagccggatctgaacatgagacaacggagatggttggaattaattaaggattatgacatgggaattcattatcatccgggaaaggctaatgttgtagcagacgctcttagtaggaaaggctattgcaaagctacggaaggatgacagttgccattggaattatgccaggaagttgaaagattgaatttgggaattgtccgaaggggtttcgttgcagccttagaagcgaagcccactctaattgatcaagttagagaagcccaaattaatgatcctgatattcaagaaatcaagaagaatatgagaggaggaaaagctattggtttcttggaagatgagcaaggaactgtatggttgggtgagagaatctgcgtccccgacaacaaagatttaaaagatgcaattctgaaagaagctcatgatactttatactccattcaccctggtagtaccaaaatgtaccaggatctcaaggaaagattttggtgggcaagta

SEQ ID NO: 477 - DNA, 567 bp, Oryza sativa
ggcgtgacacgaagatacacataatctccttcttcaaaactcaaatctctgcggcgattgtcggcataactcttatgacgagactgagccactcgcaatccttcttgaatgatctttaccttttcttctgcttcccttaggatatccatcccgaaaacctgacgttctcccgtttgatcccacaaaagcggagtgcggcacttccgaccatacagtgcttcgtaaggagccatctgaagactagcttgataactgttgttgtacaaaaattctgcataaggtagattcttatcccaacttccaccgaagtctaaagcacaagctcttaacatgtcttccaaaatctgattcaccctttcggtttgtccgtctgtctccggatgataagcagtactaaagttcagcttagaacccatctcttcctgaagcttcttccaaaaatttgaagtaaactgactgcctcgatcagacactattttcttagggacgccatgcaaacacacaatccttgccatatacaattccgctaactgacttccggaataggttgtctttactggaatgaaa

SEQ ID NO: 478 - DNA, 1967 bp, Oryza sativa
  unsure (1)..(1967): unsure at all n locations
ttataaaaatcccatgagtctgacagagaagcaagaaggactgaaatcgagatcattccatttatcaattactcaagatggtaagatagccactgataaagttcacaggtgcaggtatggttttgaatgatttatatgcttgatttatatcttgaagaaattcattctacactaacctttactcagggacgagcaaagggctaagtgtgggggtttttcttggcggctgttaaatgttgattctataccgccaacatctgcataaaattcagataataaaacattcaacatagtgataggtgcttaatctcacatattctacaagtgttggtgtatatttgtatgaagatgataaaccctaagttggaaggaaaatcggactaaagtgaggagaattatgtatccatacaaaggagaggttgtgaacttcatcgaaacatcagtaaatcaacccaaaaattcgagaaagagacagaggaaggtcctaggagtctaccgaccgaaggccaggccaggagggcccagcctaggttcggccgaaccctggtgatcaccgttgatcccaggttttggcatgggcggtcttgatcatctcgtgatggtggttgcggagcatttccgacaattcgcatagtacaaccgtaatacctacctctatataaaggcttcactctctcacttcacacacacacttccaagtttgagctgaattataagaggctctattgtactatattgtataatggaataggaagagagtagagtagaagaagtcgggagaattccagagttgtcggtaatcttctcctacttcttttattctgtttattactatgaattcaatgttatattcttcttgagtaattttgatttattttgtgagaattatctcttggttagttcctaagtagcatacggtattattgttcacaataatcaactaaaatgtttattactctgaattcaacgtaatattcttcttgagtaattttgatttattttgcgagaattatctcttggttagttcctaagtagcatacggtattattgttcacaataatcaactaaaatatagtgattgctttggtgagttataaacactaaagtagatattaattgcttagacgtggtgtttaggtaattattatccagtaattgttgcatatcccacagtacgtttgaggttggtgtagaggtggtaacagccctcgagatcacttaagtcctccctgtccgggtacgtagtagagcgacatctgggaacagcgggttgccagtgcctgaagtattgcgttaggattaaatataaactttccctagacactgtttctcactagtaaatcctctctatcctggcctatcatttgcttggtgaccttggatgaaccagaggaagatctgaccacacacattcccttggattcgataccctttgaattctccgtaggggaagtgctacatcggtatatccgtgcttgcggattttatctgtgatcgtaagaaataccaacacttgctgagtattgtgaatactcatccttgctcaatttcacccttttttagatctgggtcaagaggaggacccttatgactactactatgatgacttcgataatttagaaaaccctcagagtttgttccttcctagtcaaactttattagacttccgctgtataatagtaaccctatgtataattagttagacaatcagctttgtaaatcccaagtattgtaaactttacctatgcaatgaagaaccagctgtattatatgtatgaattatttactaatccagggcttgatacattaatcatggtcggatccaagtcattagttttgggacccgacagaactggtatcagagcatatgtttgactataggatgaaccttaaggatttctaacaaagttaagtttgaatttattnnnnnnnnnnnnnnnnnnnnnnnnnnnnnnnnnnnnnnnnnn

SEQ ID NO: 479 - DNA, 737 bp, Oryza sativa
  unsure (1)..(737): unsure at all n locations
aggtgctcttgcggccggtgatcttctggctgcgccagacgcgncgacgcttgggcggcaagacctctccctgggcgatcttgagctgatgcagctgcgcctccaccgcgtctaagtccttcttgagctgcaggttctcctgacgcagctccaggatcttcagattgttctcgaccatcccacggcacaccatctgatggaagtcgatacgagccgcgtcgtacgcctccaccatgcgcgccaggtgtacgatggtagcgtcatcctccgagctagcatctcggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggaatctccacccgcggtgactgccagcgaagtccgctcgggagagccagcgaggatcactgcagtgacctcccaaccagcgtggggctctgcgtcgtcaccctcctgctccggaagcggcctggcctggtagtccactccatgtggataccccaggacaacgcacataccccgcagctccaagacgaagccagtcatgtccaaaccacgacgggtgacgctgccgaccatctacaaacaaaaccaaaaaggaaaacaacattttaaagatcagattttggcgataaatgaagcagcaagacagagagagactagacagttt

SEQ ID NO: 480 - DNA, 409 bp, Oryza sativa
ccctcgtgctcccatcggtcccgggccgtgcaaccacccgccgccgccgtttccgctactccggccgccgctagccgccgctaggcttgccggcgcaccgggccgtcgtcgccgtggggttcgcgtgcccgagatccaccccgtccacccctccttcgtagaggtccgtcgccggagagccgttcccgtcgtgcaacggtgagggttgccatgtccgccgccttcggccggaattcccgcctcctatggcccctctcttcctctctaatctctttcttttcgttctttaggtcgtcccggtcgccgtccgccgcgtgtcgacttccttcagtcgctcctcgtcgccggtcgccgccgtcccttaggtgaggactccctccccttttctttacttcccagattcaccgtg

SEQ ID NO: 481 - DNA, 30852 bp, Oryza sativa
  unsure (1)..(30852): unsure at all n locations
nnnnnnnnnnnnnnnnnnnnnnnnnnnnnnnnnnnnnnnnnnnnnnnnnntacagataattatgaaatatattctttaaaaatgacattggtaccatgtgtattttactccataactttccagttaaaactcaatctacagtcaagaaaaaaaattgtatgtgcagaccaggggcttgtttagagtgctctcataaaataaatgctttccgtttcacttaaaaaagagagcggagcatgttatagtattctcataaaatgaactatagagatcctactctataacttcacgcaaaacctagctagctttttagttaaatttaggggttggagtaataacaaacattgcccaagtttggatttcaatatttgtgaagcaactttcgtgttactaattttatacagcgatatatgtcatagcgatatgcatttgaaaatgatttgtctagacacgttttttccccctccgttctttacaagtgggaatagttacttcagagcatgttcttaaaaaacaaaaattaaaaattaagagcatgtataatagtagggatgatcgatactttgactttgttcatgtcatctatttattaactaaaatcacggcatggtcataatggtcataagtaggttaaaactcttataatcgcctagacaccttagcttagctcacgttccctattggtgtgtgaataattcaaaacttgatgaactttgctttaaaatgataggaagagccaacatcaaaggataaaaaaagcaacgtacctatcaacattgtggtaacttttttgacatcttcaaatatatgtccgtatatccgatatgacacaccaaaactttacacccttggatctaaacacaaccttaacttcaattcttcacgatgaacgttgtggtatcttttctgacacaacttcaaactctaaaggtaaaggattgattatgccacttttcacggtttgtatttgtactggaaatcaaaacaagcttttacctttttgtttcacacgacatatttgtgctcgttgaaaacatattaggacacttgcgttacctctcctggtgcaaataagtgaataacatacggaagaatgaggaaacgtagcggaataggtgtggtggactctaaaatgttcgtggaccctacatctcttggcccacatgtaagagaaacaggttctccttgatcaaatctagattatggtggttctcgacattctgtaacagaagtagacccggtccaacagcattggtaaaatttagaaagaacagagaaactcccggtacaaattcaagaaaagcttatcaagttaaagatacctcaactcacgcattctaaccgaagcaagtacataaatctcgtcagaaatcaatcgcttcatctgcgcgaactacttttggactgtagctttcttgcttaagaggccttctaagttgaggttattgatcttcgcagcaaggatgaaatcattgtcagttaaacctcctgcaaccatagcagtggaatcacatcattataaactagagtgatggactgatggtgatttctgttctgttactgtgcttatgttgcttcagtacggcttcctaaatcctaacccaattctcaacaaccaaatactgtgattatgtgccttcagctacagttgctatgtctggtccctatttcttgacttatctccttttaagcatacaaatattttacatggaaaaggcaaatcaccaacagactaaacatccaaggctccaagcatgtaaccttttttccataatccatagaaattcggttaggtttcaactaatagagggcaagaatttctcaaataaacatctgaattttgatattgtccaaataaagagcataaattatgccattatggccatcttgtttttcttgcaaagtgaaaacttagtcaagtcaatcagagttcctaaaatagtgtattgactaatagccatcattcattaaggtttaggaaagagccattttgacctttcagtcctagagattgaaaaggttaaacaaagttaaacaggaacaacagtgatccctttatttcattcagcagcattggcttcaacattcactgctaaatgtaatgagtcaagtgttttcaggtttggaaggaactttgactaaagaacaaaccaaaatactgagagatatgaggtttgattcttttaaatgatcacatcaaaacaaattggcaaaacgaatgatatgcaaatcacttactgacagagtgagtccaaacatcaattttcacattgttccaaccgacaagatgaagatcagggtggtggcctgcgaaaggacatcaaacatacttcactggcactgttatttaaaacaaaaatgagatccaaaaaatgtgaacagtttagaagtgtttttcatgcaacatgtaaataaactcccagcatactaaatataattgtagcatgctatgacaacaaatgtaatgcataggtagaaaaatgtgagaaaactaataatttgattctgatcaccatgactacactatatcaaatgtaatgcaatctttctattcttcatcaatagccataacaattataagatattttcccaagttcaacaggagctagcttactagctctcctctctatcttatctcatccagacaataagcgtagaattacatgcagccacgaagtactgcatatgaaatagtactagcttgcagtagctccacttggaacacttgctctgcatcatattgtttaacctttttatggtacgtttggtgtctcaaaagaggtatgtaaaactgtgaacctccaaatcaactagtactgtaagagaagttagctaatcattgctgacttaatttaactaaggaaacatgtggtggaaatagaccatatagattatgccagtatgtataaaaagaaacaaaagaacaggaaaccttcttcctcagcaacagcagcaacaagctgaaggaattcaagcccttttacaaaattcttcaccttccatgctctgtgcaatttcagaatgtcaccttcggttgctaattcccaaccacccacctgttttcaagagtcagttgatgaagtgccaataaccttaatcagactcttgactacaaaatcatacaagaataaaacctgttctagcatcttcttagcagaatcttctggcatggcatgtatatccttagaattgcatggaacacaaatcttctttgccagctctgaaataataggagaagcagatctgtgagattatacagtaaatgacagtatggattaacaaggcaagagaaagtcaagaacagaagaatggggatcgatattgctactggagaaccacaatatggtgatgggagtatcacagctcctgtactgcatgctatcaagacatcactattccctcaaataagatgataagaatagtattctgaatatcattcaaaaagctagaggagcaaaccaggggttcctgaatcctgactagtgactacatggttaagatatcctttatttggttattcctagttctttttatccttcttacttaggtggattgctttctttctacctgttgctgtccatttcttttacattataaaaaaaatcaaataagaacaacatgttcatatatttgaatacccagctaaaattttaaaagattggctcatgccattgcacccgtagcaaagttttgcaaaatatcaacagaaaggtcgaatgtaaagtattactgcaaacgcataaattctggagaatagaatcgacatcacgttttccattcaccaaatctgccggtgtccgtttaaatgagagaagttttttcctcctggccttctttcaccccaactacgggtatgggcagacgattcatacgattgcagcaagatggtgttgacagagcacccacggccacggcatcaagcaagacattagagcgccgccgatgacaactcaagcaggaggggaggagaaggacaccatggacacatggccgcggtctggtgcgcgacgacgacccgtacgcatggtgcgacgggaagagattagaggacgggggggaggggggggggaacaattaaaggcggtcgaaagatgacctggatcgccgatcgcagccgtagacgacgacatcccgacgacggcgcggctcagacgatctttctctgcctggtgcggtgccaccgctcgagggctcgggctcgactcctccgccgcggcgcaactcacagcgccgttgtccgccggttccgcctacctcgtcaagctcctcggctgcgtgatgccagagacaggaatgggcgaatggctagtgtagattgtagaagagtttgtgctttgtagatggaatgagtgaatgacaggtagtacagagtttaacaagaaaaggcaaagaagaagaacagagtgagaatgaaatgtaacggatacgcaatcttccaaaaatgccctacttttgtgataatagtatgtttccatttatgcacgttagctgcattactactccatgcctcaaacatgtaatagtttccatttaaaaaacaaccagttgagatgaaactctaggtgtgaattgtacgtgggtgcactaatacatggacagatgaaccggatgagttcaaatgaatatcctcaaacatttctaagaaactttcaggaggctggtgtcttacaagactaccttgattgtcaggagaaccatggcaccatcttctacttgacattttaatctcgtcttgacttgcatacatcggatgatgagaactgcatcatagacaatggtatttctccactcagttatccatgagaccatcagctaaagctcactatagcataaaggccataagcccatacaagacgtcatacgatctcatttatcaacggaacttgtatcgaacccagaatttgagtgttttttggtcattagccatgatttaaatggagttctacactgtgtcctctatgactgttcccaacaggaaacttgcccggacaaaaggtttgcaagttccaattataaaaatgaacaaaggaatcgtcttcctattaaatgcatatgcttgcatatacttgtaccaaaatgccacgaaaatttatcagaagcttcctttcagaaaaaaaaaaactgtttccaaaagcatatcaaccatgttgtaatgcttccaaaccaaaattaaaagtgcatgaccgctacagcaacaatagaattcgccgtacacctaacaggctagagaactcttatttttcatgttaaacaacagtacttgatccttacttccgtgcatctttcaagttttttatggtgttctcatatacatccttattggtagtatatattaggcaaagatgtgcagaaatactctgattctgaaactacaacactaagtgatctgaaacatatgctaaaatcgaaccacatagcatattaatctgtcatgcaacagataattagtgatcatctgtgcccaaaggatctgcaattaacgatataattacagattaacatgcataaccacctctcccacccctttcaaaaacaacagcacgtacaacaatccagaccccgacaaacccacccacggtataaaatttcgagcacgattcaagaaagaggttactcgtaccgtccatggcccagcagcggaaggttcttggatacggtaggccaactgggggccgccatcgcctgcacaggcaacagaaaagaggcgggttagtggcgcacgggaggtgttcgacggtatgcttacacggcgttggtggggggctgggcggtgagttcttcgtccccgcgtttggcatacgtagtagcgcgccaggaggagcctcgcgtgcgccatagcgacgccgcgggtcatcggcgacggtgggacggcggcggcgctcgccgtgggcttgcgacgcggttgggggaagaagagcggaggcggcgggaaggcggcgtgtgggtttgcctggcgtgtggtagcgcgtgtacccgctgtttacaaatagtactactagtagccttcgaggcttcgacgggtcactgacaggtggtcccaaaattgtcctgaagttattttctctaacagattatttttgacaacttctacacgctcgtgtatttgcattttgatatttttgactcagcttattagctacttcatctgtcttatattgtaagatattttaatttttttctaagtcaaaattttttaagtttgatcaaatttatagaaaagtatagtaatattttttaacacaagacaaacattctatgaaaatatattcaatgttggatttaataaaattaattagttttttaagtattgctatatattttttataaatttgatcaaatataaagaagtttgacttataaaaaaataaaaaaagttaaagcgtcctataatataaaacgaaagaagtagcttatataaaaaaggaaaaaatccaaatgctcccctaaactgtagagtctgtctagcaccttaaactttaaaatcggacatccagccccctaaactttgtaaaaccgttcatattaccctctaaggtggttttgtatggtggtttttatctaatttgtatataaatttaatgagtttgatcacgtgacatacacattgaacatatatattaaaatctttagttaaatttttatttgtactactttttagctctcacttacggacaactatcgacataataatagtatggtatcattgtataaatataaattgatgatttacaactgtttatatgcaaatatgttatataagttatttaatgttgttcgtttaagcatccaaaatatgcaaaaccaccttaggaggtaatatgaacaattttccaaagttcagggggttaaatgtttggttttaaagttcaaggtgctagatggacttttatccaaagtttacggggggtatttagactttttcctataaaaaatcgatacgcttggtcatcgcccattattacccttggtgatacacaggctaaaatgggagtgacacttaatcgtttcatgttgatatgataatattttagaactatttacttcctccgtttcatattataagactttctagcattgcccatattcatatatatgctaataaatctagacatatatgtgtgcctagaatcattaacatctatatgaatgtgggcaatgctagaaagtcttataacctgaagtggaggtagtatttatttattcaatcaggttggcttttaatatgtatctatcaaaatatcgtgctagtaatgtgaatatagccaacgaactttcaactctggaataaaaaaatagcattattcactttggcttttatatgtaaggaagtttaccgcccatcaaatctactcttgactccttgtttgtttatatttaggtcccttattggctcaaactttgtgggggtttgacacttttaagttgaatacataaatcaattcaacccaaaaatttaaaccaataaaaaaagcagggcaattcgcttacacttacattaaggcacgtgttcttaccccatgtttcccaactcattcccatcgttttctgtgtgcacatttttcaaactgctaaacaatgtgttttttacaaaaaaaaaaagtttctatacgaaagttgcttaaaaaatcttattgatctattttttaaaaaataattatctaatacttaattaatcacgtgctaatggactgttccgttttccgtgcgcgctgttctggttgggaacaggctcgtgcgaacacatcctaagtttctaatgaacattacccgcatactcaattttcctgctcaatatccacatcaatttaatgctttgtctacgctctaagctaatactacctccgtcctaaaatgtagctacctagtatagaatgtgatattacctagtactacgaatcgagacagcctagtacattccaaattagtagtaataggtaatgtcacatcctgtactaggtagctatattttgggacggaggaagtagtgattataacacaaagctattgaaacatttgataggagaaatgcctaccagagttgaaagtaacacatgaacaagtactaaccaactagccttgcgagttgtagttcttagcttgcctagaactttgtgtgatcatagcaacacgccaacaaccattcctgactctgagctcacatggtaggcaacatatcctatgcacacaagccctcacgtgtacacacgtgcacaccaactaaaaaatgtcaccaaaaaatctagaaaaaatcatacatatactttcaattgtattacacctagggttaaaatcttaacgtcaaattcattatattttagccgtaacaaaaaaaaacaaaaaatctaacagttttaaggttacaattttgtcataattttatcttttttgttattctctatgtagaatgaatttgaagatgcgattttgcacgtagatgtaatactattgaaagtacatgtataaatttttctagaattttttgtgataatttttagttggtgtacacggtgtgtacacgtgagggcctgtgtgcataggatacgctccccacatggtaatgtcacactattttccttgtggaaacaccaagcgacgaagatgaccacaaggcgtgaccatttttttctaaaaagaagcctgaaaatgtggatgtagctcactgcattttttcttcgtttcgtcttgatattccgattagatcaggatttcacgtaatcacagttattttcttcgcaacaacaagaatgatgatggcatgacgaaaatgctagcggagttttgtaccttttctaccatgaattgagcatttctccaccccatttttatgtcatgccttgcgacctgtaggaaccgtatggcacacacgagcaaaagacttttaaaaaatccatctactccttttgtcattattgtcctctaatttcgttttgcactcgctttccaccgctacgctaccgcaaaagtaaaccaagccaaactgatcaagcccaggcatgcaatccggcgtgacatttttccaggtgcattctcgcgtgagcttagcaaagaaatatctcgtggcacctgtcacccctccgctgccgatccgacggctcgtacgacgccgttggtaggatcggacggcaaggggtggctccagagtccgctgcttccgctataaattggccccaagtgggggctccacgctacagagcagcagtctcgtctggagaagtggactagtggagtgtcgtgagttcttcgcttttgcttggctaaaatcgccgttagaaacttgtggaatcgagcaggtttaagaatttttctagtatccactctagatttgctttgttgtatgcttgaatcaaatttttttcgcttgatgatcaatttgagccaaaaacatgccgtttttctggtgattttttttctagcaactgctttgaaatttgtttcctgtttttttttctcaccaaagcaaatttgtaccaaatctcaccgaaattggcgatttagttgggcagttgatgccattgtttgtcgtcgaactatgcaatcccgatcgatttcgtgttcgtcgtctcgcctcctcgtgatccttctctccaccatgtgcagctcgccgcgcagccatgggtacgcgacgcgtagggctcctcctcctcctcctcctcgccgccgtactgctccagcccctcctcgcggcggcggcggcggagggcgtggtccgcatcgcgctgaagaagcggcaggtcgacgagaccggccgcgtcgggggccacctcgccggggaggatgcccagcggctcctcgcgcggcgccacggcttcctcaccaacgacgccgccagggccgcctcgaggaaggcgagggctgaggccgagggcgacatcgtggcgctgaagaactacctcaacgcgcagtactacggcgagatcgccatcggcacgccgccgcagatgttcaccgtcatcttcgacaccgggagctccaacctctgggtgccttcctccaagtgccacctctcggtgcgcgccgttctctttggttgccgcggttcaggggttttgttagtggtttggtagtgtttgtggtgctaattggagtgtccctttctgatgtttgctgcagattgcttgctacttccactcgaggtacaaggctggtcagtcgagcacgtataagaagaatggtttgtgctttctaccaatatcttctcagacttataatgttgtgttgcagtgtgatttagtagcaatcagtgttatctctccagttatattgataatctgatcgatcaatactctgttggtggcttggtgcctttcgcctgttcttatatagtagttctgttggctccaagtgagtaactgaattggcatgactaatttaaaatttcaggttgataaagtgcattaacatgaaaacttatttgaagcatatatcaaactagatgttttctgcaatttattaaattacgctgtttcttgtgcaattaatactctctccaaccacaaataggtagcaatttttgcatcaacatgtttgatcttactgctcatatacagtagaaaaaatatcaaatcactagtcagatttatgtgtttatgcccaaatggtacttagtgttggttggatgtttattaaatatgataaaagtatgatactgtgaaattatttttcaagataagtttatgcaacccatttttgtatgttggtatgtccaatataatgaatagagatatcgatagctgaagttatagtggttaattacacatgtcccaaaaacatcatatatttttatttaacttatttttttggagaacatgcaaaagggttgcatgtccttccattagatagagagagttccccaaagcgtgtttggttacagacctggctatataaaccctgggttacagatcataggtttatatcttgcgaaaaggttctaaacttcgatggcccttcatatcaccacggtttcggctcttgtatttttaacaagagggagtaatactgtaataagtttctgcagctatgtaattgtgattagttgataatttttggtttgatggatttatagtcatcttagattgtgacgttgacaccatcctgatatttattctgtggactctacagttacccgatctattctcagataggccattatttgtaccatgatgtcaattctgtgaatccaaaaaccaaaactggagaaattatgtagtgtgaaattgccactatgatacttccagctttttttccactatgttctagcaaaaacaagaacccataacctgtatttacatctttggcaagcaatcaactgagtagcaacatagacgtcatgattataagatgttattcattatgtgcgttaaatctgtatctgttctgatgtgtccttggatttaaactgcaacagggtgttaagttcatgaatataatttatcagttctccttggcaggaaaacctgcttcaattcattatggaacgggtgcaatttctggctattttagtcaggacagtgtgaaagttggtgatgtagctgtgaaaaatcaggtttatcatcagctgtaacttgctttcatcttatattcttatgtgcatccaattcgagaatatcctgattttattgggtaacactgctaggattttattgaagctacgcgggagccaagtattacattcatggttgcaaagttcgatggcattcttgggcttggatttaaggaaatctcggtaggaaatgcagtgcctatctggtgagcaagtcttgctagcatcttgaaaaaaataaatccattgcactcgtatggtaatagtagcatcaacaataaaaatgaacattttactctgtgtgtgacatgtataccttcattctgaacaattttttggaaggaaagagaaaactgagttttaagtgggaaccggcaaaccaacacctatacagatcaactatgttagactgacagactatcttactgtattatattgcaaaatgaagaccattttgtaccgggctacctgcatatttctctcatccttcgaatgtgaagcagatttcctgtcactgacattgcaaagcaaactcataggtacaacatggtgagacaaggtcttgttgttgatcctgttttctcattctggttcaaccggcatgctgatgaagggcagggaggcgaaattgtgtttggagggattgatcctaatcactacaagggaaatcatacatatgtccctgtcactaggaagggatactggcaggttgatctcattttgaagttggttgggtatgttttaaatttcaatattgatagcaatggtctgtgctgataaaattatcatttactttctgaagttcaatatgggcgatgtcctaattggagggaattccacaggtgctcaattatcaattttttttcatgctcactatacctttatttaaatgcaaaatggtctaatctttttctttttgaaaggaacatagtctaaatcattttggttgttccctatgtgtcattaggattctgtgcagctgggtgtgcagcaatagcagattctggaacttcactgcttactggtcccacggtatggtgtgaactcttctttttttataaaaaaaatgtccataagcaaggaaaagtggtctggattgcatctgatactggggttcctaacattggtttattgcctgaatctggatttcaatcgtgtgtgaaattcacatctgtaaatatttcttaacaatcatttaaaccactgtgcttttaacttaagttctacggcttctaccattagcacaaaatgttgcattttttgagtacaccgagtcattgaacatttttatagttctgtcagaaaagtttcgtttagattaaacatagagcatagatgcatgattttataattttgcaggtttccttttgatcaattaaggtaatcctacaattaaatgacaagcaccaaaccaactgaatggtattctacccttaaatggcacaaacaaatattccttgggccttgcttggcagggcccaaatcccagctcattcccagggacggtcaggaaagtcttaaagaatcactaacttcccaaaaggctgtataatttgttcccaatgtgtacattgcctattgaattagatagataaccatttaaagaacatcgcgtgtattatctagtgtcagaactttcttctgtggtgggtacattccttcttttaaaattagactttgtcttgatgaatcaatttggaactatgcaggccataattactcagataaatgaaaagattggtgctactggggtagtcagtcaagagtgcaaggcagttgtttctcaatatggtcaacagatcctagatcagctgcgagcagaggtttgcagttttctacattccaaaagcatgacgacatgaagttctcaaattcgtcactggtaactgaactttctctgggtttgtgatgcagacaaaaccagcgaaagtatgctcttcggtcggtttatgtacttttgatggtactcatggtgttaggtaagatttgtggatttgctgttttttagatattgggaactgtccagcctctacagttgtgggtttactgtggatggataattgaatgcgtagcattttactttgcaaattcctaatggtgtttacttgaatgcgagtgctgctattgtttgtgcttactaaatgtactagattattataagggatgaattgcattaaagtactgttgatttcattattcttgataactggagttgttacttatgatgactagttgtgctatgtaatggcagtgctggtattcggagtgtggtgcatgatgaagttggaaaatcaagtggtccctttagcagtgcgatgtgcaatgcttgtgagacagctgttgtatggatgcatacccaacttgcacaaaatcaaactcaggatctcgtattgcagtacattgatcaggtttgtttcctagcttgtaagagcaacgctgcagtgcattattatacaaactgtgtgtaacttttccaaccttcacagctatgtgaccgtcttcctagtcctatgggagaatcatctgttgactgcagcagccttgcatccatgcctgacattgccttcacaatcggtggcaacaagtttgttctcaaaccagaacaagtacgtttcttctctatgactcttatgctgtcttttcttgggaattgcatccatattagctcttaagctcaggaattgttgtttgcatattttaagattgagatgtttttgcttaggaactttaactcaagatgtgatttctccattatcatcttgagttaaagtgatgcagccatatattagggaagagccccgtaggatgtattcccccaaaaaaagaaccccgtaggatgtttatttttctattttagaatatactccctccatccaaaagtctcatacatatttcttttgtcatcgagaccaaggagaaattaactcctccaatctatactctgcatgcaagtaatggggttggagaatggttgcttgggctccgagatatatgtttgatccagtgatgctaaacaaagagtcactctgttcattcaagccttagatgcatggagactacaaatacaaagcatctcatttggaaaaacaaaaaatgaaatacataagagacatttggatggagggagtagtccaatactccaatacaatgcttattggcactccttttttctttttttcaaattgttgcatgacaatcaaaatttaaaataacaacgttgaaaaaaattacagctagatataagaaatgagaaaatcagcacgccagaaatggtggcaaaaatgcttgtggaacttcctatagcttgagccttgaggaagaggtagataatattgtgtgtaaatggttctcatgcattcaaaattcatatattctgttttatcttccctattcagtacatcctgaaggttggtgagggaactgctacccagtgcatcagtggattcacagctatggacattcctcctcctcgtggtcctctctggtaaattatccacctctcagagcgtttttgcatttttcaccatcaatgaccctttttgtgtagcatgtactgctcaaacagaacaattgcataagtaatcgtctgtcctgcttgtgtcttagatacttgtcatccaacaaaagaagtgtattcaacattttcagagttcagactgtatgttgaaatgctcgagttttcttcttttatgatactactacttaacaatcttcgttgtgcttcacattacttaaaacaaatccccatagactgatagacatgttgcccttcactgaccacgggagcttgctgttgcaggatcttgggagatgtctttatgggagcctaccataccgggtttgactatggcaacctgaaggttggcttcgcagaggcggcataatgccccccatggtgatcggacgagtcggagagcccttagcttttcagctcgggtttatctcccgcaagcgtgtaggtatatattttagtgcatgctcaataaatattgctactgtgatctcaaaacctgtctgttttaatttggctaagctaaatataagtaggcagaattcagacgacagtttatcacaggaaatactccatgagttagcaataacaaaacaaactgataacgaggaaaacctatcagtaatcggtttaaaaaaaaaaactaacagtaagaaacaattgattatgagatagtaactgctacaagtactagataaaaaatccttatgactgacagcaaaacatcattcatataggagtattatactagtgtgaagtacgtaagtaatttgtaatcactggctggcttcttccatagccaggtaccataaaacttcaccacagagtggctacttcgtggtccacataattaagaacacctaaaaacacacgtcctcccaaggcaccaagaaggatgacaaatactaatccttctctcccggatgaatcttaaatcatctcgaggagccatcaactcacactcacgtacctcccacacatgaagtaaaacacacaaatcaaaccaagcctttctttcttttactaccactttctgggcctaatcagcggtcaatctctatttcccgccgttgtgtcggcccttccccctcgccggctgggcctgcctggcccgcgcgaacgccttgctgaggaagcgcagccgccggctgttcgtggtgatgacgcccgtggtggacggcgtctcaccgaagacgacctcgtagccgtcgcggtacgagtccatgccgggcaccaggagctgccagaagaggccccccaccgtggcgccgcccctccgcgccgactcgtagatcttggcgtacaccgtgccgtagagcgcgtcccgctgcccgctgctgtagcccgggtccttccacgacttgccgaactctgcgatcagcagcggcttcctcagcaccgcctgcgcgtccgcgatgtgcgcgtccagccacctccccatgaaccccagctgcgcctggtcgtccttgcccgacaacctgcacgcgccacacatgcatttgtcggtttcatcacttagcatttagacagccatggccgtcgttgatcgatcgatccatcgaccggtgacgacgacgacgaagaggtcagtcatataccattggtcggggtaggagtggacggtggcgaagtcgatgccggggacctggttgttggcgatgaagtcggtgccgagctggtagccggaggggttgacggcggcgatgcgggacggcgaggaggcgccgtagaagccctcgaggccgacctccagcatgtggttgcggtcgatggacttgacgtgcgccgccatctcggtgatccacgactggacggtgcggccggacaggtcggactggcacctcggctcgttcatcagctcccacgccaggatggtcgggtcgtccctgtacgccacccccgtgatcgtgttcttcctcgtcaacaccgtcttcgcccatcatcatcagacaaaagcaaagttgatcgtcagaagcgtgccgtgagaatcaacagaatttctagagaattgtggcatctatatttcctgactgataaagtaacgtgatcatggagtgggcgcgacactattgagcactaataagggcattcccaacccaataactaggatggtgtccatagtattaaataagttgccacttagaaaaaaaaatgatgtgacaagtgaataaataaggaaagagaaggaaaccatattttgcatgagacatggtttctacacaacatccaaaacatcatgtgagataagtagtattaaattgaagtatgaaatagtggtgtttgtattggaaaagtggtgtctagtactagtttcttgatgatgttaagtttatagaaactatgtctagtgttatgggttgttatgggttggactgcactaaagcacttatccgatggggccctgtggtgtttgaccaactgtctgatgcagcagagcaacgatattgcagaggcatccgacagtgcaaagagaagaaaaaggtagtgctgccatgcgcaacgttctgatgacagagtcctgcctgttcttgaagaatttaccaccactagtgtgctttttggaaagttcagaccagtccaccgacagtcacagtattaaatcaacagtagtatctccgcctcaccgtcctatttcttagatttaaatttatcctaacatagttatcataatgaattactctctccgtttaaggttatactttagttaaagtcaaattgttttaagtttgaccaaatttataaaaaatagtaatattttttacccaagataaatttatttaaaaatatatttaattattaatttagtaaaactaatttagtaatgtaaatattactatacttgtctataaacttagttaaactcgaagcagtttgactttaaccaaagacaaaatatcttataatttgaaacggatggagtactaattatcttattgtcacttctgatttaaatttctctttattctaccctgaatcagcgtactgctcttatctatacaccatttaacgagagataccttatttagtaaatcttagtatactccatgttaaataacttggaatcataattattttgggattgaggtaatacttgacacatacacaaaagaaaattcaatactaatacacaaaagaaaagacggaggaagtaccactagtccactacaagccacagttgccgctctggagtgtgcataggaatgcgtcttcccaataaatttgcggcaagatactgtactagtagcggcgcatcacgctgcatttcaacgaacgctctatccgtgtttgccttaaattggtcattctacctttgctattctcagggacgaatatttcaccgcagcatttgcgggtatatcaaaacaatgagataaacgttcttcttggtgaaactaacctcgatagctttttcttcttaactatagtctatagatcataaaatggaaacaacacaaaaatgaaacaaaggaaccatcttttgaaatacgaaggaaacaaagaaccccatatatcctagaaagtagaaatagctatggtttacttcacgtactaaacggtagatattttctcggaatttattgccgctgttaccttcacgtggttcttgtagaagcccttaacaacagggttggtgaagaactcatcgtcggacccaatgccctgcccctgcgctcttgcccagttcacatactgcttcctcccgccaaaagagtcgtagttgtccacaaggctcagtatcaccttgatcccatacttcctagcctcagacagcacaaaatccaaaccctgcacagagaacaccaaggaaacggaaaattaacacgcgaaaaccacacatctcaaaccaaaaaccatcacccccaataaacaaaaccatcaccatcacatgaacacatgctctgttttcacagagagagagagggggtgggaggtagagatgcaatggaggcggccaagtagacttttttttctcacttatccatacttttagcttattttttcttctaaattttgtactaacatgcgaaaaataaactagcaagcggtttttacacgagtagcgggactacccacttgagagggacaatgtggctaagggaccgaccttgaaggtgttctcgttgtagttgccgggggacaactgcagcgcgttgccgccgccgccgtcgctgaacgcccacgtcctggcgacggtgaggccgtgcccggcggcctcgccgagcgcggcgctgaccttgcccctctgcgacgggtcggcggccagcaacatgagccagtaggcgttgaacccgttggcgtagtacgggttgccgtcgagcacgaaccgtgtcccctgcgccctcacgaagccgccccctcctcccaaggcctccgcctctcctaggccatggatgacgacgacgacgacgcacgcgagcaccagcagagcagcacgatgagctccgagaagcctcatcccttgctctctctctctctctctctctctctgcgtgtgcgtactgtgtctgcagggtggctctcttctttgctttggatggcaatggcgatgaggtgaagcgagatgaaagaatggaacttgcaaggaggtgaaggctgcgataaatagctgcaactcatggggcgccatgtcgttctcctagcttcaattctgcgcggcaatgcaaatagaagctgagtatcactgtggggtcagctaggctcacttgtcagtgggtcactagtgccagcttcgtgcacatagcaaccaccggatgtgaagggcatgtccttcaggctatagtttcataaaaaaaagaacagtttaaagtactttcataaactgaattagagagatagcgagtttcaaaacttcagactactccataattttattccataataaacttttaaagctaaatttaaatgttaaagcgttgttaaacaaacccgcacaatactgtactactccatggctagaacttagctttagctcagcgggtggtggaggagaggggtggcattaactttgtcggtaccagcgcgccatggaaggaagcaaaaggttcctttaatatttgagcatcccacatggggtggaagtgttggactgggactgggaccgatggtgatcagtgtacggtttctttggtagggtttaccaaatctatctcgagcccaatcagctagtaaatggagggcacgtttgtggtttcggttagaactgtgactctgtgagtactgttctagcgagtccaatgcaatgcagtatcctctgggtccttgttgtacgtagattattaattgattggtccacggtgtactgtttgttgccatctgttttcgttgcatgtaataattaaccgatttttgctatatatttacagatgaatttttgtactaaaaatttatcaaatataaatacaatatgattgtgatgcaattatattgtatcttgcatgtaactataaggtcaaccacaatgtgtgctaaaagtaaccttaagcaataaataactctacagtatatcaccttaagtattgtgaaagtggaccataagaatctgacatcaaaaatgagcattagccttatggtgtggcaacaagactatagaatacaatacttttgtgatgtactgttcacgctagtacttttgggaaattttcattgtgcaaagagtttcacaggaggataagaagtgatttttttatccttcggtgggacccattgggacccagcttattttctcccataggcacaaccattgtggatatgaacatagctaatgcttacttatagcgggtcccatatatatggttgatggaaccataagcattggccttgccctaataaatttgcatattactttcatataattttaaaccgttagatttattttaagattcacacatgtgggaaagaaaaaaaaaccacagcacacacgggtaagatgatttggtcctctacgaccttcactttgcggaaatagcatactatcgaatgattcttaaaagttttatataagttatactatacttatatgctggttacaatgtgattatactatatttatatctaatttaaagaaaattcataatatttttttagaagaaaattcataataatattttagaagaaaatacatcgataaatatatagcttgttcttaattaattttcatttggtttgagaatggctgattacatatgcacaggttttacattggtacaagttcagctatggattgcattggggtaggcttatgacctacgtacagctgatccatgccagtactggtaggtataccaactatgtcgagcggccggttaattagtcaatgcctacccaatcgcgtggttcagtttgccaataaactgatttgtcaaactcttccaagacttccactggttataacttactccagtaaagtatataaaacaaaagagatggaattttcgcctgtgatgcgacgatatgcgccccctctaatgatctactccttccccatgtagtaaacgcattattggctttgcttctccgtaagcttccattcatgtgaagggggtagtttgttgttgttccttgcctctcagggaagcatgtggattcccttgtctaaaacccgttgctgccaatgctcttaactgtagagcactggtagctaggggtggacaggtggcgtgtacttgcagacaaagcagagcgagtgaatccgagtatcccaccgggccggccggggcaccggccagccaccgtgcgcgcgcgcatgtggaggcacatggggcggggactgggactatacacgggaatccgcaagggggacgggcaaatgcaccggtggatcggatcgacgtgccggcctacctcgcacggtaccctaaccgtacgtgcgggtcgcggtcggcgaggcgaccgatcgctctcaccggcgtattattcatttccccgtgggccgtgccgcaccccccccccccccccccgcgcgacgtgcgccgctctacgcacgacgtaataatgcgcgctcaagctcacgtaggcgcgcgagcattaggctcacgactcacgagtagggtacatatgggtggtacggtgataattcacgactcagaatactatcttcttctctctttttttttttccaatcaaacgcctgctgaccgatcgagtgcggaattgcagataaacgggaatctccattgtcaagtatacgttgtcttcgacaccgacaaagtccggccgtttccggtcaccctcatcacagcctaacccatttgttttttttttttcgctaatccattgttagtggacgaaaacgacagacgagacgttaccgaggtaagttacgcccgtttggggccgggcaaggaggcacctacccacatggcgcgcccctgtacgcacccccaaattagtcctagtggagtacgtgcttgcgcgccgagtctgagcggtgggcggccgtgcagtgtgatcgatcgatcgatccgcgcccctcccctccaccgacacgccctcatctctctcacctccgcggtcagagtcccgtcttatcgcgggcgcgtgggcagcaagcaagcaagcaagcaagccatttgccgccggtacctcgctttcttctttttcacgtcgttcccttcccttttgcgcggcgcacgctgtcgcgcgcctgtttgcatctcgtcggcaccggctgatcactatcagagtcccctgttactggcattaattgatcacacactgatcagacgacgcccgtaacaaaggatggggaaaattaagaatccggtgatctgctctgcagtgatcggaccatgggcagaatgtaaaactttattaggccccagccagatcatggtgtcaaacctgatcattttagtagagtagcagtgcacctgattgcacggaacaagttcacttggcgcaagaaagcgcgtctccggcaccatctacggggttgactgcttttggggagcaaatcacgcctaccatcattatgtgcctactgtaggatttaaaatgcgcacaaagtagtccgcagtacagttctttctttgaagagaaaatccattgtatactctaaaattttagctaattctttctatacttataaattttacttactttcttgtataccttaaatttcgattttgatcactttcatacctctcccgtcagttgaccgttagctgaccgtctaatttatataaaaatgatcattctaccctttggatgaatatagaaatttttgaattacattattaaaaatataaaagcttctcgcatgagactattatagttatgagtttgttgtgcgatgcattatttatcttaaaaaataggtaataaaataaaaaatcatgtatttagtttttttttaaaaaagtcataaaaatgaggagcattcatacaaagataggactacaaattttcacaataatttttatgaatgctcccgataaaaaaaatccattgtcctattaaaatatcaaataaaaattttaattatttcatttgttttatttccaaaatttatgtcaaaatttcctacactagttttttttttagaattacacagtacaacgttgacactcacaatgcacgcgcacgcaaaccctacccctatgagcatcttcgaagactgggtcggcaaattctggagagattgacgaagtcaccacaggcgcctcgctgtcgacgggtacgtcgcctacgactgaaagcacaacgccgttaaatcctgaaaaattcgctcccatggggagtcgaacctaagacctcagtagcaggctacatgccctttcgctcctacactagttatttagtctcattcaaaattttcaatcgtctttgaatcgttttttcaatctgtgcacgcaaacaaaaatttcaatcgttttttaagcttatattcaaacctaaagcatcaagtgcaaaaaaaaaaaagacatttgcaaccaaatgtaatagtgaaatgatgaaaaatataacggtagggacatggaagtgatcaaattgaaattttagggggtataaaagggatcaggtaaatttcagggttacgaaagggattgagtaagttttcagggtacacaggaaatttactcttctttaaaaggcgcagatcactataaaacatcaaatgccaatattcaccctaaatgcaaaatcaccactggaagaaaacacaggaaaaataacagacgactgtttccgaacgccaagctgaagaatcaagcgcctgaaaaatgacagacggtagtaattgccatcgcccaaccggagtgcccaagcgcctgaaggaaaaatacgagccgacgttgcacggccgaaagcccgaaccagaattccatccagcccagaaacaggccgcctcgcaggccgcattcgctgatctggctgggaggacaagtttctcttttttttctctttgctaattggacccatatgccactgcaaatttgttggttcgaaaaaaataccacattcatgatattaggtatataccactgaaactttataaaatttaaactatgccactccgtcaccatttctgttagtacctctaccatctttaacaggaaacgagcaccgggcgataccgctgccaagcacaagatggcgacaacgaggaggtcgttggcgagggccaggtggtctaagggtccggcaacgatgaggcgcagctggtggtggcggtgacgagcacattattgggcgccacgagcaggcatcggtgaggtcgaggacggtgacacggtgagctcggagatagcgcttcccggctgccgcgagcgtcaagatcaagcgcatgtcgtcggggccggtggagaagctgatgccgccgccgagcacgactccctcctgtagctccatcctctgtgtcatctccttctccctcccttcccttttcttttcttggctgcgcgggcgtcaggatccagtgccggtcatcggcgctggcgccgacgtcgagcacgactccttcccgcagctccaccctccacgtcacctcctccttcccagcccgtggcggcggcggcgacacttgcactcccctccaacaccaccggtgacgcgatgtcaggcttgtcggatttggtggctgcggctgccgctcccttccagctccacctctcttcaccgggtgctaagctcgccaccattgttggatttacatcgccgccgcatgcctcctctgcctcgctcgccggagttgggcacaagtatcggcgttggtgtgggcaggaggagaagcccacgaattgccgcccctgcttctcaagcccacaagccgccgtcgacaagtcccctccgcgccactgtctacgagcccgagcgccgctgaagatttgtcgcttactactgtatgcgctggagctggagaagaaacggaggcaccaacggaaatgtaccatcaaatgcatgctcgggcggaaatcttgacgggaatggcacggttcaaattttacaaagtttaagtgacatgcacccaatatcatgaatagtaatggcatttttttcaaaccagcgaatttgcaatgcatggatccaattaacaaaaaaaaatctgtaagctgtttattcaaggaaaaaagatctggagctctcctagtaagcaaagataacccggagctctgatgtgttgcaattgttcgtgcatgccaaatagagcaactagtggcgcatttcttcaatttgattcgtcaccatgcgcgcggctaacttttcaccccgaaaacgattctgacctgcaggcagtatcgatcagccgaccttcaggcaggcatcaactagcatatatagccgggggtccagcttcaaaagcagcagtaggagtagcaatctaagcattccgcccatcactacgccaatcggccgccggtaaccactaggccgcaaaagctctcgctcctcaccttcgtccccgacgtggcttcttccaggtctctcagcaaatgtgtcgctgagctggtgaccacggcggccacactgcctcttgccgatctgatgcagtggcgactgctgcagctaagccgttttttttaaacgaagatgatcaaaaagtatccccggctagcttctgcatatctaagctgacgagccagcaacaggatatccacgaacttttaatttggtgccattcacggtcgacaggtacgtccgtcgtctgctagaaagaaaggggaaaagaaaagagagagaggctggaatctggtgccctgtggccttggaacaatgttcccggccggtccagtccacgctgccgctcgatcgatcaggcgatcacacgacacgccacacgattgctccaccaatcgatcgatctcctttcagtatcatcaatcagttggcacgctgcctggctggtttgctgcgtcgatccatgatccatcggtcatcggagagacaagatataccgcctccagatcaataatactgaataacgttaatttttaaaatcttttattataaataatttctaaaatatttatcttgaaaatatagagaatatatgtatatattagtcttaaaagtactccaatcaaattatatatttgttgataataataaaaaaatggtgatcaaaattactttttgagattgtgttcttgtctaaaatggtgatcaaaatggagtatcaatctggaaggagtactcggtaatgtcacggcttagctctgatattatgagatagatacgtagcagatagataggttagagtgggtatatatgagccgaagagaatccaaacatgaggatggtggcgccttttcggcgagggctggcggtaaatattctgaatcccggctgagagctgatggagagagcaggagaccaccttgattccaatccctgcgatgcaagttggtgcttggaatctgagcttctacttttgcggatttgggatcccggtggatgtggactgcatgtttaggtgcatatgcagtggctgtgtgcgtgctagtcaagacaccgaccaccagtgatgatgcttcaccaggatttagaagttcagagtctacgtacccggcaaaattgcggcacgggacggctaataattcttttttttttaagagagggtacagctaaggatgcataaggccattcacaatgcaagctatgggacccatatccttagccttaaaacttgacccaaagacactcatcccacaatgcaagcatccatagtcaggataccaagcccacagctggtggaccccacgaaaaagaatcgaggcattgaatactactttatcgcctccactttcctgaacacagccctcgcctcctctcctcgagtactactggcgctaccttgcctccttctcctccctcgccgcgacgccgacgggaagccacgcctctaccagcaccgccgccctactttatctcctctctctctctctctctctctctctgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaatagcacaaagatcattgcatcaattaaaataaaaagaaaacaaataaaatttcccctctttatctttgggccgctttcggcccaagatcttctccctctccatcctctcgggcccggccgccctccttttcccctcctcccttctctttgggccgtcggcccggcttgccccctccttcgcgcaagtccgtttcgcctccctcatcctccctcctctccccgagccgccgacaggtgggccccacctgtcggggtcacccccaacctccagcccgggccagcaaccgccatggccgcccgagccgtccaacgtcgccgccgtttccgcccacctcctccaccccgcgcgcgcgcgtttgtccgtgggacctcgccgcccacttccgcgccgtccccccccactctccccgcaaaatccggccacgtcgccgcctcccgcgtctctctctcccccacgacgccgccccacttcccctcgaaatccgccgctccccggccctctcctcgcccacttgagctataaaatcaatccccgtggactcctcttcctttttccccgttttcccgagtccccccgccctctaccgagctctccacgccgatccccttcgccgccgctcgccggcgatctccagccgcccgccaccgccgctcccgtcgctgccgcgctgcgccgccgccacctatagcatcacagcgcctcgccgcaccccggcatccactccatctccctcctccaccgccggaaccaccttcccatcgcgaggccgagccactaccgccacacaccgccttcagccggccgctgccgccgcgttagtcgtcgccgcacctcgccgcttgcgccgtcggcaacgccgtgccaagatctaccccggcctccgctccgtttccccattccaccaccgcaaccaccctttcaccgtgcatcccgagccaccttcaccatacgccgcctacagccgtgtgccaccgtcgccttagccgccgccgcgtcgctccgtcttcacctctcgcctcgcagcgccgtgccgcacctcggtcaccgttgttcatcgccggaaacccaccggaacgtggtatctctcggtcgccggtgagccccaccattcctctcctctccggcgtggtattctcgccgctccggtcgcctatttccctccctaaccactccaataatttccccaagtcttgccggccctcggccgcggctccgccatggtcgggcgtcgtcggaacgccgttcccgtcgcctcccgtgccggccgccgccatcctttccgccgccggtcgcctccccatggtcgtcccgtcgccggcgctcctcggtgaggaccccctccgtctcctctcccttttccctcttttcgccgcctcccgcgcgtgccgtcgcgccggtggtcgtcgccggcgaccatcgggccgtgcgccgtcgctcccggccggccgaccggtgagccggctccagctcgcccgtggccgcccgatcctccttcggggcgatctgggccgtccacgtggccttcccgtgccgcccgcgtcggtgcctctgtggcgccacgtcggcgccacctccgctagccgtccgtcgtggccgccacgtgtctgccacgtggtgcgcccgcggaccagcgcgtgcgtggactcggtccacggtgcgcccgccacccgtgagtcaccgacaggtggggcccgcttgccggcgccacctctcccccgtcggatgacgtcataattgatttaataattgcgcaataaatcgagtttaattatagaaatccattaaaatggctcaaaacttctaaaatccatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagaatccgtcgtttcggaagtccgcggtcgcgaggaaaagagttcggaagatcaaagtgaagaagcaaggcaagtcacacattccccttgagcatgttgatcctaatttacaaatgttttactgtttgcaaataaatatgcatattttgctaattacatggggtcagggtattacctatctgctcgcttgtgtcatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttctggattcaccgcggcacgaaaggggggctgcccgttgcctgctggagacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacctaatacactgtagtccaggtgggttggttgggcctgttcaacgtggtgtagcgttgatcagtggagatttaatgttactttaattactcaacagttttactgttttgctcaataaaatgttttacaaccgcctttatgcaaatagccccaaaccatccttgtatccccttgcacgtctgcatcgttggtgtggcttgctgagtacggtggttgtactcagccttgctattattcccccttttcaaaagtgtagtgcttctgagctgaagacgaagttagaggaccaaggctcagaccccagttgagttttgcctgt

SEQ ID NO: 482 - DNA, 11700 bp, Oryza sativa
acgctttatttacgtttggaactgatattacttgtcgttttgtgtaccctggctggtcctggacagggatttaatacacaaaatagtctggaaatttgggctaaatttctgggcgtgacacactctctctctctctggcgagcggcgcacggggcgcggtggcgagtgccgcgcgaggtggacgacggcgacgggcgcgcggggtggccaacgacaacgggcacgcagggtggccgacgtccacctcgcgccaaatcccatctccctccacctgtcgtcttcgccgtggggtcgtcgtctagactttctccgctctcggggtcgtcgtcgtcggccatggacgcgcgagatcctccgccgtcagccatggatccgccgccgtcgaccatggacgcgcctcctccaccgcgacgacctcgccgagggagagaccccatggagaacgtcgtcaccgacaactttgccgctccaccgccgcggcggctcaagaacggccgctcaacctcgccttggatttctgtgttcttgatttttcttgtgtgattttgtgtctcttgatttttcttttgtgattttgtgtgactcttgtgtgattcttcttgtaacgtcgccgctgcgatctgtgttcttgattttgcggacgagagtcggaggcaggaagaggagattttgctatggcgggagtggatctggagggcgtatcggggatcacgcttgggtttcgctggcgaggtcacgttgtgtctggggcacgcgctccacactgcgcgattccttgccgcgcgtgggtttgcaagagaaggaaccgcgtgcctcagcttgggggcgaggcgctctggttggacgcgagctctcgctccatgttcacacgaatccaacgtggaggggcgtagcaccggtccagctcaccgcactgtgaccggccgaatacactccacagtcaagcacaacatcccacacgcacgcgtgtgcgtccaacacatgtatctataggctttgaggacctaaagcctcctatgtgcgggaaacacatagtcccattgaacgcactcacgtgtgtgtaccctatacctaattaactaagattggactatgctaatccaagggaaaaggggttaaaaccccgtgcgacacccggtcgatcccaggatcgaacgtgggtggtaggctagccaccgttaggcagatttaccactgagccacaagctcatccgcgggaatgctaataattcgttaacgctggaagatcatatttccacaatatttgcaacatgatagaaaactatttatcctcattctttgttccgttaatatctcccaaaaaaatttaggtgctcaattaactactacttaaatgatctttacgaacagtcaaaacatatttttgcaaatagctgcgtgacccgcatacctcgaggtgtctgcgaaaatcggtattttcccaaacaggtggccataaaaccctagctcccatccgtcctagccatcatcattgtcactgcagtctgccattgttgccgaggccccgccacaagcccgcagtccgttgttgtcgccgaggcctcggtgctcccaaggccgaccccgccgtcatggagccacataatcgttgccccgtccccgctacgccatattaagctccttcaccaccgggcctcccaaccccttcgccgccagcgttggatccggccatcgagggctggatacgcccaccgcagggctacagacgctacctcaagaccgtgctgctcctccagtgtcgtcgtggcctctcccatcgctgccccttcagtgtcgttgtggttgcttccaccgccatcgtcatggccgctttcgtcgctcctggcgacaatcagtagagggaggagaggggagtagtgtggagtgaggagtggggtgagaaaaagtttttctaagagaggacataaaataaaagaagagactgggtagctggccaaacgtgtctcttaaccgtcgcttgtgaaattttgtttatttttgtaagcgggcatgttaagaggcccttatataaaatttgatttttgcatatgggtcttgtccttctcccggaccaacattatcacaggcgaacgccggcatggcccacctcaaggctggaggggggcttgtctacgaaaactgtttctatagttatgtttattcctctaaatcctctccagtcagattatttggaattaactgaacaaacccttagtaagcagcaaccacaataccaaccgcttattctgcttgttgtcttactgcaaccaaaatttgaattttaaaacttaaatttagagtttttttaatgtagtttatttttctagccttggctttcaaaccgctaatatataaatattttacccacaaatcttgtttaggaaaaaaacttttacctataaactattttttttcctcaattcagtttttactacagtttaccagccttatctcaacagatcgaaactaagaaacctgctgtttgctagctgaaaattgtttggcaaaaatgaatttcactaacaaggataaaggattcgagcaggaaaaggcattgcaaatatcgcagggaatcatgtatctttgggagaaggcgatgcgctttgtgcagattatattccaccagagatctcccgcaccggtggctcgaggtccccggcccctcatacaagcgaaggcacaactgcatgcgccacgccatcacgagaacaccaagttgcaccagtttcacgagacaatcagctggacacgaaggcctccacgtcgtcatctcattctcatctccctgtagagtagagaccatgctgcttttggagctttggagacggagtaaaatcttccatgggcgctggaaaatctctcgtaattccatgggcctcgcgtactgaacctaggagcgagatcatgcacaggatggacaggacacaggaccatggataaagaaaaagcatcacttcatggcaaaagctaaattcccccttcaaaggacatgggagttggagatggtgagatccattcgtttttttgttggatggtcccacgggtattttactagtctgaatttgtctttgtcaaagtgtaggttgcatttggggacggggaatcgccaacacatagtacatattaggtacacgtgtcttctacttggtcataaatacatgatgtttaggatagtattttattgaagttttgaaattttgatcatcaagaacttctcaatatcgttacaaaatttatgtgttttctatttggtactccatttcagttagatattatcaggaaggatatgaggatttgttccataaaagtccttttatttattcttgtagactcattgcccctatgtctgttgacagaggccatagatatgaacaatttctattattaaaaaaataaattcttaaatgtttagttaaataaatggtatgtgtatttttgaatactcataattgttaaatataaaattgatgactagagttttaaacattttagtcatacccttgaatgtcaaatatttatatccagtgggagtatatacacctacctattaaaatgtacatctctgcatttcttttgaaattggtgaaagttagagccaaaatctatggcttgaatctggtaggcagagtacacactcacactcaacagtcctaatcatctgaatccggtttcttccacaaataaccgatgcagatacacggcaattattctccacatgcttttgtagaatttgaagtaaacaacttgtattatacccttcgcaggagtacatgcaactcccatttggcttcccttatacgaaggacctctgttgtcccctccctacaatgtaaattctctttctcacgtgagtcagcaagatttcctttagtgttcattgctggacaataataatgcacagggcgccaatgctggcatcaacttctgtggtaacttacatagttacatgcaattgcacaatgttgctagtaattacagtatatcacttttaagttatctgttagaccttgaaccaagtgtgtccctcaaagcaatggtcctattgtcataaggcagcaccgaggggcaaaacatattttcagttttcaggaccagtacgtagacagaacctctcactgcaaggcaggctacaaatgcagagtaacagctaacaagaggacaaactgcacagccttgtagaacaagcactatgtggtctacaatttttatcctgagattcaaaggcccaaacgtacaatgagcagtaaggaccaaagaacaaaatccaattccatcttccgaggtcctgccagccaaccggagatacttattctttggtccagaaagggctccaaaccttgttcaacccatgctttggcacatattctaccaatctcgttggtgcagcccagatagattgaactcgaggaggccatggcaaaatttcctgtagattgtttccctgctactacatatttcaagactagctaagttgttttaagccttcatttacatcagtttttatttttgtaagtactcaattcatgtcatctgctcattgttctaaaaaaaatcatgtcatcttctccagcatatttagctgctatccacctgcatctgtgaaaaaaggttgccagcattaaataataaccttaaaaatagaattgcaaactgcattttctcaaatatccggcagtacacagcagcacagtagccgcgactgtgatgcctacactacaccaattaaatgcccacattgatatactgcatgaaaggtcaattacagatttcttcacaattatataacagtaaataccagaaatcatatgatagtaagaacttatgcatattaaaccactcatttagtaagaaggctgcttgtttaagtcctttaggacatacaggtcagtaactagaaatctaaaatgagtaacttaaattagcagtgcatctatgagataaaaactagtagaatgactaacaaagagaagtatttatgtaactctctcaccaccaatactagcacagtgtcctgatataggtgcatgaacctccgtccttgggaagcatatccccagaaacccagaatgagaaacatcatgcatgctgaacccagatgataattgcatgcatggcatttctagcaccacacaaaatatgattcatgatgcctagtggcgcacatgcatgcaggtccaacaaattgtctccctcctatgcaggaagagggtgcaggcatgaagcatctctattaacaccactagctttgcatatatccatgagttaaccagctgattttaccactctatcgcatagacatcttctgcagttatttgttggatgtccatcagtactataatgttagctagctatatgaaaattagagcatacatccaagcatccagctagttatcacccactaggccactactgcctactgggaaccctgtaacagtgtagctaatgggcaccaccatatataccttgtgacttcaaaagataaaataattgctggatttgtcatggtagatctgataccttaatatcgtgacactcccaatcttatcatcatgttctgtgtggttacaatgtaatgacattatatatcaacaataaacaaattttaacaaaacaaaaaggggcggtggagcttagttaaatgaaactaaacctcaggagaactacttcttttacaaggatataattttcagtcttttccaataactaattacgtattaggctaccactcaccaccagtctaccactacactcttatttatcacctattctaggttccgtaccctacagaatggttaacgtacgctgtgatcactcaacaattaatggaaggatctcaataatggtacatacagcatggtgcatttgacatttttattcgctaggcatgtatttttttagacggaagctaggcatatatttgagatattgacactgtgcaccatcagaatctacatttgaaagaaagcacttatatctcggaatcggcagagatacgatatatacccttcccttcttgtgggtcctcaacagagagcatcagaatctcactcgcctcccaatctgcaagccaaaaagtgtgtacactgttatattttccatatgagctacagctcactgctcacacaaccgcaccctcatgaacacgagtacagccggcgccccaatggcctataaatagctgccacccaagcagaacagatatcatatcaaaacagcagaaatctcttctgaagagaaaaaaacttcagtctagctgcacactagctagctagccagttcacttccaaagaaagacagtagtccaatccaaggatgtcttctaggtcaagcagctcctcccgcaacagcaacagtgtcaacatggactcagagtggagcaaaaaggagaacaagctgttcgaggaggctcttgcctactacggcgagggcgcgcctgacctctttcacaaggtgtctcgcgccatgggaggcaccaagacagccgatgaggtgcgccgccactatgagatcctcgaggacgacctcaagctgatagaggcaagaagagtcccgttccccaagtacaatacacagggagcatggaactgataggtaaccagctgggaaatattcaacctaattcaatcctctcgcgtctagtaataaacacgtgttgctaccttgctatgactcttcaaagctagtcatctcacgtgttctgataagttcagaatcggctgcttagcaaaacaatcttcagttgcaggctagcttgtaagctgatagctactgtcacatctcacacgaacacatatgcagggatcattagatgtcagccatgataatcatgccctagatgattgaacttgaacactgctagggtagtcagttgtcgtttcatttgcagttatacttttcagatgcagtgcaacatcagagtatctgcactgtactgtaacagataaatctggcaaaaccaagagctcataacttgagcctgtgacaagccatcatgcacacataatttgcatgcagtggtatgcacgatgcaccattttgtgattattggtttgcacataggctggtaggcacaggagttagccctaatttatgtactgatggtttgtcccctagttacaattattcacgtgggatctagcaccagaagaataatctctctgctaccaaacaaaagaaagtttgaatcttgcagtcttaccccttgagcagttgtgcttaattcagttccagactagcagccgacaggtgctttaaacatctctttttcatgtcagttcatctggcaaattaaaaggtgattgccttctttttaagaggcacaagtgtgatgtgtctataggaaaaggcaatttattcaaagttattctatgctctctcggaagggagcacaaccattgtaaccctagaagagggagctatgcatacaccattcttctcaaaatatattttatagatagataagtaatctctgagacccaataaaccacacctagaacgcctacatagaaagcaaattaagataaaacggcgtctgaatatctcctattcaaatgcaacattatggcgccctgaaatatatctattttttatcactgctaagataaactcacagttcatctttccaatttattttccaggggtggaagcatctgaggttccagacaacaggaaaaaaattccaatataaattatattccttgctagctgtggctaagttactgaaggaatcaaggaagtatattgatattgttattgcctaagaagattgtggtcgcttggttataaataaaagaagaaaagacttgtttgtacatactctaggttgtaaagcaaatcagtgtcgatcttgcagaaactagcctgcatttggcattgtgtgtggttgttaaacattccagctaaattatgtagtaaacatcagtgatgtaagacttctgtacttgtgtgctagtgattataaagttgtgcttgctagaatctcacttcctcattggaccaactggtttcagaattttgaatttgtgatgtctacatttgaactatgaatgcttcaatgtcccttccaagttccaaccaagatgtaaatgcaatgtagatatgacgttaatttgctcagtgctcacagagttctcacctcttgaagtagctagttatcaaccggagtataatgaaacattatgtattacactgccagctactctgaaagtggatcaagtatttgagctattatcaggaagaaagtagcatcttgctagcttcacacaggttgaaatgaagaaatacacaagtcattttcaagaatatgaaaaaaaaagcaaataaactaaaaggccagaagtatataccatttagacagttctacaccccaaaagataccatccgacctgtttaattgattttaagcctagtaatagccacagaccactgtaccaaaccttctgatcctggtacgacagtaaccaggaacagctagcgcctaggaataaaataaactagcatgcttaactgattttaagggtttttttttctatgaaacaaacattgatagtaccgatccatctacattcttgagatttgagacccagcaacacccaataggaatcgactcatatccgaaatatttcctcagaagtgtttggtaaaccattccgatcgtaaatcgtaatacataggatcagaattgcatcaaatctggccctaattatgatttcagtgttcaacttcaactgcggaactgtatggaagaagtaacacacaaagcatatagcaatcgccaaattaatttaccacacccttatctctctacacgcagtaatgaattaaaataacatgtagtaaatgcgagatgtagaatgcgaacccagtagccatagcactgacctagttttgccggttcgcggcgttgccctccgatcgcctctccgtgaggcggcgggaagcttgcccacgcgccccccgagtggccagccgccgccgccgccgccgcggctactcaccatcgcctcccctggttcaagcgcgacgaggccgcgggcgaccggcggtggcggtggcggtggcggtggcggtgcgccccttcacctgcggcggattcgcccttgccgggacgacttttgagccgcccaaccaccgagcgcccaaggcctgatgggcttatttctcccaacggcccatataccttcacgggccgtcctgcttcggtaggcccaaccgatagccttccgagcttggcccattgacacagtggcaacactgtgttttgtgggggatttcctttaactatttaccacaattaagaaacgtcgcaatgtatgacacagggagtcctcatatatttattgaatgcgcctacaaatcaggcgtccgatttttttttcaaaaatcggacgttgttttaccaagtagatcgaaaatatttcaatcttttaaaacgctgaaacacaaccaaatcacctcatgaaacattttgctataacgtatgaaacaacgatttttaaaaaatcagtcgttgtttcaccctatataaaaacaatgttttaacaaatagcgaaagaatgttttaattcttaaaaaaaagtgaaacatggtcagattgctagatgaaataatttgattcaacgtatgcaccctatgtacatcaacaaaccacgtgtctatcaagatgaaattattaaacagtagcaaaatccaccgcaacatttgatccatacatagcgaaacatcacgagtacactagctgaaacatcgttggtggaacaaataatgaaacggatccggtgtttctgttatatccgggcggctattgcaatgggcacacgtggtgagggcgcggaggcgtgacgcggcacggcacgggcgcccgacgcagaggattcacgatattcatggcatgtgagtccaataataaatacttaattatcacttgtaaaacattaggaatggtaaaaagttaaatatctcttcggcggctgttcgttgcaagcgcgcgcaatgtaaaaagcacgcgagcgagctgcgggagagccgaggacgtcggcggtcaatgtcgacgcagcggcggtcacacaggaagcagctggggcagggtcccccgccgggagagacgggctcaaaactgagatgatatggtgtgcggcgggggtgcagctggaccaccggatgggtcacgtcgccggccccgctaaactcggtgacggcgacaaaagctcctcaaaggatgccatgggccggggtgctagcttgccgacaacgtacgtaactctagccctgctcggctgcaaccgcaaactttttcatgtgcctcttgttgtgaagcaaagtgtagtgaactgataaaatgcaaaacaaatacgctcatttttcatctcaaaagaaaaaaaaaatatacacacaacttgcatggaacagcaatctgtgataggagtacatgcgccagctaggggcttgcactagacttcctagttaaggccactgagtacatgccctaacgaccgtctcgttgtagtgtctttgtgtgatgagcctccccggctttcgagagttaagagatccagcaacgaatggttcaaacctagagaaacgggacgaactcaggggtgcctatcgctttccaaaagatggcgatatagcctcaccatcctctctaatcaaagggcaaagagaggagtactatatgagtgaggccgagctagctaggcttcatgcatcccagatacagtagtgcatatcccaaacccaaccaaaggacaccaatctctaggcttaactctggccgtgtcgggagcaactttttgaacgacgatctcctcggccggattgcctgccccagccatcgcaccaaacacacaacacaacgctagtactcgcagccgtatactgtttggtgctcgtgctcctccccttgttttttctcccgtcttattttaacacttccgtcatgcggcgacagatcacacggagcacaaggcgtacaaacccctgccaagctgagcattaagctgctaattaaacaaacgtttattcagctgctaatccactgcacacacaccagatcaagggaatggtttagatactctgtgcagtgagcacgcaggcgagttttcgtctgctgcatatgtggagatttcgtggatataattacagtaatacagggaatggttgggctcgcaatagatagagacgagaaggaaacaggagccatgctttggttaaggtcgtgtcggcgctttggccgttgggcagcagcatacggaatgatgggctccacagcctttcgctttctctggcatcgctgcctcctttgacttggcagggggaattacgcagcttataaacatcaccaaaggaaaaggaatccagagaagaaaagaaaagaaaagaaaagcctctctggtgatctggctctctctccccctcagactcctcgtccgatgggcagtgacatgtaccaccaccaccactcgcaggagaaatgatcaggcatacagtcgcggcgcgccgtatcggatccccgtggcgttggccattgccattgccatcctgggttaagcgcgcgtggaggttggtgccaaaaggcgggatcttctatgcctgaccgcgactgttccttggaccgatgatcggattcgattcgacgggggactttatggaacttgggggagccatcatggcgagcccgattatcatcacgacgtcgcgccc

SEQ ID NO: 483 - DNA, 16495 bp, Oryza sativa
  unsure (1)..(16495): unsure at all n locations
cctccactcctaccactgttgagctaaaactttttagcccatgtcacatcaaatatttgacactaatttagagtattaaacatagactaataaaaaaattaatttcataaatgagagctaatcaacgataagatttttttaagcctaattaatccataattatcaaaagtttactgtagcatcacattgccaaaatcatgacgtaattagactcaaaagattcgtctcgtgaattagtccaagcttatggaataagttttgtaattagtgtatatttaatactcgaaattagtgtcaaatatccgatgtgacagggacttagaatatgtccctggaaaccaaacagccccctagtctcctcttctcctggcatccctttcccttttgattcttttgatttggtttccctcccttctcttttgttttatttttttcctcccttcttcttcgattcgtcgaccccggccctgcttctttcgctacggctcctttgccctttttcttcgtcttcgactccctttgcgtttggaagctcgcagcgcttcgatcggcttggcctactgctaatcatgtgcccaaacgtgctgcttgtggagatagcggtagcccagttgtaggctgcttttggaccgaggaatgagctcgctttttagggccgatctgatgagagtgagtacgtaacgtagcagcagtagtagcatcgtgctgtaacatctcgtggtgtgatccatccatatccatcgatcggtggatcggtccggatatactgcagtcaaagctggtgtggtctaagggtgcagcgacggcagcgtacgtacgttgcgtggtcgttgatcgatcgatcgatccgaatcacacagagtcacagctagctatagctcgatcgatcagacgatcacatggtacgtgtagtaaataaatggcattcgatccatcgcgtcgtcgcgagagagataaaaggggcacgatgcagtggatgcatgcagtgcagatgcagatgcagcgccaggctttcgggattcatcagagagctgcccaccgaacaacggacgcttgcgcatgcatgcaatgcatgccacgccatgcatcatatcctcgtcgtcgtggctgctttgccagcttgtttgcccccggtggtggtggtggccggcctggggatcccacaaagcccagcagagagggtaggaggattcagggacagatcgaactgtgcccctcgtgatcggcgaaacccaatggagactggacgagtacccagcagatgagccgcacaagctatagtttggcgctatgcaccagccagcccggcctccacgtccccatatgctgcgtcggagactgttcccggtttcacgtggcctctcttttgacccgtctttgaccacgccccagcaagccagccagccagccaagccgatcgatcgaccaacaggaaggcaaggcagacatgagacatcctcctcgcccccgcgcgcgcgtcgacgcgcatctgcctatctatcccctgcggcggacgggcgctgcatcgcgtctcgcgcccggccggaatccgaaatctagccgcgcgggccagggcggccacaggccacgtaaaaagccgccaccccaccgtacttcacgtcgtcgctataaaaaccccacacccgtaccccttcacccatcatccaccaccaaccgatccatccatccatccatctgccgcaaatctcctcgtcgtttcgccgaccagctctcgctgccgcccgcgtttgatcgagcaagtcgatcgttggttagcgcgtacgtacgtcttggtcatttgcagctgccacacctccgcgccatcactacaaactcgatcgatcgatcagagagtagtgcagcgcgcggttgggcatcatgctgcacgaggcggcgccctgcacgtgcgggctgctctacggcagctgcggcggcggctgctcgctgctgttcccggcgggggcgccgggggaccaccaccaccaccaccactacaagcagtactgcggcgccggcgacggggagtaccccgacgtgccgtacggcggcggcggctcggtggactgcacgctgtcgctcggcacgccgtcgaccaggcgcgccgaggccgcggtagcggggttgccgtgggatcagtcgtctttgcagcccagctgcaacgggcggcaggagatgagcggcgccgcggcgccgcgcacggagcccagcggtggcgcgggcgccgccgccgcgtcggctcctcgccgctgcgccaactgcgacacgacctccacgccgctctggcggaacggcccacgcggaccaaaggtactgtccattgcctacaaaagcacactgatcataacatacataattacacaaacacgtataagctaatgcaatgtgctcgcgtacacaagcagcatacacgcattctcctgcatgtgtgatcgattcgatgctaaacgtatgcgtgatctgcttttcagtcgctgtgcaacgcgtgtggcatccggtacaagaaagaggagaggcgcgccgccgcggcggccgtggcgccgacggcgctggcgtcggacggcggggtggagtacgcgtacgggtacccgcggcagcagcagcagtggggatgctatgggccggccgtggcaaaggcggcgtccttcggcatgttcggtgacgcggcgggcgaggacgggccgtgcctgccgtgggggctcggcgtcatgccctcgtcgccggcgttcggcgccgtccgggagatgccaagcctgttccagtactactagctaggctaccagcctcatcttactccctcttcactcactagatctcttttctcccctttttagtaacaacaagatgctgtacttctttttgagggcatgagatgctgtacttgaccaacgaccccagctgcatgaaagttgaagctgatatgtatggtcatcaagttttctatactaggctgcattttgtcatcagcgtccattgccatttgtaatgtctattatttgagtaaaatagatttttaaggcaaattagccaaacattaattatatatgcgggtgaagccaacctgctaaactatcatctctttgttgcacgacgattgcaaatagtagtagtatagtactgctgctactaaagtacagtggagccctgttctttttgtgcaagagcatatggtatgacgctgcattaccaggagtaacagtgcctgttcctgttggtaaccatgattggtttccattggaaacaccgtgcacagggtagtacagctagagcctatagagagatttgcacctttttgctgggccctgggagtgggaggatgccccaacggtcaatcatcggtagctgcatatgtcctgggacccgccaacgtaagggcccgcgttttcatagtttctacagttgtaatgtatcagtagtctcgactttctacgtgattctgagtaagaacaagtttaatagtatagccaactactagctccaaatcatatatagccagtataataatcaatttatataatagttacttactatactattaatacttgattctacctgttatacacacattacgttttagaggctgtgctgcagctggctacatatctgtagatctgtagcccgctgcttttctctatcttccttttatctttttaaaatatatttatagttagcttatagcctgctactgtacctgctctaagctgcccgatggaggagcgcccaaactgcagtcgatccgccccaccgctgtgtgtgtctcagtcctcgtttctcttctccggccgccgtgttcgtcgccgccatcccactgactacctcgacatagttgatagtagtatcattttctcaaaaaaaaaaaacatagtgtagtttcatcttgaaaaccagattacttagcccaagttgcacaatcttgattgttgggcagttgggcttagttgatgtatgccgtgtacctgggcgtctgggcccattagaaaccccagaacgtttggtgtaggcccaggccgtgtacttgggcccatctgaaaactccaacacgataacgtggcaggctggcggcgggccccttcccccatgacccccaaaatctgatccaaaccaccatccatcaacccaaccacaccccgcgcgccacgctccgtcgccccccacacacaacacaaggcgttactccggcacctcccgcctctctctccctcgccatggacgcggcggggaggaggctcgcccgcgtcacggcccacctcctgcccagctccctcccgctcccgctcgcctccgcccctaccctcgcgccttcccccgccgcgtcgccagcgtcggacagctaccgacgggtccacggcgacgtgccgtcggagcccccggagtggcgcgcggcgacggacgagtccgggaagggcttcgtggacatcctctacgacaaggccgtcggcgagggcatcgccaaggtgaagagctgtaacgaatttaatctgtgttatgccaaatttgccaatttaatcgctgtagtgtacagcacagtttagctccctttgttgaattgctaagaccgatctcttttgttgattagcattatagtgtgtgttcatctcccatttcgtgattggctgattcgcaatcgcgattcctgttgcagatcacaataaaccgccctgatagaaggaatgcattccgacccctgaccgtgaaggagcttatgcgtgctttcgaggatgctagagatgatagttcaatcggagtcatcatactaacagggaaggtaactatgctagagaaatcattaggtattcaggttccagctggtacgcaatgtgaatgaaatacttactttgatgttttttgatggacaggggacccagtccttctgtagcggcggtgaccaggcgttaagggatgctgatggatatgttgattttgatagctttggcaggctcaacgtcctagacctccaggtcatacgcattactctgacatttgcacacactgattgactatctcataaaaatatattctcgcacctcataacaagcttctggtgctccatgtgctgttttttcaaaagcattccgtgcaagtattcgagggctcagttttgtagctgaggttggatgtactactctcctctgtatgtttatctaatctttaggccaaagcctcttttcaggataaaattcatttttagattactaggcttcaattctgagtgtgttcaatgttcatgatattcttatatgagcttccataaactactctattttggtggtacttcaagtcctacatgaaaactacttgttcacattgttgatgtcttatgttccactgttcactcatcaaaccccgtacagaatgatgtttttagctctgagcagaatgtacattttgtttcttcaggtgcaaatacggcgccttccaaagcctgttatagcaatggtattatcatcactattgtgtttttcccctcatttaaccattctacattagtactacatttctaaatgttaaatttggtgctcatactatatcaggttgctggttatgctgttggaggaggccatgtgttgcacatggtgtgtgatctaacgattgcagctgacaatgcaatttttgggcagacaggtcctaaggtgtttttctggcctgttattacttcctgtatataggcattacacgttgctattataaaagttagtcgatatagcggaacgacgttagttgctatcacagtatcactcaaagttctgatgcaacttctgttacaacaatctaatttgtcttgacatttcttttttccttttttcccaccgggccagcgacagaaccggccaaatgcagtaagatttaaagatggaattacataaagctagagtccaacgacatgattgttgggaggtgtattgacctttctctagcatgtagaggtccttgtgcttgctttagtagcactgatgaatttcagctatgccacctaaagaatatgataactttggtttcaccgtagtacatctaagcttctataagcttattcagactttgattaaatgggaaaattttgtcactgaactactagtgcaatcaaatgttaatgaaagtaggttgaatagcttggtgtttgggctatgcatcaagaacacacggtgcatttaggctctgtttgaaagcccgtttagcttttgctttactgccagactgccacacatgaaacgaaaaatatcattagcatatgattatttaattattaactattacaaactcgaacaattggttatttgatttttcaaagaaacttttgtataaaaagtttttgtaaaagacataccgtttagcaatttgaaaaatgtattcatggtaaacgagggagttgtaaaagctaaacgaggtttcaaacattgtttccttgtagtttgacagattgacccttaccgggattcgggattacctgtgtgctatagtacttttaagagtaggttatctgaatggtctaatctgagttgctttttttttttgcacttatcttttttttttctgaaagattttttttgcttttcttattcagagtaaattttatcagtgaaacgcaaagcttactttaccttgtctctctgatttatacaggttggaagcttcgatgctggctatggcacttcaattatgtctcggttggtaagtcaatgaggtgcatgtcctcaatagagcttttgtgtcattgcgtaactttccatatgaccatatcatgcattgaaatcccctatccaaaacatcttcattttttcagaaaatagtaagatgtttctgtctctctttttttttcctgtctcggacaggtaggaccaaagaaagctcgtgagatgtggtttctgtcacggttctacacagctgatgaggcagacagaatgggtctcgtcaatgtagtagtaccagtgagtgcccgaggagtttacaactaatgcacagtctctaactctctatgactcatgccaggtgtttatgcactaaccgtatacattctttgtgcatatagctcgctgatttggagcgagaaacggtgaaatggtgccgaaaaatcttgaggaacagtccaacagccatccgggtgctgaaatctgcactcaatgcagctgatgatggccatgctggccttcaggtactagcaccattcatcgaaagccagagataaaactacagctcctttcttcctcctttgtaattgctgtagtaaaaaaacaatcctccttttgcctctttcctgaacatacttaccccttggatgcttgagtttattggaaccactgatgcaatcggcgcttctgctgcaggagctcggtggcaatgcgacactgatcttctatggaactgaagaggcaaaagaaggcaaaaatgcatacatggagcgacggcgccctgatttctcaaagttccctcggaagccttaaaagttgaacttgtgcactactagtacagatttctctacaattctgctgtatgtcatgacgcagactgaaatgctactcaaatctccgtttcctcgtcaactctgccggaagcataggtgggcgtcccaatgattgccagccccggtggacgggtgtagaagcgagatcgttatcctttacatgtcatttgttagttggcatttttataggtgtaaattgcagtgcttacgtatatgtgaatattcatcccgacatatcatagccgctggaaataaatggccttgtggtgcattagttatttgatcctataacaattggcctatatttatttttttgctggttgttttgtttgcttttcaatttattttaataactttttcaaggatatttatctgtaagaatttggatgtggcttgttgataagagtattctgtgtattcgagattctttcgtgaccccgtgagagatgagatgagcccatagaaaacgatagtttggtgacgtaaacctgcggctgaggcccagtagagaaaaccaaaaaggcccagtcctccttaatattatcctttgttgcgtcgcgtctctccacggccccgaatcgcctgcggcagccaacgcagcatccaccgtgtccccatcgcaagcgaacgccacaccaagtcgccacgtacccaacacacgctacgcatccaccgagtcggggcgcacgggatccccgtctcccccgcgccgcacaaaataacgaaattaaaaaaaagataataaataatattattaaaataacaagaaagcacagccacaattcaccacctcctcctcctcccctctcgccgggttaaacaacgaggaaaacctaacctaatcgggaaaaaatatcggaggaatccagaagcggggggctcccaccttgttggcgacgatgctgcgcgcgggagggaggcggctcttggcccccgggctccggcgggtcctcggcggcggggcggccgctccggtggccgtgggcggggcgaaggcgtaccacgagcgggtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgttgacgagagctccggcaagatcgtcgacgcatgctttaagacctttgggtgcggatccgccatcgcgtcctcctccgtcggtgagccccccaaccccaactattcccctacctgttcccccccaccttcccttggatgatatggtttaggcttcgttttcgtcttcgtgaggttttctgtatttttcaattgttgggccatttgccaacgatgagaaattgtcggaacgtacgaggaaggattgtgatttgctttgtagtatgatagggaaattccgggggccaattctgagcgtgagatatagctacatgagatgcttgttgaaacaggaaggctgtttggatcagtgtaggaattatagtactaacagcaatattttttgtgtctgtgtccaatagctgcctgtgttttttcaccttagaaatcatgttcaattcaaatatattcaatgtaatgttatcttgatttggtgcagagagtattaatactatgtgtatgttgtaaacctgtggaggcagatgtggttgattaatcctgggtttaatttgattgagttatgttaatttggtggtctagggtagatttggttgattaatcctgggtttaatttgatttgagttatgttaatttggtggtctagggtagatgtggttgattagtcctgggtttaatttgataagtatgttgttttggtggtctagggctaaggtgctcgttctgcttgtctggtacaagcggttactgttttcagatgctcccctccccctaatgattttctgttttggtgagcttatacttatggattatttgtcctaattagtagcattgaaagtttttacatttcccaagttgtatgtcctaaacgaaatttgacatgattgggccccaccactgaacaaacaacttgagaaaggtgtattatcggtgaaatacttttgatagtcagcagctcaaactgttctcaagatgatcgcaattttgtggaagaaaacagaagagtctttacagaattgctatttatgttatgtgcattattctgttgtgaggcgaattcctgtatgtaactttattcatgttatgttacggcaaatgtcgccatgatatgatgcatactgtatgtattgtttgctagttataagccaaaaactagaaccaattgcagcttgaggttaatattaacttactttaatgcatttgcatattttccacatgaaaatcatcatgttcagatgcctggagttcacccctgttctcaaccaatagagttaacaacatcagttgcccagctggtggattaactcttatgattgttctctagaatctctttactatggaagattgtttgtgctgagaaaatttgggtcccaacaacaaattcaattcctgatccggcttttgtccttgcagctactgaatgggtaaagggcaagcaaatggaggaagtagtgactataaaaaacacgtaagctattccccttcctggttgtttgcactgcaatactctcagtggttacattaacatgctatgcttatatggccttttggatgtcattgaactactgtggttcgttattaccttgtggtaattaagtttctggctggtatgtgcaatttccttttcagaccatactttttcatcaaaattttcaatactaaatgtcggtaaaggggttccatctgtgagattttctttgtcattcgttgtcgtaatgatgaccgtctttcagttaatgcttcagcatttggacatgtctgaagcactttggtaaaattatttgatatgcacttgactaacatgatgtttccagaactgttttgtatagatcatattggtttttctgtagttccttggcagtggagtgtgtcatgtgtttgcattgattcatgaacttatttgtgtttaatggatgcattttcattcagagacttgatttgcctgtttgctaagagttgtttggctgctcatattttcttatgaatgtagatggtaatcccatcaggataaccatgcagcatacagtttagcttatgccctttgcttgcatggaagactaatatactttccctttatttttactaattttgtattttgtctatcaataagtttgtgtgtgaggatgctgtcaaatgctttcaatcaagttctgtaaggctgtaacagggttttgtgctctgctttgcagtgagattgccaagcacttgtcacttccaccagtaaagctccattgtagcatgcttgctgaggatgcaattaaagctgccgtgaaagactatgaagcaaagaaggcgaagctagcacaaaagggtgaagagaaggctgccgaagcatgagtgccagaggttctgtcatgaagaatgttgcagtgccctgcgtactcgtagtaaagaacctgtcatgaagaagtctctgctctgcttcttgctggcgggaaatagtgtgtaacgctcacaaactctatgcagcatgtatcataaggatgaaggcaaacatttttgaataaatgtgctgtcatcttgaaagaaaaaaaaaaggtgtatgcgtgtgtatggcctagtaatgaacatatggtacggaattacggtcgcgagataaggcacattgtttctctttggttgtttcaattagtcttaggttgagttggtagatgctcatgaacttgagttgcctggtcacttgcatcatttttctttttttttaaaaaaataactgtttagtagttctccgtgtttctccatccaacaggaatgcagaatagttattgttttgagagttctcctagtatctccatccactaggaatatactgaacttctgtagatatatccatggtgcctgtaagagtgcaagttctgtttgagagacactcggaagttcgcagggcgagtccggttaatggcccgtcacaagcagctgtcacatacggcggagtatgcgacctccggcatcaccagacccgcgtcggctgccgccggatctaaagtcaggcacgggaggaggcggtaggcggcggggatgctggggcagcgtgcggatggcggcggcaggcggcggggatgcagccatgcaggtgtcagcgggagtagaggaggcacggccggcggtgtgcaagccggcgtggagcgtgcggcagagggaggccggcgcggcgggcgtcgtggaggatggcgcgacaggcgtcacggaggccggcacgacagtttggagtcgcggtcggcggcgtggatgtgagatcggtggtgacggtcgcgtcacctggaagcgaggtcaatgacgacgtggaaacttggttggcggcggcgaggttgtcacagcacgtgggggcgcaatcggcgtgaggtgaccggcgaggcatggatggtgcggaggccggtgaggcgcggcttgcgcacggtcgcggcgcaaggaggcgtggcagaggcccggcgcgacgtgaggaggtgcagctagcgcagtgggaggcgaggtcggcagagacggaagccggcgaggcgtgtgccggtgcggtacaacgaggcgcggccggtggtgacacgtggaggctggccagcggggagcgccggtacagtggtgcgtatgcgccggtggtggtttagatggtggtggagcaatggtgcgtcaactgtggattggcaggcaaagaacggcgggtgaaaacccagcctaaccttgaccgggctggcaacggtggcgtttatgcgtcactcccctcctgagggtgttgtcgtgccgtttcatccctctcaaggcagaactagtaaagcttgcagtagctttccacctccgacgaaaccggagatccttcgccaaatacgaccaaacgtggcctttccatcatcccaaaatcaaaatacgaaaaagggtaaacgctaatagcatcaccccctctgaaactctgacgccattgcgatcacatgttaaacctgtacgtttggcatgccagcagctcatgcgccagaagcaattgagcttgccaaacattaaccatcgcttttgagtgcgtccggtaaagcacgcgcgcttccaggccagcgtacgtcggcgaactgatgcggtgcaggtaagatagcgtttcacgaccctcacctaggcagtcacatggttagttggtcacacgctgatgcgcgccaaatccatacaccgttttttgcagcaaatgggctgtgagcccacacaagtattgccaactgggcttggacgggttactgagctgtttgggccatctaccaatggttaaaaaaaggaataagttcatctaaggtcccttaacttgtcgacaaatccgattttcgtccttcaaccgcaaaaccagatagaacgggtccctcaactatcaaaaccggtgtagattaggtccctcggcggtttcgatggtggttttggctgacgtggcgtctacgtggctaattttgactcagtctcgatctgatgtggcactgatgtggcgtttacgtggcaattcgacctgggaaaataataaaccccatgggacccacatgccagtttcacacaaaaataataataataatggtgggacccacgtgggccccacatgtcagtctaactcaccccctcctgttctgcttcctctctctccttctcccctctctgtctctctcttgcgctgggtcattctgattctcctcttccccatcttctctgtcttcatctctctcccctctcctctctctctcttctctccggttgacaggcggcggggagagggcagtggccggctgggagaaggggcgcggcgcggcagccggcgggagggaaactagcggggagaagggaactagcccggcggcggaggcggcgccgccgtggccatggctgcggacgacgtcgacgtcgacctcggcatcctcggcgacgagatgaacgtgtcccgctgatcggccaacacacgcgcgcatcctcggaggcggccatccgtgcaggcgggtgagggggccacctcgccggcgggagaggggagaggcggtcggccgcgaagaccaccctagtgacgatgattccaactacaactcctagtgacgaactcgaggtcgacgacgaggactctaactacaactcctgctccgccgctgccaacgacaccgctaatcccgtgagtccatgacgacctcgctcacctccgacggccacgtcgtaagcgtctacttccgccttgaagcgcccctggcgacgtcacgcctgtgccccaggcggccactcttctccattttcgccgccgtcgtcgtcgccggccgcatcccctagcacaagagagagatgaagagaggggaggagagagaggaaccagaagaggaggggtgagttagagtgacatgtggggtagcgtgggtcccaccatcattattattatttttgtgtgtgaaactgatatgtgggtcctatggggtttattattttcccggatcaaattgccacgtaagcgccacgtcataccacgtcagatcgagaccgagtcaaaattagccacgcagacgccacgtcagtcaaaaccgccatcgaaaccgtcgagggacctgatatgcaccggcgttgtatctagttttgcggttgaaggacgaaaatcagattcgttgacaagttaaaggaccttagatgaacttattcaaaaaaacaaaaggaagaagaagaaacagctttctatgagcttcccatgaagtcgatgagctcaaattatttgctgcgagaaaagaactcagtgctgtgttacaaatcgagtcattttgaccgcatgacttattgactttctcccagtgcacgacaccattggcatgttgagggggcagatgccagatgaggaacactcctacagttaacttttcttcaaaaaattgtgcaggttagctgaattttcttcttcaaagatccaaatcatttttcttagtccttgtttagcttgagacttgagatgtgtgggtctgattcagcttttgcgtcgaaattacagggtagacagcctcccattgctacatgggtcggtagatgcgtatcatcaaggtgccaaatggccaataggcaatagcatcatcaacaattcacatcttacatattacaatagagtttaaaaatagaacttcctccacgcaaaaaagatagaaacaacatccatttgggtatctccgcgcatagatatctggaaccttactacctcaggagtgttcttcatctggccccctctacatgtcaatggtgtcatgcactgggagaaagagtcatgcggtcaaaatgacaaccagaaatggttgtttctgtaaattcaatacgatcaagggaacacggcataaatgcttgaaatcttctggtaaactatcaatttagggtgtatttagttcacgctaaaattaaaagttaggttgaaattggaacgatgtgacggaaaagttagaagttttgatgtgatggaaaagttggaagtttgaagaaaaagtttggaactaaagtcggccttattgttttcgtatgacgcactatcaatttgtttgacatgtctaatgtcttcgagaaaaatagtttgacatgtcagtagagtgatgtacacaggcatgcaaaggaagcaaatcacataaatcacactaactattttcaacacaatgaaaaatgataagcggagaagactactgttagtgttattgttactttaaatatggtatatatagcatgtgttcctgatgaaggaaatcacaaacatgcaaaaatcgtcatgaacaacaaagaaatgtgagagctgaaaaggcatcacagtgttaactggagaaatgagctgagctaattcaagaataaaggtgataaccacagcactgaaaacaaggccaacaaataaaaatgggatggcacattatggtagaatgcgcgcacaaactggaaatcagtgggcagtgatcctcacaatgctagaagctcccccacaaaaaagtgacagcagcatttgagcatctataacaagaacagatttatatcgagaagaactataggaacaagctgaacaagctaactaataagcaaccaatctgcatgaagttttaattttagacacaattattgaacagccccaagatgtgtaatgtcacagttgcaggaaccaatcatctacaatatgtatatgttagctaacgacatttgctcatattcgcttatctcggggcaaaagatgatactttgaaacaactgtctgtcacttgtacacgggcaggatcgcagtaatgatacatatcaacttctaagtgtcttggcatcatttgcaggatggacttcaatgttcagaagctcaagagatattgattccaacgaggaaatgataaatagttgaatctactctaaaaatatgatagtaggaaatatggagtgatttaatccagagctgaagcttgagcatgttcagaattttcacttcgagttaagggtgattgacctgacagtagcttttctctactgccatgattaacaatttaacagacagcataatttcacttcaacactacaccgccattgcacaattctcaccattatgattgcgccaatatacaaaatctacattggcaatttagcgcgtggaacatcgatatcaatacaagatggaatgtgaactaacagatccacatacagaaatctcatagtatgaaacaacaaaccattgtaaatatcaaaggtggtacacaagattagggtgagaaaaaaaggggagtcctaaaattacctagtgtcacgcaatggacaccttggcgccgacctcctcgagctgcttcttggcatcctcggcctcgtccttgctgacaccctccttgaccttcttggggaggccctcgatgaggtccttggcctccttgagggccaggttggtgagcgcgcgcaccaccttgatgctggcgatgcccgcgctgctgggaacctccttgatgacc

SEQ ID NO: 484 - DNA, 1298 bp, Oryza sativa
agaggagggagaaggcggaggagagcgcggtgaaacccatggggatggggggagtgagctctcgcttccgaagttgaggtgagctgcgggaggaggaagcgaggagacggggggataagatgaggcaccgctgggataagacggcacgctatatagtgcgccgcgagtggctaatacgcatttttttcgttgcgatgcctaatcaaattgtgcgaactaggagtgctgactacttggaagttaaaagagggatataatacatgagagcagtcccaaaccatagcgtttaaaggtagtgtatatggtaccatgtcaataagacatcacaataaaaattacactccataacttatggtttcttaaagtgggccattaataaatacatcatctctcttctctaccaatcatatttattctttatctattatgaagaaactattctcccccaatgcaaaacttgatagtgtctactgcataggttctcgtgttgaagctgtgtcttgtatgagacccaatttcttcctctcttcactctctctcttaattaatatagtgccacataagataaaagtccaacatgacaatgtagttaatgctatagacaatatcctaggtggagggttgggactgccatgataaaacatatccctgctttacaaattaatcatcatataagtttatacaccaagaccaaggacaatttaaatcatatcaataaagacatcatagacacattctcccacgatgcatacatcgattaaaacctttcgttataaaatatactccctccattccaaaatataaggcataaccacatttaacccaaagaccaagaaacaattattatcacctctttgtttgaatcaatccaactaatacaatatatgcacccaatagaattaaacattttgtgagtgtatgatttaaaaaataataatgtgagatagaagatatgataattaattgccatgcatgcatgcaggccttatattatgaagaaaaaaagtacgaattaccctccgaactactgggacagtatgaattacccctccccccgaaaccacaaaactagacatattacacctcgaactattgataccagatgaattaacccccccccccccgaatcattcctaagcggttttttttctacatggcatacacatgtcgctgacgtggaaattcaatcaacaaaaaaataaaagaaaatatagggcccacctgtcattatctttcttccccctctccttttttctctcaggcgtgtgtaaaacggcagtgggcagcggcagtagcgt

SEQ ID NO: 485 - DNA, 9048 bp, Oryza sativa
acaatttcgtattttctagatttaattcaaatctaatctttagaagcccatatctcctacaccatagatccgattccaatcaaacttggacctaaattcatctaaattcaaaagctacattttgatatcaaatttgctattttactattttatttgaaattccttcatgccatttgaatttatatttgactttcgaatatttcctttttactccaaaatagcctttagccactaaaaagccgccggttgaaactttacgccttccatggggacgttcgcgcggtctactggccccgacgtcgaaccgttggttgtaaagcccggcagaacccaaacccaaggtcaaagtgctgctcctggcaccctacgcctcgacgcgtataacagtcggagcttcactattccctcgaccttcacagcacgccgcatagttagctctcgagctctgtgtgatcctagccgctccaccgccacccacggttgttggagtaacactccacccccaccaaacctataccaacctcctattcctctagccgatatgttgtcggtcgacaccggctagagaaaggtatcaaatctactcgttatgctctagcatcgactagcatacaaccaaccaaaccctagccgatatgttgccctacttcacaatcggcttaaataccaccaaaccctaggtatcatactgcccaaacctaccaccagccaatactagccacatactcacttaaccagttatatcctttattctccaagcaaccaaaacccacacatgaaatataagcgccagtagttgcttaatcccttctagcctccaactctctagaatatccgcataaaatatcagcaccgtaatccatataccctataaaataaaatagatagactatatcctaaaccctagccctcctaactgtttatctctttcttgctattatatggattttattgaaattggttcttcatctttcttagtagagtctattttattttggatggcaacctgtgatatttcgaggattggataataaggttgcttatctcggatttatttgcgttggagcaaggcaagttattattcctccccttgagcataattaccctatattctatatctcttttctatgcattagtcattcatgattttgaatgcataacctgaacatatagcaaaccagatatgctagcttttgcttagccctgcctagttaggctgcataaaaatataatgaacctagattgggacagtacgtaagatttggttgatttctgggtggctagtactgtcccggtcgatataattgccaccaaatacttatgtcaaacgaacgagtatgaccacagcttcttgaatggggacagacctagatattatgttaattagcaatgtggtacctctgtacagtggttccttttgtaagtcctcgcgcaagaggcaatcttatgccgagcagggcatcttatgatatttaccgaggcgcaggtaaatatattgattttcgctcatgagctgtgtgtgtgattttatgtaaacctggttgagatgacgggggtctctcaacccgttctctctaaaaaccccgggaacgccagaactcctctcgctgctgataacgttacgttcagagcgcatagggactagagttcatggaacaggtgccacaattgttaataacctaatagtgggccatgactaagctaatgaatattggcaagtcatggactgccggtaaagcgtacatttactgcagtaaagtgaaaatgaatctattcgaatagccgtgctcacggatttgagtatcgggactcatatggtatttggttagaaacctaattcaagattttattaaatactgatgcatttcaaacatcataggctttcttcttctacattatctgctttctgcaagtaaatctagtcctactcaaatactgctatttcatacattcatattgaatataatagcttgctgagtacattgtactcacccttgcttcaaccccatctttttcagagtccatttggagttcttatcgaggccgggagttcaatcacataagttagttcccttttaacttaatcttcaagtctaggttatttagatggtttaagtctatagtaaaacagcagagttaggtcattctaaagcttctgctgtaatagttagccacaatctcgtaaataccctattactttatgtaataatatctccttcaaagctatgtctaaacgtatgcaaagacgatccagattgttgaagctgtatcaacttattgatccagggcttgatacagtctaaacatgtcggttaccgaatcattagttttgggacccgacacggcgacggcggggggaaaggcgcggcggcgacggcggctaggggagagtggggaattgagtgaggactaaggtttgcaatgtcttgggcttgggccattttgttgtattgggcttttgggctgtgatggagtctagctcattaaggctcgcgagccagctcgagctggctcgttatctctaacgagctaaactgccagctcggctcgttagaaaattcaaacgagccgagccgagcctgtcacgagccgagcgagctaacgagccacgagctttctgtccacccctacccatctctctactctatcctctaagtgccggggaggaatagggttgttgcttggtcatcgcctcccgcactagtcattgttgctcgctgctcgccaccgctgcccacttcctaatggacccaaagctcgctgccagcggcttcttcgaccgctaccatggcgggggtagaggggagaggaggaagcatcaatgacaaaagattgctgaccatgccgcctggatccacttgccagccttaaagctcgtcgcctgcatcctcctcggctaccgctgtggaccaagaagagggaagaggaggcaatgttgaaccattagagacataagctcgctggccacgctgcttagatccgctcgtagactccttggcagccaccatggctcaggaagagagaaggcgaccactaagcagtagccatagaagcttggtggcatgccacctagatccgcttgcggccccgaagctcgcgcctgtggccttctcggccactgccatggggtgcgaggcggggagatgaggtgatgatgaagcattaatgatagaagctcgccggccacaccacctagatcttctcgccggcctcgaagctcatcgcctacagtcttcttgggcaccaccatggagcgagaagcacccgttctcaacttctcattgatgaagatgcatagggagagagagaagaaagagaagaaagagagagtgagaaataagaggagagtcattgacaagtgtcataactaggtcaatgagccacatcagcgaaaactatcctcaaaacatcatctatatagttattttgtaccagttttaaacttttaatagttagaaaaatcagtgatatttgtgatggggagatatgaatttaatttgggaaactataatttgatgagaaagtcaatgcgttacttatttcgttgcgtatttcgcggaagggatacgggccagaggccacatcacagcaccgtggggcgggtgcgctatcagcgagtgggcgtggccgacgtgatccagcccagtattcgagccgcacacggagcgcgagagaaaacaagacggacgaggccgcctgcctgccgcccgcgccgagcgccacgcgaggggcagatctggccgcccgatcgaccgctatccggccgcggaacagtggagcttgtgacggtgatccccgcggcgcattccgtggctatatatccacttgcgcaatgtcagtgcgggcgtacggtacgtcggcggtatctcgtccgcggcagctgcaatattctcggaacgaccaaggccaacggcgcttttttactgccaaacgggctgcagtcttctttcccgtcgagaatcctcaaggctcaagccagtgtccgtgtcttggtgtacgtacgagccctacacagcgccacgatgcgatattgcgatgctgcatttattgattactacttactccctccgtcccataaaaaaccaacatagtaccaatgtgacatattctaatattacgaatctagacatacgtctgttcagatttatagtactataatgtatcacacattcgatatttcgtttcttatgaaacggatggagtattactaactgttgcagcttcgctctcactggtggagaaggggtttttactcccggttcgtaacccccatgtactacgaatccgggactaaaaatgtttttagtcccagtttttaatataaccgggactattgtgaaatctggtcgaccgaccaaagatggtttctccaccggtgtctcaaagagaaaaacgaaaaattgcatcttcattcagggggagtagctcgctgtgatgtctctttcaggccaaaattattcaagtaggcaacagagattaaacaacggatccatcatccatcccctgccgccattacgcagtttggttcagctggtacactcttaaaaatctaaacggacaacaccctccaggtggagttggtgcacgtacgtacgtgcctgttgtctcctgttgtgacttgtgtctcctcatcatttagttctaacatcgtacatcatcatggcaactgatacggattagtcacagtttattctttcgagccagctgggttagctggtcgctacttaaggtctgaaggaggaggggacgcctagtttattcacctgcctttggtcctttccattttgataaggtatatcccacttgtaatctaatctagtcctgatgctattattgaaaactcatccttaatttgattccctttgtccagtcatttttcttttcttttttgtcgtccacgtatgcctatcgtgtaatgctgtgtatatatgtcgtcgaacaataatctcgacgctgattgctgatctaactgaccaatgaactaataaataataacttgtgagagagagcaatgaattaactaattcttgcaatagatattcttatctggtttttgaaaccacgcaagcaaaaataatttatttgcatcctgttttacaattgaacacaatgcgctacacggaactgcaaaaagtatgctgttgaaaaattatttagtgcatactattgcctctaatcgggggcggatccaggaaaaaaaattaaggggttcagttatacggtatcttcaatctccagctatttaaggactttagtttatcatttatggtgaaaaaatcgaaggaggtgctccagaggtatccatgggtcttgagggtgtaggggggacttgagtccccctgcacccacgttggatccgcccctgcctctaataaaatatctggcaaacatgcacacaaatcgcaactctttgttttttcaagtgaaagagacaaatgggcatatcaatatatttcttataattgttttattcagtattttagtggaagaataatatacctatatgtcagcttgccgtctgcttaatttacaaatatatattttttaaaaaagtggctattcccggaatataagggataagatggtttcctgaaaggccatatgacttctgcaaacattaaaaaaaattatgaacaggataggtatattaatcagttgctgcgaaatggcaaagctgactttgtaaattttgttcaggaaagtgttcggtgacaaattatttaagagaactgactaaagtttgtagtttatggggtgatttgaactatcgcaatagttaaatgggtaattcaaactttttactcataaagtagaagcatgatcaaactctcaactctagataactgacataaatatataccggggtccattctaacttcagtcttcaaggacgtgatactaaactgtaaaactagactttggttggtaattgatccttcattgccagtttggcacagctcaaatcaaagaaattacaagttacaaatgcaactgacagaaatactgcagtagagactgtagagtcgtagtgatgcagaatataacaagatagaggctgtgattagatcagaggtgtaaagttttagcgtatcatatcggatatgccggtacataatgaaagcattaaactagactaataaaaaaactaattacagaatctatcagtaaaccacaagacaaatttattaaacctaattaatctgtcattagcaaaccacattgttaaatttttttagcatatatttaatattttatgcatatatccaaacattcaatgtgacctgatgtaaagttttgtcagggatctaaatagggccaaagtaacaacgcagtaatgcacggcatatgcacatcgatcacacagtgttcacatttcacaagcacccccatatagctagccaaggtcacatggcgatgcaggaaaaccgcgagcagatgagtagcgcggttcacatcacctgcactgtagttcacagtgcggctatagcggcaagcccagcggcgtttgaccgaagcttaaacatgcatgacactgtgcgcatgaacatgcatgaattgcagtctctgcagatgtcgcatcgacctggcactacgtaaaccacacctggatctggatctggcacatgaattgcctcctctagctaatttcactgcaaaaaagaaaaaccgcaaactaaacaccctatcatgtactgttccagctagtagaacacagtagtatagtactactatactacagccccatcgtttggcctaaacagccaaagaataagccaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttggataaaatggcaaccgatgggagccctagtagatcaactgctttggtgggcttttaattaagcagattccatttgaaagtttaatttactggagctgtgagtgtgcgaggtcggtcaggttagttgggaaggttgacacggagaaaaccggtcagtcttgtcatcgcggacagcacggacacgtacgcgcacgcctacacgtgtgcaggcgcggccacatgcagatgccgcgccggaagtagagaacacgcatgcgacaagactacaagagactgctaggatatgagaattagggggtgtttgggtgctaaaaaataagtctcgggacttattttttggtttgagggactaaaatcacctaaacacccccttaacaacctgcatacagtagtgtttgtgttggaagcctgggagggccaagctagccaacgtgccgcgatctttggtgatctttgataagatgtgcagttgtgcactgcacagactcgaagggaagagagagagagagagagagaaaagtagtacagtactgtatacgctgcctgtccattctgactgacaattttgtttgtaccgacgagcctcggctacgcgactactcctacacgcgatagttcacgacgagaaaagttaggaaccctccgaactatcgcggtcatctgaattaccccgtaaaccacaaaaccggacattcttcacccctaactatacaaaccggacgaattacccccctcgacccaatccacggtggttttggtctacgtagcgtacacgtggcagtccagtcagcattctatattttaaaaaaatgtggggcccacctgtcatacacactctctctcactcacgtcagcggcaggcgggggcaacggctgagggcggcggtgatgtgaccatgactaccacggatgcaaccattgctcacattatggatgaataagaagatatcgagatcacgtcgtccaagtgctagaatccgattcggccacctgctacactactgacttcaaacggttaccgaatctgcatacgacctccgttttcggcccgtgagtatttgatggaaagctcttggagccctttttctgacggatccagcctcatctccgaattccatctcgtgtggccggaatcacaggcacaaggtgttgcatcacctataatgggcctatgggcttgtaacttcatttgggactccggcccaggtggggcccatgtggggtgcgccccaaccaggtggagcacgcccctaggcacccctaggtcgtcctcccacccctatatatagctaggtactccttcagggtttattgggttttgttagattaaagtttagccattgctacttgcttgcagctcgcgtgtcagctagaccgcccgtctgcttgttcttcggaaccccaacttatcgtgtgtattcattcctatttgcaatatcagattgcttttatcttgttcttgcttgtttcttcgatttgcttgcaggaataaggttgatctgcaccggcaagatcaacaacccacggagaggtgtatcgatcgcaaaggcgcaacacaatgtcttgtacggttgtagtcggatcgtcaacgtttctcccaaatcgtagttatctcaactcaccgaaagatcgggccaaacaactgccttgagtgtcgaatggaactcagggttcatcaggtggcctcggcgcggaggcggcgggggcggcggctgagggcggcggaggcgccgtcggcagtggtgctgccgccgcgtcgccgctcggcctagatggtcactggcgacgcatgcacggcggtgctatgcggtggcggaagaaggcggcgacacgaaaggggagaggaggcgcgagcggcaagggcagcgactcgggatggttgctcgggacacgggaagggcgacagcgacgagaatcgagggggagaagggccgacggcggagcgtgactactcagcggcggtgggaggggaggcacggcgcgggagctagtggggaggccggcggccaaggcggcgggttggggtggttcaagggaactccaggagggtggtggcgcgaggaatcgacgaggaagaccacggcggtgcacaatcgagcgcggcggcggtgaaacag

SEQ ID NO: 486 - DNA, 25611 bp, Oryza sativa
  unsure (1)..(25611): unsure at all n locations
ctgccccagcctcccgctgaccgtgagagagagaggaagagtgaggagagtaaaagagagtgtgtgtatcacaggtgggccccacatttttttaaatatagaatgctgactggactgccacgtgtacgccacgtagaccaaaaccactgtagattgggtccaggggggtaattcgtccggtttgtatagttgagggtgaagaatgtccggttttatggttttggggggtaattcagacgaccgcgatagttcggggggtaattcgtactttttccgaaaagttatgcctgggacttcaaattttactgcccagccatccgtcttaaaataaaatataaaatttagtactaaataagatacgttttaatatatagtattgggatatatcttatttaatgctaggttattatattttgagacggagagataatatgatttaattttaaaagtaataggaatcatttcatcaattttgtggctcatatttgatcttattttctaggagtagaagttggctaaggacctgcagttcgaactagtgtttttgttaactaaaatgatagttcatgaaacaagccaagtcattaatgcagaattgattaagcattaattattataaacttaaaaaacatatctatctaaatttttgaagaaactttatataaaatgattttaaaagtgtatcatttaacaatttagaaaatatgtcaaataagttataaaagccaaatgccctgtacaattcagcctaaggtttataatacatcgatcgaaaaatccccctccccacttaatatattagttgcttgcaatttttgatgtgaaaagttaatacaaactgctgatgtctaaaccaattattcaggccctgctgtgtattggagtactgcatatttctactagaacaataccggggttggaccgtttgagtactttttagactgatgcgtgcattacatcattttaagaattggatttcaaagaatgttgcttttatgttggaatccaaatcgcatacgtttcacgataagtacagagtatcattatacaatatttagtgattttaaaatggtatggttttatatctccactagagaatcgtcgcgccaattggcacgctctttttaggctgtgcttacgtgtatggacatatatattttaaaatatttcgcaggattaggccaacttcaataagttgttcatttaactcagaatatagcaattgagtatctactcacttatctcaaccgatcatacccctcttatttaatttctctacttacacgcctaatttattaacacctatacccaacttcgaccaattttatagacattataatgacaaagcatttctcactaaaatataactaacaaaaaaaataccaattaaataccctagaaaacgttatttctagccattctcatgcatttttgtagtggggagaaatacttatgatgtccttatcaatttgtaaatccaattaaatatgtatatctttgtttgattggctagaaaaatgttttcctaaagggttacgtaacaaaccttttattatttcattgtttctttttacatgacacctcctgctactagattctagagagaatctagtatatgccactgatcttgtcccacgtctacgatttactatcgtttgtcacgttctacaatataccatcgacttttgtttaacttctacgatttaccattgccgtccggttagcctttattaggactgtacaattttgtccaaatgagcaaaataccctaggacaaaaacttcctaaatttggataaaaatttaaaaatatcatattataacatccaaaattttgccaaaacaaaatatgatagttcagaatgtttatccaatttttatctaccgcgacaacctatcagccaccgccgctgggataggaatccatttttcttgcgatttgtttctgggatttttcttggataatctagactcctctagcatcacacgttttgtaaaaaaaccctctaggaacttgcatttacatttaggtccgccagattttttttcaccgctgatatttcatcaaacgactgtgaaagggttgcaaatacgtggcgcgttcttgggccgagaattccgacggagcgcaatgagtggtgacacgtggctcaattagaggcccgagattagaccttgaaatcggtttataagattctttattaaagttctatgatcgggtcctagtttgttcatttatagaagatgtatgatcatcccattaatactatggcggactaaacatggtacgttttcacaatttatgcgcaatgagacgcgcactatttatttatttaaaaatgataggatacatttattgtattttttatatcttcgtcctttattaaatgttctatgaggcatagtttttcatttatagaagatatacgatcctctcattaatattatgttagatacacatggtttgtcgcaatttatgcacattgagccatgcattactttatattttgagattgtaggacgcaattattgtatttttcggatctccggccattcttcattaaatgttctataagacgaaattttacatttaatagagaagatgtatgattacacatggattatcataatttatgcacaatgagccttgtatttgttttttattttaaagtaccaggatatatttatttgtttgtctagatctctttctttactaaatgatctacgattgatatttttacataatatgcatattacattttatagaatatgtatggcactcacattaattccatgatagaatacacatggtttgtcgcaatttatgtgcaaagaaacatgtgtcagggttatggataccacatacctaatagtagtcgactaaatctcggcaggacccaccatataccatgtcctatacggaaacaacttgcggatataggaggagttccggataaggaaagacaaccagagttctaaatggaaacgacaaggactactcggattatatccatattggtttctctagttctacttggacaagtggacacctatggttataaatacaaggcccaccatagaagacacggaataatagatcaagtcacaagatcaacatacaagccaacatacgccaagacaagccgtcggatatcgacatcagagatatgcctagatcgaccctatccggtacctacagaggccggccgtagggatctagcgttgtctctgatctcgccggacacgaactcgaggaggaagactaccctgttgtcgactacgagtcagaccttcagaccgccatgtcgacaacagttagataggctaccccaaatattgtactggtgcgattatggtgaataagagcaataccggcttcggctaacaggatgtagggttattacctgacaattcaggggcccgaacctgtataaaaatcccctgtctccatctttttacctcagtctcgcatatatcctagtaccaacgatccccatactatacaaataccggaatcgcgacatcaaacgtcgacaacatgtattatttatttgttttaaatgccaagacatatttattgtatttttcgatctcttttaatttatttattttacatttatagaatatgtattatcctcacaatagtgctatggcatattacaattgatttatcgtgatttatgcacgttaatgctatcttcgcttctatggagtacttaccatcgctcatcactaatcagtagtactaagtacattcggactttttaattaaaataaaaaaaaagacctctgtggctggagtatttgtttttcttgtttagaagtaacaatttggaggttttatcattgcttatgcctccaaaattttattttcagccttcggagaaccaaatgtaatggtatatatgaaactttaccatttttccacctaagaaaatgacaacttaccattaccaaataggaaaaaacaatcaaagcgagagaactacctgaaaattttggcatttggtaggaaaaaaatgtttttttatttcttcctttgtttttgtaaagaaagaaatgaagtccatcatcttcgtcagaggtttgctccggtccatcacatttccgatgcacaataacagcagtcgccattccctatataaacctgtcccgagaaacagaatctctacttctctctcccctcccgtcttctttgctcaaatagccatcgcgagtctcgcgaacttccccagctgcctcaaagccggaggagctcgccggccactccatgcctcgcgtgctccccgcggagcccgcggcgaccaaggcggcgttggctcgcggtttctgacgagctcgcgggcgcgaagcggggccggtcgtcaactcggcggcatcccctccctccntacgctgcaaccgcaacaagtaagcccgatcgatcgctgctcctgcctgtttcagtgtttctgctccggttaaaattcagaaagttcacgggaaatgcattgcgaattttaactgtacagatgtttcgtttagtcctatctagaaacttttttttttaacggttcgaccgcgacgacgtttttgtctcaaatgaaaacgaaacgacgtttttagtggagagactacagcaaaatttccaatgttcagaactaggaccaggaggatactctagtctatagctatagctgccataaacgcagatgattttgagaaacgtggcccatgcaccaccaccaccaccgcgccatagttaaccaccaagacaaggtaactcagctagctgcagtttcactttcacagtagnagnaggaaggaagcaaggaacgcgagaaagaggccacagcacatgcagcttcttaaatacacagtaccaactaaagtgtcgcaacagtgctcgtagtattattgcaacgcagctagtagccgagagcagcggtgtgtacctcgacgtgtgtgacatgacatcctaggaagagatctctagccgcgcgctgcccggcctgaacaatggcaggatcgtcgtcagtgcagcggcgccgctgcaacgctactagctactcctcctcgctgacacgaagcatcagcttcgtttactacttgtcattaataaaaatctcgatagcagcaaggtttggttgagttgagctcatccggtgtcttctgacttccatggtcagcttgctcgcgtaatctcgtccgttttctaatgcctctagagtccaatggaaatatggaatcttgccctttgtttacgtcagtagttgctgtagctctatctggccccttcgtcaggacaaaaggccactgtctctaacatattaaaattcaaacggcttcgaaatgtttacaagtaggtatacttgcattggtttcaattttaaaaaggatcaaaaatatagttggcgtatgaatgcttcaccactcattttttttctgttactataaggagtggcattcctgtccgtgcacgggtcatgcagttccaaatactattaattagctcattaacgtgtattagaacgcaagaagccgagatcggcgcgcggcttttgctgttcttgttataacggttgcagtaaaattattggagcttttgatgataaacacggcttctttccacatagaaagctactgaatttcccactaaaacgaagcgttcatcaaacaatcacctgtgtggaccaaagcaataatagcatcgtctcttaactaatgccattaaaatttaggcccaattcgcttttgcttaaccaccgaatgtacattaaacatcaaatgaagcgtgcaacttggtcgccgcaacaaatacaatcatcgccatgccgtccaagctatgggtatctatagatacaattatttgggggacaagggctcggcatgtttttgcgctgctgtgtatttaattctagtccgatgtgcaacagagtgggattgatggcgacccaagatcagtttgtttacagccaatcttgtttaaccttaggtgtactttggtcacgcatagcttgtgccctgttctaaaggacacgtgtaatggtatcgatcactaccctggtttgaattatgccttctttgtaagcagtgatccttttggaaaatttgtaggaactagttcgatattggtaaataatactcgtaagtacaacaattttgcaattcaaataggacctaagagtaagactcgtaagttttatttttggtctggtccccttgttactatgaatcttctacggagtacacattttttgtgtggagcctacagacaattcccaacatgatcagatattcaggttccttcttctctgacatgttctatccataccactcaggcaccttcctctccactctccagctatcttcccctcaacaattaatattcagtccattgattagagaacacacatacacacacacaaaaaaaaaatcagatatcttcccccacgtagctaactcgattcattgtccaataatgaatcagccggcgaaaacccccaaaaaagaaagagagaataaaatgaaaggaacgcaaaagaaacctataggtaatcatctgaagtagctgtcgctagaaatctgtatcaaccacaccatggggggagcagggccctcttgcctttcgatcgacacgcatcggtctctgccaagtaaaaacgtcgccaaaggccagcagcgacggcagggtcgcgggaccgacgcgtcagatgcctcgtccggccgtgatggctgctacagtttccgctcgtacccgtcctacgtgtccgcacagtagctcaacccacaacgcaatgaaatgaagcagcattgtagtggtagtaatattttttactgtttagtggattatatgttgctgcgactgtgagcaatttacttcggtagtagtaactgtgatggttgcttgcttgttgtttggtcatggtgatggtggtgtgcttggtctacttggaggtttaggccactctttgatggcttcaaatctgccaaaccttctatttaaggtgtccgtgtgcatttacttgcatgtgtccatgtccagtcctttggttttgcaacatgtggtggccgcctgcgttgccagttcgccaattgggcccaaaaaaaaaaggaaaaaaacgtcacctttttttcacgtttcgcctcacggccctcaccgggaagcggtagtgatggcggtggcgccgcgcaggccatgaccatttccctgaccggattgtcgttaagggctcttctcttattgttgttattattatcgttcaaaaatggacaggctgcagcagcagcggcggcggcatgaggcgctgaccgggcggcgccgtggtggtggcggagggatgtcgcggcggcacggccggttccggttcgccaccggcggcggcgacggcgacggcgacgaggaatgcgctggcgtggcggtggtggaccaggcggactgcacggcgcagtcgtgccggtcgtgcgtggcggtgtcgctggcggactgcatcgcgctcgggtgctgcccgtgcgcggtggtgagcctgctcgggctggcgttcgtcaagctcccgctggcggtggcgcggcggtgcgcgcgccggctgcggcggcggcaggggaggctgcggcagaagaagcgggtgcgcgacctggacgccgcgaagaacgcggcgggcggggggcaccaggagccgctccccggcggcgcggcggccgcgtcgaaaggcgaggacggcgacgtcgtggtggtcgccgccgccgccgccgagttccccggcagcgacgacgcggagaacgtgtggctggagttgtaccaggtgggccgctggggcttcggccgcctgtccgtctcggcggcgaacccgcccgtcaggccgtcctacgtggtggccaccgtccgcaacgccgactgcgccgccgacggcgacgtctcttgaccgtcgagacaaccaatgccagccccgtgccgtcgaatcgacgccatttgctgctcccccagctcgatcaattctcccgtgcgatttgtcgccgcgctgggcgaacgcaagtacaacctgtgagctgtatgccatggtccaagtagaaattggtcggcgacgttcgagagagcggcatgagtgattgactcgaacttcgaaggacttgagttcatgatttctctctctcttctccttttttgaaggaaatcttcttcctttttgttgttcagggagctcgaagtgtactcacaagtgtagataatttgtgccgtcgagctccttcctccatccaagcataatgccgtcttcggtgatcgctctgtacataccaccatttctcagataaattttatctgcgtgataagagtgtggcattgcgctccaactttggctcagtactatgttaatggatgtcagttctgtatctgcattgccagcgcctgcgctcgccaccgacgcgggcttcctgcgcctgcgaggctgcaactgcgcactgcaggcatttgcaaatggcaaaaactaagagcaagtttaatagtatagcccactactggctccaattcatctataactaatctaatagctcatttatacaatagttacatactacactattaatatctggtctcacctgtcatacacacgctgcgtcttagagtccgtgctacatgtggctacaaatctgtagcccgctgcccttctgtctcctcatttatctgcttaaaatatatttgcagctggcttatagcctgctattgtacctgctctaagaggagctctattttttttaatcaaaagggtgggtacccctccatttctagtatcagaaatgtgcaagtgtataccaagatcgttcatatctgaaaacaatcccagataacgaataggcaaaagaggagccctactgacggaatgtatacgcggtgtttcaaaatgcaagttaacaagttaataaacggatgaggtttaaagttattttgaattttaacgaatcttatctgaatttcaccgtgtaggtaattggcaaaaccgctagagagcgattttctgtgggcaaatgttttttttgtaaaaaaaaatccggattccatgtaggagaatataaaagatctgttgcttcaggtttcatcaaactttcaatagaagaaagtactccctccgtttcagggtcacagtcaaactgttttaagtttaatcaagtttatagaaaaacgtagtaacattttcaacataagataaatttattatgaaaacatattcaattattgatttgatgaaattataaatattacaatatttttctataaaatcagtcaaacttaaaactgtttgatattgatcaaagtcaaaacgtcaacttgaaacggagggagtacgaagtttacaactcgttcatcgtccctgaatgactctaaatgaaagcccacatgggcccatagtctgtacgggaaacaaagagaaactggaaccgaagaccatgatgggccggtccgtacgaggagcgccgaaatacctcgggccgccgcaaacatgcattgctgccacaaactgctatcatgtcccgaacagaggatttttacactttcgtttttcagatttggttttcacctcaaaacgaaattatactgatagtatagttttgcccagccctgcgttccgaaaagtgaaacacgttggcccagcaacaaagaagagtttgaggagcctttgcaccaaagagagattgggatgatgctcgtgctgcgtcatgtacactcatattgcctggttggtccaggtagggaagcctagataaaatcataaaaaggaaggatgacgacggcccgggccggccgggactgcagccagctagccagccaaccgtagctagctcggtcccattcccatctccctctccctctcgatcggcacggttcacctaaccgtcctgattcttcaagggaatttctcccggtcatcgattattgcgctcgagattccctagtgctactaaatccgtctcaaaataataaatacagttgtggtatttttgtcaaacatttaaccgtccatcttatttgaaaaatttatgaaaatatttaaaaaattagtcacaaataaagtattattcatgttttattatctaacaacaataaaaatattaattataatttttttttaaataagacgaataatcaaacgttgaatataaaaaatgtaaaactacatttatttttggatggagagagtaatagactcaaccacaccctctccctgatttggccaatagtgtaccggcgatttataccagtggccagccggtcgcgttcccagcggcttcgacgccaccaccagccaacatggaaaccacggcccgttcgtggtcgcggcggatgagacatctgctcggtttggtttttttcatcgacccacacggccgcaccgctagctaataactcgattctccccgttgctgttctgcatctgcagtgacacacaattaggtgaactaacaacgtcgcacttgaaaaaaaaaaaggtagggaaacaaaaccacttggcaaaatctagcgaaaaagaggagaggaggaaggaacaggatagcacaagtacgggcacatgtcataaaccgtacacgattcgttcaaaaaaaaagaagaaaaaaccgtacacaatccgaaatcgcatttctagttgggtttctagaagcgccacctcccacatccccagctctccgggcccgacacgtgtcccgcacaacctacgaaatcaggcgtactcgccactgacaggtggtcccagggccgtgatggacccaccagtcagtgacacgggaggcggcccttatctactacgcgcgcgcgcgagacccggccataataccgccttctgttgttaatcggttagcttcgcgcgccgccgccaccggctcaacccgagccacgcgaaaattcgaaggaatccgcgaataaatccgaggaggagaccccaacccgagtaggcgaggcgaggcgaggagcgggagacgtcgttggccatggaggacagagaccgcgaccaccgcggcggcgccgacgaggacgccccgggaccagccgccgccgccgtcgcagctgtggacggggaggacgaggtggaggatgatggtgggggtttctccttccccgtcccgccgttcgccgcggacgcgttcatcgtgcccgtgtacccggtgtttggtcggccgatgtccccgccgccgcgggaggcggtggtggaggaggaggaggaggatgagccggagacggcaaccctgcgggtgccgttgggccggctgctgctggaagagcgggagttccgggcgaggcagcgggagagctcgggaacgtcgccggtgcagccgcagcggcggcggccggacgacgagggcgagctggagggggtgccgccggagagctactgcctctgggctccgggcgggcagccgtcgacgacgccagcgtccccgcggcggtgccggaagagcggctccacggggtcggtgctccggtggcgccgcatcagcgagcgcctcgtccgccggagccacagcgacggcaaggagaagttcgtgttcctcaacgcccccggcggcggcgccccgtcgcctcacccgcccaaggacaacgacgatgcaaacggcggcggcagcgtcggcaagggcgacgccggccgccacggctggagctattacagcaaggccggcggcggcggcagcggcggccgtcggagatcgtatcttccctacaagcaagagctcgtcgggttgttcgccaacgtcagtgggttgcggcggagctatcacccgttttaaattcgatcctttcctcctctctctctccctcttcgtgttcgtcctctcctgtgcatatagctagatactctcagtataattcgtagtgatagaataaaatcggcgtgttgacaaattgtaaattgtaattagctcgtgtaaagtaaaatggtcctacggctacgtgagtaagcatctcccaaacatggagattgaaatcttatcttatctataaaaagaaaaaaagtattgatgaagcatatggttagcatttgtttgttctttgtttacatgtttagtagttacttcagaattgatgcaaacagagaggaagagttcaggatgggttttctgttttgtcggctgtggctgcttaatttttttttggttcatctctatctcagatagaccggatttctgtacgcttagtattaaaccgaccaacaccattaattattgattagaggattttgtttcgtggcggcttgaattagtactagatttttagttgtttgtcaacgtgtcatcatttgttctttgattaagaggttgtgtgcgaggcaggatcagcggcgacagttgattttcaatacaacgatttcgcgtacgtagtgaagtaacccggcatggggcaatttagtttgtcatcaatgcttcatgtgaatttagcgaaagctatctgcctacctgtcacgacgtgaacgtacgctattgatcgtttcaaagctctcacctaaattctctatccgtgcgtgtgagctttgtcactaaaagtcttaaaactatatttattcgtggggatattccacaattagcactgggtgaatggtttgtcgtgttggcgatagttaccactgctactaaactactacagtacctatttcttttcatggtaaagagactgtgccatttcgataagcaagaatctgcttaccaatacgagcatctccctgacgcacacctccttccttttctcccttttctttttcttttttttagccacttactatttctatttgcttcttgagtggcaacttttacccgtgcagattacacagcaaaaactagcaaaagccttgttacgtgttacgccccaatctcgatcgatctccaaactttcccccggttttttttttgtgtggaaccggtggtttggtgtccatctcccgtttcgttgtcgcacccacagcgcccatccaccgtggtgcgtggcaccatccgtcaagttggctgcgagggacgaagatttgcgagtttgcgacgacggggaaagggctccccgagcgcgacagctactcctccgctaaccaaacccaaccacgcacacacgggcacactactcgctctagttttagacacaactttaaaagttatgacgagaacaaaaagatctaatacatactacctatcgaaatctaaagtcaatggttatataaatttgtaccaactttgaatgaaggttacaaatggatttgaataaatgtatctttgcatcgtgagttactggattatatgtgatctctgttcagcgaatcgtgtaataagttgttgcagtatcgctgaagcaaagatcaggatttattttattattgaaaaagaatctccgagtacgcctagattttagtcttttttgtccaaccgcgatcagtagccacgttcatgtcatcgtgtgagttgcgtttcggggtaaatcgatcaggtcggcgaatgcagtgtcgtccacttattattatcctctcccttgtcgagccggtgagtgatgagtgagccattagcgtcttgtttgctgcctagcttagctagaacgcacgaaacgaaagagccacggccacggcacgcgtgggcagggggcctcgctagtgcggtgggctcacgccgtcacgcgcgccgttcaaaagcgagggggaacaaggcggcgacaagggggaacgcgccgacgtcgcgtccgacgccgacgccaagtgatggctctaaccttaccaagagtgctggtctttaattcttttagagaagtgtcggtacaaaggccagaagttgtaagacaattcatcactgcttttcttctctctcccagttacacttcattcttacaaataccatattactgtaccatcatcaaagctcagttgataccatggattagtaatacccacccaacccatccaaacgatgagcagatattgccgtattgcctggacgattatggcatttgtttttttttacttgcatattttggcagcacgcagggagtacatggagagtttgaggctgaattacattgttcagggagcggaacgcaggtcaacaatctcgaacctcaaatttgggttgaatataaccttggagcaggtttcatagattgggccgccgtccgttgtctcccggtgggcgtggaacccactttcactgcactccctaagcacacccatccctcctgggtctgtcagcctgaatattccacagttcctaaaggatttgagagcatatgcatttcactgtaagtgataataaattggcagggggcaccaccaaaagcaaaaggaataataaattgaaactgtacaaccgtccatagaatacttgcctagtaggatcagtgggagcaatcacaatcgcaacggcctctggtaacataacctgaagaaatccagcactttatgtctaccagaattagaggaatggcaaagcaaaccaaaatttctttctgataaagtcgtcctgagctagtagattaataattgcagtagtggctagtaattcctagctagattagaatacagccaaaagcacaaaagatttggtcgtgctttcaccaactgaattaacttcgtttacatgtcttactgcaggcaaagttttaatgcaaataaggaacctaaggcctttttaaatgataataatgcatacctttgattattttattctataagcctaactacaactgctcaactaaggatagcaccatagatagtgtatgcagatgtcagggtggtgtgttaagtcttgttatgttttctcttgagctttggtgccattttattcatgtgattccatgactccatagccccctacgatagcttgctaaacaaacttcacaccaatagaaatcctttttgtcagatgaggcgcacaacactgatatgagagcacttaaagatcatgaacagtaatatattcagagtttgcagctttcgttctagaatcggactatgtacattaaaatcacaagatctataataggaaaaaattgatgcatatcagtgcatcaaagtattataccatcctttataaattgataagagctgaactttctattgatacaccatttattttgagacaaaacattattatctgtcatataattacctggtaggagtattgagtgtgcagatcaattgatgataagaaacacgtttgtgaagggtgtgtctggaaaagataatgaaaaaaatcaatctgtgagctgctaactaaaataaccattatatatgaacatatcaagaaggtcatgcatgggttccattttaagttggatttgataatatgaaagttccaaggatatcaagacaaaagggtaaataatggttgcgagtgttacatgtatccaccctgcagggtaaagtgattgctccgataaaatagcatgtatctcctcctcactgacagcctggcactgcatttgggaagataaaccaccgcttcagagcgtgacaaccagatatgcgtgcacaaaatatgtaaaaatggctatgatgtattaatatttaataatgtatctatgtttcaaaacagtttaatttctgacgtacagaatgagcagttgcttcttgctttggtatgatcaacatagtcacatagtaagtcccatctctctgcaaagaagcattgaagatcacaatgcaaatccaaaaataggtatgattatcatattggcaaaccattttgtgaagcgaacctacaaattcatctaaaagggacttacaaatgaagcacctaggattccacaagtctctacattgttgcctgtattctcctttgcaagttcgatgaattcatctgtcaatctaactgactgaagaacatgcataaaacagttatttcatcttaaactccagtttcttcgtagtgacatcacaaatcgagacaaagggatgataatggaagcagaacgtactatctgcatgtcatgcaaattgacagatgctgaagactgccccactgaagatcttgattgctcatcagcatattcaggatcctggctaaaagaaacattgccgaagctcgaaaggtcttctatccaagaaacaataggagatgggtaatggtgcttcacagagtaggaaccggtattgcgatctcttgctggtctacaattaacttgatagtggacaaccttttgttcattggtatcgattttatccacataatatggtttacttggcgttggatgcgtcccacatttatttgcattgatttcaactctgccatttagcactgaatatatcatgatggcataatattaaatacaaccacacaaggaagatgcacatgaggccagtattgtatacctcctgccacccatggctaggtcttggcaccagacttcgacctgcagatcagatcatctcaaacgaatataaacgcacaaaatcaaatacaagagggatttctttgaaaaggaagtcgaatcagccgatttatttccaaaaggcatgctatccattgggacataaactgaaagctgatgaagaacatcagtggcgggagtttcatgagctgctcaacaactccagaatggttcggtttcaaccacagcttaagcaaaccaacaaaaacgtggcatcttatcattaatcctataaacaaatgacacataataccactacaaactgataccactgcatcaccagccttgcaaggataccttattgcttcagaaagctaaaactatcccggactagattaatccacgtgactgctccttgccacctactaactaccaagacagcacgaaaccacccagcggcagcagcaacacagagcgagctataccgacgattcctctctcaacccgacatgaacctgccagcggaataccaccggaaaaaccgattccccaacgatcgataccttttgagagggagagaggctcaccttgagaaatccggaacagcagctggacaacctcactggagttcgctcgggccaaggattggagaagggacgcgggagagagagggaggggaaaggcgagcgcgcgcgcgctgttcttaccgcaagcgcaaaggacgcgaacccgaatccgcggcgccgtctatagaatttcacgcccccacacacgcacacgcgtcgtcacgctggccgggctcgtgcgtgacaagcgggtgggcgaagcgattgagagagaggagaattcaagatagggacgaaaagcaagtcgaggtgtcgaaggggggaagcacaagaaagcgggaagcgggcgtcacgctcgcggcggggcgcggccggcgtggggttgcgtgccggtgcgtgggagcgacgcgcgcggtggtgtggtggcgccgcgtggggcggcggaaaaatgcggtggattcgtctcgtctcgtctcggctcggggaatcaatcgagaggcgggtggatgcctgatgacgtgagagcacgggacggacggctgagagtgggaagtgaaaaaaaagaagggggcaaaagaaagcatgtcggctgtcctagccgtacaagaaattctttgtagataagctacggtgacgaggcagtttcttgttctatgggtgtgtttagttcggaaaacagaaacaacttggtgtgtttagttcacactaaaattaaaagtttagttaaaattaaaacgatatgacagaaaagtggaaagttatgtctaagaaaattttgatgtgatgaaaaagttagaagtttgaagaaatagtttagaacttacaagggtacggaagtttaagctcgaaccttttctacacctgttgcacttgtcatcccggattgagaaggcgatagtctgcgacttgcgaggcatatgtggctaaattctcccaacgtcacgcataggtcacttaaagatgggagctaaattatcatttgagaagtactagttcagctgatatgttagtttatacagatggggaatttcacacgccatatatctgagaaattcaatatcacccaccaatcatcttccagcagatcagcaagtaaccttgtgcaaatcccaggacatcttacaaaccagcgtatcacgtatgattggaacaaaactctctatgaagtttcataagcggaatcatccagttaacttcatatataagacatcaaaacgcatcaacttctttcatgtacctgcttatgtgtacattcttctaccgctccctgttgagataacacgattatagtgccgtttctccggtttgcagaatcatagctgacgtctaaccagtaattcctttaagattcattagtactgccagtcggttctccctacactgactagagaacagtgtacccacaaaataataatgataaggaaaaatgagcataaaggtgtagattagaggtagtagtcctacgctatacatgacaacatatttttgtataacatgatgtgaaggctacataatttgtgggctatggctaataatcaagagagacaataacagataaggaagaatgctcgtaagggacctaggaatccagatctagctaacatgacaaaggaagctgtcatatcaacctcaaagttggtggttgcatgatagtaacaaataaatgggaaatcgaacaacagaacaaagtatgctttcatcttagtagggacctgagggcagctgcagaatgcagagagcccaaggtaaaactgaccgcagcttaagtttttgtttaaggtaaatatatacgctcatagaaacataaatgggaatgaatatttaaaattaagtaacaaaaaatgataggaccccatgttatacttgttaatatttaaagcaaaatgggaaccacaaattcaaacttttacccaagacaaaaaaaaaagtttgcttaccatcaagatagtctctccaagagactttccaccatacttcgttgccctatgccactcaaagattctgattttataatcgcatttgatacaacaatgacattacttggagaaggtgcattaacctacaaggacattagcgatttatattttttccaaagaaacaaagataaagaggatacataaaagagtgatataatcaagacatatacccacactcggccattcaggccaacagcaatctcaaatgaaagtttttttccaagggcctctagaattggacatgtcggagaacttaacaacctacaagcaacaatttacaaaatataagaaaataatgcaactgcattgaagaatgctagtatgtaatgtccttacattcgcgacaggccagtagacgtgtcaaacatatagccatcttttagttgaccaaattcggctgctttcccagtagctgtaaaatacaagccacagcaatatattcatattgaagtaacagaactaatgcaataattagacaaattcaaacataacagtatagcctgaaatggtgtcattatgtaaggtcaaatattatcatatagaaaggagtgacagaataacaaaagacgtacttgagtacttctaatggattagtataaaatagaaaatcccaatgctgagttgtaagataatagttttaccatccatgcacgagagctctgggttcatgatgctatttgctttcaccactcgtgcatatattaatgtaccaatctgcaggagaatatcatggggtaaggcacagattgggcctgctgtacatgcctctttagtacaaagacaaaggaggatgaaaagcaacaaatcagtgagttgctgatcaaaatgaaagataggtgttttacaaacaacatatcactttgttgaagttatagatctaagcccatgttactgcatagaacatcagaaaatattggctatataactctaggcagtagcagtttaaaacaaggagaaacctgacatttgcattgtgcaagaacacaattattcaatgaaataaacaatattctcctatacatcataacagactgagttcaccattattttctgaaactaagatgatagctattcaaactaagataatttcaagtatatctactaacacaaaatcatggtatatagaccacctaaagtaagaaaaatgttctcaaagctggcaatcaataaaagcaggataccacagtgaacttcatgacaaaaacctatgaaagaattgagttggggaaacaaaatcaacaaccattgatgaatgatgatgacccattagtcactgccatacctcgaactttggaatatttctcctggtaccaccttcaaatgcaagaactggtaaaaaggccaaattaggaccttttatatccaccaagaagttctgtaatgacagaatccagctcagcaaagaggtaagaatatatcatatgaggtgcatcgtgatgcctcatttaatgacaaaactaaaagcaagattttagacagttagtggaagtccatatcagttcatgtagtatatttgaaatgtacagaacagtgattgtatcaaaacaattaggtccacatactaaaaaatgcaccatatagaagaattaatttacataaatatacataaatgtacttacatctggtttggtgtcaaccacaacaccaagaactgtatcttctacagaaggtatatactgcaaaagaaataagaataaaagccagtgaacaggctaagcgctgaaggacaaagagagtaaagaactatgtgaaatccccattctacctttgagaagatataaaggctaaaaacatggcaagcataacccattccacatgggaaacaaatcataacattaaactggaaataaactcaggatggcacacgcatatgccatctacctaaccaatttgcatactgtgtcaaaggtaatatagtgggaatagcaacataattatctttctgttcaatcatgaaacattaaggaaggggcaaacaaccttctgccgcactaagaaaagcaatacatgggcataaagcagcacgccatacagacacagtgagcgtatttgatcaattcacattctcattagtccttataacgatccatggacccctatatacctctcaagcagacaaagttgacacacatgaggtaaacatttttttttccattgtgttatatatgagatcaaacaggagcgctcaccctcttctgcgagctctcgacccagtatttgctgggcttcgaaagccgtagcctcccagcactggtagcctgtatggtgtcgcaatcctgcaaacaccggggagcactcataagcataacaataaacccttgattaaaccctaatccctaacaatctctcacaaagccccacttgccaccacgaaacgaagttacctgtcgcaggccggcgccgagcttgatggtctggttggtcatctcggcgaggtcgaggacgacgtccccggggacctgggaggcgacggtgatgcgagtgagcgagcccaactccgcagggatagcgagtcggaggtcggggtaaggtaagagggcttgggacgcgtaccacgtggttgtcgacgagggcggagggcggcggcttcctcgattccattgcacggcggcggcggcggcgcgcgggtgggcgggtgcggtggagactggagcggaagagcggaacggacgaacggtgaacgcggcggcggcgcttcggtgcgggcgtctgcttgcctgagagtgcttgctgtggaggagatgggcctagggtaagttggaacacatgctatgggcttggcaggtgatgagtttggcaggagatgggcctagtgatgagtttgggctgggctaatgttgttcacttgcagcccactatttggaccactgagaggacagaataatctattatattattaaaaaaataaaaaaagagcctccacgttctcatggcctagaaattctcacattaatcgaagaaaaagaaaaagcaaagtccatatagaaatacaatttagaaatagttgaaattcggaattaaaaaataaaaaatattagaagaggagactagagtccatatagaaatacaatttagaaatagctgaaatttggaattaaaaaaaggaatattagaagaggaggctagagtccatatagaaatacaattaggaaataactgaaattcagaattaaaaataaggaatattagaagtagagtatagagtccatagaaatacaattaggaaataactgaaatttggaattaaaaataatgaatattaaaagtagagtatagagtccatatagaaatacaattaggaaataatagaaatttgaaattaaaaataaggaatattagaagtagagtatagagtctatgtagaaatacaattaagaaaaaaaatagaaattcagaattaaaaaaataagaaatattagaaatagagtacagagtcatataggaatttaaaactaactaaaatttggaataaacataataaaattaaaagtagagtttagactccgtataaaaatacaatttacaaataactaaaattcaaaattaataaaaacatgggaagaagagtttaaggtcaatatgagaatataaatatatggatacattttagaactaactaaaattcgaaattaaaaattaaagaatattgaaagataagtttagagtccacgtagaaatacaattagaaataataaaaattcagaaataaaaataaataatattggaagaagagcatagagtctatatagaaatacaaaaaattcgaaattaaaaaaaaagaaatattaaaagacgagtctagagtccatatatgtcggtgacatgggaccgggagtatcatgactcgaggcttgaggcagacacaatcgcccacgtggcctggcaccctcggggacgtcgggcccgagggtgatgtgtgcgcccacctcttggtcttcccgaggggggggggggaccactccagcctcgcccccgaggggcgaggcgccccgacccctcgcgttttctactccacgtgtatgggttaggtgagcacagcagggctcacctaaccgcatttattgcgcctcggctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctgagccgacgtgtggtggacaagaatgaccgatttgtgaccggtctgacactgctcatgtcgtcagcacacagccaccttcccacgacgtgcccgcctcaggcagaagtggaggtaggtatgtgccgtcccgtcaggaggatgttcggaggacgaccgtgcaaatctccgtccatttatgaaaagagaaaaagtccagtttggaaagggaggggtgcatgtggtatccccttgaagtataaaaggaggaccttgcccatagagaaagaggttgattctttccagattcagagcctagaacgagggagaggtcggctcacactttgtagctccttcatacacagatccaccaaaacacaggagtagggtattacgcttctcagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagcgtgtgttttctgagctctcgtactcctccgtgggcgccaagcttttcttgttcagcctaatggccgagcaagcaaaggtgcacgacctctctccgagtgtgagcggcgacgacggggagccgaatccacgccgtcgagctcgtactccaccgccccctcctcgccaaagtcctaagcagggggaggcgctcgaaagggtcgaaagatccgcggcttcaccgatcgcgggcgatggaggagaacggcgagatggggagcgtcgcctcctcgtctacggcgacggcagcacgccccagggcgcgctccaagctgcgggcgcgctcttacgtcacccgcctgtcgtccctgacccggaatctccagcccaacgatggctggacgacgtggccaaattggtcatgacggcgcggcagcgcctagatgctggtgggcggtcctccgccaccaagacctctggtgctgctaccactggctccgcgtcgtcaagacgaagggcacgacgagcagcagccgctgttcgccgttcggtagccactccctcatcgactccttcgacccgagaagatctgcgtagggagcagggcgcccgcgccagcctcgagcgccggcgtaatgaccgaagtactccccgcgcaacggagggcgcctcttcgtccagagtatcacctcgacatggacgtgaggaccagccctccgtgcccccggctggtggtatcggctgtagagcctttgtggcgagtcttcggaatgtccgttggcccctaaggttccgtcccaccatcaccgagaagtatgatgggagtgtcaaccccaccgagtttctccaggtctacacgaccgggattgaggccgccgggggtgacgacagggtcatggcgaatttctttcccatggccctgaaggggcaagcacggggttggctaatgaacttgccacccgcgtctgtccactcctgggaggatttgtgccagcagttcaccatgaacttccaaggcacgtatccgcgccccggtgaggaagcggacttgcacgctgtacagcgaagggacgatgagtcgcttcgatcgtacattcagcggttttgtcaagtccgcaataccataccatgcatccctgcacacgcagtaatctacgcgttcagggggggtgtgcggcacaaccgcatgctcgaaaagatcgcctccaaagagccccagactaccgcagagctttttcagctcgcggaccgagtggctcgcaaggaggaggcctggacttggaacccctccggttccggagtggcagcttcggccgcccccggatccgccgctcagtcagggcggcgtgataggagaaggaagaagaggtcagtccgttccgacgacgagggtcatgtcctcgccgtcgagggcgcttcacgggccacccgaaaggggaggcctgcgagcgacaaaaagaaggaggccagcgttcccagcagggagcgccctaccggcaagtggtgcaccgtccacaacacctccctccatgaccttgcggactgtcgcgcagtcaaaagcttggctgagcggacaaggaagtgggaggaggagaggaggcaggagcgccgggaaggcaagtccccggcggttccttccggccgtcggcgaagtgaggccaagcagaaggcccccgccgaggacatcgatgatggcgataatgacctaggtttccaagagcctggggctaccatagccactgtcgatggaggagcgtgtgcgcacgtttctcgccggagcctcaaggccatgaagcgagagctttctgccggtgcccctactcatgaagcgaccgcgccggcgcggtggttggaagttgccctcacttttgac

SEQ ID NO: 487 - DNA, 2919 bp, Oryza sativa
gtcttcgcatgaagaccggcgaatatgcccggggtccccaggaaggtgattgagcaccgtctccccgtacggccggggtcaaggccggtccggcaaaaagtgcggcggcaggccccggaacgtcaagccttcatccgcgaggaggtggcgcgacttctgaaggccggattcatccgcgaggtcatccacccggagtggctggcgaacccggtggtcgttcccaaggcgaacggcaagcttcggatgtgcatcgactacaccgaccttaacaaggcatgtcctaaggatccttaccccttgcctcgcatagatcagattgtcgactccacagcggggtgcgaccttttgtgttttctagatgcatactctggttaccatcagattcgcatggctagggaggatgaggaaaaaactgcgttcattactcccataggaacttattgttatacgacaatgccctttgggttaaagaatgcaggtcctacttttcaacgtactactcgaatttctttgggtagccaattaggacgtaatgttgaggcttatgtcgatgacttggttgtaaaaacgcgcaaccaggaaacgttgctttcagatttagcggaaacttttgagagcctccgctccgcccgcataaaattgaaccccgataagtgtgtgtttggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccctaagtcggttcatatcgaagctgggagagaaggcgctacccttatttaagctcctcaagcgctccgggccgtttacttggacggaggaagctgaacgcgccctcactcaattgaaagcatatctcagctctcctccggttctagtcgccccggagccaaacgagcccctactactctacttagcggcgaccccccaagtagttagtgcagcgttagttgtggagcgcgatgagggcaatcctcattccgcgcacccccgccctgtgctgacttggcccgggagcgagcagggaggagaggcccccgagccgaacggaggcctaaggcccctgacgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggagggagcagggagaagaggcccccgagccgaacggtggcctaaggcccctgacgaccagagttggccctttgcccgtttgtccgacgacgccaggagcccccgacccccagaacggccccgaggccactgtgggaaggccgcccctgtcgtcctccgaccccgaggtcatcggcacagaagacgagtgcgccccgaggggccacttggacgaggagcgccccggggatatggcccctagcgaaggggatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcaccgtggttacgtcttaccccctcggtcaaatcttgcataatcgggagggtacaggacgggtggtaaaatgggcaatcgagctttctgagtttgatttacactttgaaccacgtcacgcaatcaagagccaggccctcgccgattttgtggcagagtggaccccggctccagagaccatttcagtctctgaagccagctcagacccctcgctgttgcctcacgccgcccactgggtgatgcagttcgacggctcattgtctcttcagggcgccggcgcggggatcacgttgacctctccgaacggagacgtcctcaaatacttggtccgcctcgactttcgagcgaccaataatatggcagagtacgagggactccttgccggactcagagtggcagctggactggggatccgccgtctcttggtgttaggcgattcccagctagtcgttaaccaagtctgtaaggagtaccggtgctctgacccgcaaatggacgcttacgtacgccaagtgcggcgtatggagcgccattttgacgggatagagcttcggcatgtgcccagacgggataacatgattgccgacgaactctcacggctcgcgtcctcgcgagcccaaaccccaccgggcgcctttgaagaaaggcttacccagccgtcggcgcgacccgaccccttaggggagacggatgcgcctgaccggcccccgaggcccgtcggagtccaggcctcgggacccgaggggagcgctcccagctcccttagattgattgcttggatctctgagatccaagcatacctcacagataagactctacctgaggaccgcgaagggagtgaacgcgtccaacgcatttccaaacgctacgtgctggtagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaagcttttcgtcaagggttctattggccgacagctctcaatgatgcagtcgatctggtccggcgatgcagagcgtgttaatttcacgccaagcaaatccattagccgggccaagccctgcagaccataccacttttgtggccatttgctgtctggggactcgatatcctgggaccgttaagcgggccccgggcgggttgagtatttgtatgtcgcgatcgacaagtt

SEQ ID NO: 488 - DNA, 13649 bp, Oryza sativa
ggcgtgctgaattgagcaagctttcaccaatgtggaagggtccgtatcgagtggtcggcgttccccgaccgggctcaatacgactggccacgggcgacggcattaagctgcctaacccgtgaacatcgaacaccttcgttgcttctacccctgagggggggggtcgggtgtcaggtttcgggctcgggccaaccccgcaccccctcgggcgtgcaagggttggccgggggctgccacacatgcacattcttatttctcttatttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggggaatcggcaaaaacccacaatcgggtcacccataaccctcggtcaccacgttcccggcctggccagtctcgacatgtggatctccccaggcactagccctgacccgcgccttttgaggactgggacctgggcacgaacccttaatcaagctaagacacaaaaggaccacggcacagatcatcctcatctcatacacacagcaagatgaaattgacacaaaaatttcttcatttttgattacagattaagttgatctatacaaaaaagaggcccgaaggccttagaagaaagaaaagaagaaaaaactgaagaatggtgggggtctgggggctcaatccgatgcgcccgggtcgccggcctcgtcgtcactgtcgtctgcaccaccggcattgccctcctcgtcggagttgggggcgaacgcgagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcaaggatgacttaattgtcttctcgagctcctcgggagccgttggagagccccggccatcttcgagaggcgctgggcgagacctccctggttggcggcgtactttacggtctgccctctccagaggcccacttgccgaccggcgcgatctaggcgggagacggcgtcccaaagcatgccgggccctacctcgcctgccaagcgaagggcttcgacctcctcggcggacgagtctagcgcgccctgcagatcggcgatggtgtgttcggcagccgcgaggcgggcggctaagtcgctttcgcccgcggccgccccgccgctgcgcgccctcgcgtccagctccttcgcccgcgcctcgagctcagcggcccgttggttcagtgcggccctctcggcgcgggcaccttccagattacggcgcgcctgctcctcctgcgctgcctcgcggagggacaggctgtccgccagctgttgcgccgcggcctcggccccctcgagagctcgctcccgctcggtgagcgcgtcctcgcggaggcggagcgcggactcttcttcggcgcaggcagcctcgtgcgccgccagcgttgcttcccggatggtgacggcggcctcgcggtccgccagatccctctccacgacgcaggcgctcttccagcgccatggcgcgcgcctcaagggcctcttcgcgccgccgggacgccgcttcggtctccgccgcccgctgttctcgggcagcggcagcgtcaagcacctcctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcagggcctccacctgggcacttaacccatccaacaccgtggtgtttgcgacggccaaggcctgcagaaggggctctgcgttcagtggggcgatagaaggcgtggggaagagccgccttggagaggatgccacgcggctcgggccgccgatggaagtgccggactcggggatgttccccggacccggttggtcctgagcgtcgcccgagggagtgggcccaagcgacgtgcccgcagcctcgttgccagctgccccggaagttgtcgcctgagcgtcgcccgagggagtgggcccaagcgacgcgcccgcggcctcgtcgcgagctgcctcggaagtcgccatcgcctcgtcctggcgaaatccggctttctcccgagcggcttcctcggcctggcgggctcgggcggcctcctcccgagcggcttcctcggcctggcgggcccgggcggcctcctcccgagcggtttcctcggcctggcgagcccgggcggcctcctgggcagcctcctcggcttcccgtaggcgatccgcggcctctcgccggtcagattcccgcctccgggcctctgcggccgccggatcctcggcctcagactggccgagcttggaatggcgggagggacgcgacgggatctcgctgaaacaaaagaaaagaccagatgacgaacaagatgggtgagtgaaaactcgcgttgaaagaatgaatacagccacgatgggtgagagacgaacctgcgagggggtcggttaaacgaccactttggaggggaaatgaggtttccccgagatggttctgtctcccccatcttgcggggccgcttcttcttgcgctcccccttgggctgcgatgtcggcgcggccccctccgggcgcctgctgctggcacgcgccgccccgccccctcggggaggagatgggggaggtgatcctccctgcttcctcttcccccgggcatcggcagggcggctgctccccgggcccctgtcgcgggacccagaagcacgaccccctcccggggtagattgttcccccttgcggctcccgcctgcgccgtcgtggccctttggagctcgctcctctgaggccccgaccgctatcataatggtcaggatgaaggcgcggtctggatcgctgcagaggggaaggattccttggggaatgaggaacgcctccacggagttgagattcagcacccgttggaccaatatcttgaagtcctcaggagcccagtcccatctcactccctggtgggtcctcatgaggtcttcggacccggtgtactcccaggcgccccgagcgcgccgctggagcggcgcaatccgacgacggaggtagtcgccgtacaccatggcccctgtgagcccctgggatcgcaggcccgccagacggtcgaggacggcgtcatagccatcccccagatctaccggcgcccgccagctggaagcctgtgccgggggctggctcggaagtcggaggcgcgcttcgtcggcgaggggggtgtagaaccagtcgctcttccagtcgtcccacttcttgcggagggcgcaggggatgtagcggttcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccagtatcatcaccgcgttgggggtgaggtgcgccatctagagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcgacgcggcagcccagcctgcctctcgctcacgatgcgggaaggcggcagcacgctaccatcgagcagagcggagccccatgccatggcgccggaggaagaggagattaagagcgagtgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgcttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgtcatgtccagattcgtgtgctactcaagtaatgtggcagtcttgaagagaccgctcattattgacagccgagttaccattgccgatgtgcgtgatttgtgaccgttgggtttctgcccaattgtggagaccggtcccacctgtcaccaggccttaggagtggcgtcacgcccgaccgcttcccttgaggagggcgatcgccctggcataacgccgggggctactgtcggtgacatgggaccgggggtatcatgactaaaggcttgaggcagacacaatcgcccacgtggcctggcaccctcgggggacgtcgggcccgagggtgatgtgttcgccctcctcttagtccccccgagggggtcgggccgcacccgcctcggccccgagggccgaggcgccccgacccctcgtgggtttttgctccgcgtgtatgggttaggtgagcacagtagggctcacctaaccacatttattgcggtttggctgagcgtgtcacgccgcatgtaacgcagtgcagtgcactcatttatccggtctgtgaccagtcacagaccggtcaggtcgtgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggattcatcctaaccattacaggcaagatgttgtgtgaagaagggcgaacatgcagattgttaaactgacacgttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaattaaataaacggcgcagacggctccactccacaggcagcttgaccaaggctacacctaatcctccacaccatcagcctcaatgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttataatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacaattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaaattgaattatgacgcaataatgaattatttttgaaaaggaaaaggggatttattgcgtcagcggctagggtttgggtggaccgggcgcacgggcggcggttcacgcgaacggacggccgagattgatccgatccaaatcggacggccgagattgatcgggtccacggcggttcacggcggacggccttgatgacgccagcaatgacgtcaccgacggcggcggcggctcggcgaggcagacgactcgagcggcgcacgctcaccggcgaacggcggcgctacggcacgaacggaggacaccaacgggtagcggacggcacggcgaactcaccgacgaccaaagcgacggcggacgaccaacggacggcgacggcgacgaggttgaaacggcggcggtcttcggcttgacgacggcgacgatgctccggcggtctccgacggcagcgaaagagcggacgaggacggcgacgacttggcgacgacgacggcgaccttcccgagcgacggcgacggctggaacgacggcggcgcacggctggagcggcggcggcgaaggcaaagctagggcacacggcgctagggctactccggcgacgagaggcgaaggcgagggtggcggcgagaagagaagagcacggggatccttttaaaggggctcgggggcggcggcgaaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccggagatcatttcccctctatcaattcagccggaaacggaaaggagcggccggattggaaagcggcggcgacggcagctcggcggcgcgaaactagggtttcggcccgagaaagacgacgggcctgacaggtgggacccacctgtcagcggctgcgagggcgcgcgcgcgcgggcggctgcggactgggccggactgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatatattttgaattttcagggtgtgacaaacctaccccccttaaacagaatctcgtcctcgagattcggaagaactgacaaacagatacggatgagctgacttcaattcatcttctcgttcccaagttgattcttcttccgagtgattactccactggactttgcaaaatcggataactcgattcctggtccttctctcacttgtttccaagatacggatcggtttctccacataggtcaaatcctcttggacttctatctgttcaagattagcttcttcggtaggtacccttaaacacttcttcaattgcgacacatggaacacattatggactcctgccaaagattgaggtaactctaactgataagcaacctctcctcttctactgacaatcttataaggtcccacaaaacgcggtgccaattttcctttggtctgaaaacgatgaactcctcgtagaggcgtgacacgaagatacacataatctccttcttcaaaactcaaatctctgcggcgattgtcggcataactcttatgacgagattgagccactcgcaatctttcctgaatgatctttaccttttcttctgcttcccttaggatatctgtcccgaaaacctgacgttctcccgtttgatcccacaaaagcggagtgcggcacttccgaccatacagtgcttcgtacggagccatctgaagactagcttgataactgttgttgtacgaaaattctgcataaggtagattcttatcccaacttccaccgaaatctaaagcacaagctctcaacatgtcttccaaaatttgattcaccctttcagtttgtccgtctgtctgcggatgataagcagtactaaagttcagcttagaacccatctcttcttgaagtttcttccaaaaatttgaagtaaactgactgcctcgatcagacactatcttcttagggacaccatgcaaacacacaatccttgccatatacaattccgccaagcgactaccggaataggttgtctttaccggaataaaatgagccactttggtaagtctgtcgactatcacccaaatagagtcatggcccgatgacgttctgggcaaaccagtgataaaatccatacctatttcttcccatttccattcaggaatcttcaaaggttgcaacaaaccggcgggtttctgatgttctgccttgactcgctgacaaacatcacatactgctacgtattctgcgatttcacgcttcatacttacccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacctgatcaattagagtgggcttcgcttctaaggctgcaatgaaacctctaccgacaattcccaaatttaatctttcaaattccttgcataattccaatggcaactgtcgtccttctgtaacattgcaatagctttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagatgcataggcaaccaccttcccatcttgcattagaacacaacctaacccaagtttggatgcatcacaatacacttgaaaacccttctttggatccggcaaaatcaaaattggagctgatattaagcgacttttcaactcttgaaaactccgctcacattcttccgaccacttgtacttcacatctttctgaagcagtcgtgtcatgggcttagcaatcttggaaaaattctctataaacctccgataatatcctgcaaggcctaggaaactgcgaatctctgaaactgtctttggttgcttccaattggttacggattccacgttactaggatcgacggcaactcctccggctgagatgacgtgaccaaggagtttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggctcctttaagctgatcaaacaaatcatcaattctgggcagcggatacttattcttgattgtcacatcgtttagtgcacgataatccacacacattctctgggtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtccttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagccgcgacatgatttacacgagccttggatgctggtacagcagagttattctgggcagggacaaccttcacgcgtcggggcttcggacacttgtcagcataatgtcctggatctccacagttgaaacacaccacgggcttgttgccttgctccctcttggcaggttgttgctgtgctggaactgcaacaggacgtggagcttgattacggatattgttgccagcattgttgttgaagaactgacgttgcggacgaacaacagacgaagaacatccctgtggcatggactggggtcctaaagtaaggcgcggcttctgattatttccctgttgtgtcttgaattgagcaatccgacgtttcttctgctccatgcgattgtacttgtcctcctgacgaatagccttatccactaatttctggaaatcaggataatctccaaccataagtgggtaagaaagctcatcattaagtcctcccaaaaacttctcctggcgttcttcatcattgcgcacatcttccggagcataacgagcaagacgattgaactcgtgcagatactccgtaacagagcgagatccctgagtaagcgacctgaactccttcttcttgagagacactactcccgatggtatatgcgtcttccgaaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattattcccttggttttgctgattctgaaattgctgcatcatcatgtgcattaactgagtctgttgagcaagaacttgagcaagggttggattctctccattgttgttgttattggggttgttgaggttaggaccattcccgttgctgcgagtgttcaccatctggcatggacaggataagaagagaaaacgggggaaactacttaggacagagaattactttaacttttattgatcttaactgagtttcattattacaaactgaagactctcacaccactaaactcaccaacttcctaacactcagaagcaaacaaacgcatgcacttacatcccaccactgatgtaaataacatgcaagacccacacacacaaacaaacttaaaacaagcaaactaacacaacgatctaagacaacgacttaacaagtcactctagttcttccgagcataggaggtcgattgaaggctcgttcggctcatcttcctcatctttgatagctacccactcaaacttggaattgttgcgcttgggttcttcttcttcatcactacttatgatgatgacgggaggatttgctggggcaacttctttctccaccacgcggatctttggcgccaattgataacgagggacaaacaaagctctcttccttgcggtgagacgaatcctggccttctgcggcggtgcttctcccttcaatgcggctaattccttctccaagcgatccaccttgtcttctagcttgcaaatcttaccacgattccgatcttcacgatcttgagctgctaacacagtctccgcacgactttcatccatagcccacagcatctcacccaaatgccttgtagtagcatcattctcaattccttcagtctcaaggtaactgccacggtcacttccctgtggttgacgaggatggtagcgatactcagtgtcggccaactgatcactgtagcgatcacggagctctcttatggcgatccttgccacttcctgacatgcatggatataatttcttcctccagcttcgaacatcactgatggaatatcttcactattgctgtttaaggtgactttgacacggcacctcttttcatgacgatcatgacgaatctgggcataaaaagggccagtcccaaatc

SEQ ID NO: 489 - DNA, 1132 bp, Oryza sativa
acacctgtgcgagatgttcattggggtgcgcccatctcttcggctgttccggtggttcttcaccgtgcagtcggtgtcgccgccgtcggtggttggtggctgctatttcctgccgcgggggccggtgttgaactgctacatcccctgcgtcctccgtaaaaagtgggatgactggaagagcgactggttctacacccccctcgccgacgaagcgcatctccgacttccgagccagcccccggcgcaggcccccagctggcgggcgccggtagatctgggggatggctatgacgccgtcctcgaccgcctcgcgggcctgcgatcccaggggctcaccggggccatggtgtacggcgactacctccgtcgtcggattgcgccgctccagcggcgcgctcgggccgcctgggagtacaccgggtccgaagactacatgcggacccaccagggagtcagatgggattgggcccccgaggacttcaagatactggtccaacgggtgctaaatctcaactccgtggaggcgtccctcatcccccacggtatcctccccctctgcagcgacccagatcgcgcctccatcttgaccattatgacggcggtcggggcctcagaggagcaggctcctaagggccatgacggcgcaggtgggagccgccggggggatcaatctacccccggagggggtcgtgcttctgggccccgcgtcgggggctcggggggcaaccgccctaccgacgcccgggggaagaggaaactgggaggaacacctccctcatctcctccccgagggggcggggcggtgcgtgccggcagcaggcgcccggagggggccgtgccaacatcgcagcccgagggggagcgcaagaagaagcggctgcgcaagatgggggagacagaaccatcccggggaaacctaatttcccctccaaggtggtcatttaaccgaccccctcgcaggttcgtcccacgctcattgcgaccgtcttttcttctatcccaaaagcaagttttctcttacccatcttgtttgccttctggttttcctttctgcttcagtgatatcccatcgcgttcctcccaccatctcaagtccggccagtccgaggccgaagatccggcggccgcagag

SEQ ID NO: 490 - DNA, 831 bp, Oryza sativa
atgcgcctgaccggcccccgaggcccgtcggagtccaggcctcgggacccgaaagggaagtgctccaagctccctagattgattgctggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaagttcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggtcaagtggagcgcgccaatgcggaaatcctcaaaggccttaaaaccaagactttcaacatactcaaga

SEQ ID NO: 491 - DNA, 424 bp, Oryza sativa
caagcccccggcgccacccctctctctcgggccgtaggaaggtcggcgcgcacggcggcgggtcgacatggccgtggccaccgccatcgccgcaccgcgcccgagctcctcgtcgtcgtcttcaacctagggccgtcggtctctctctctctcacccctctcgctcgggccatcgggaggtcggcgcgcacggcggcgggtcgacatggccgtggccaccgccatcgccgccaccgcgcccgagctcgcagtcgtcgtcttcaacctccaacctcatccgcccctctttggaggccgccggtcagtatccgccgccctctccttgcttggctctcccgacggcaccagagagagagagagaacgagggagagagagagacgaccaccgtctccaatgtcctcggcgctgcacgccgcccgtctc

SEQ ID NO: 492 - DNA, 8099 bp, Oryza sativa
cacagccaccttcccacgacgtgcccgcctcaggcagaagtggaggtaggtatgtgccgtccgtcaggaggatgttcggaggacgaccgtgcaaatctccgtccatttatgaaaagagaaaaagtccagtttggaaagggaggggtgcatgtggtatccccttgaagtataaaaggaggaccttgcccatagagaaagaggttgattctttccagattcagagcctagaacgagggagaggtcggctcacactttgtagctccttcatacacagatccaccaaaacacaggagtagggtattacgcttctcagcggcccgaacctgtatacatcgcccgtgtctcgcgtttcttcatagctggcgatctttccacataccgagagagcttgagatttcaccctaagcccccggccgaaccggcaaaggggggcctgtgcggtctcccggtgaggagccacgagctccgtcaatataggaacatatataatttacaaataactaaaatttaatattaaaaataattaataactaacacatatataaaatataatatgaaaattcagaaataaaaataaataatattggaagaagagtatagagtctatatagaaatacaatttacagaaaattcggaattaagaaaaaaaatattaaaagacgagtctagagtccatatagaaatatatataatttacaaataactaaaatttgatattaaaaataatttaatactaccacacatataaaatataatatgaatattacacattagtagtttgtaaggttattgcaaaatttaaaattatgttgtcattttaatatatttgaataatataatgagaaaacatatatgctattatatgagagaaaatataatgatgcctaccatgctagttagtagtaaatacggacaccggtaacaagtttagaacttataccaagtagattaattcttctacaaggaatctaggagagaataattagcagtaaatatggacacctgtaacaagtttagaacttacacccaagtagattaattctactacaaggaatctaggagagaataattagtagtaaatacggacacccgtaacaagtttagaacttatacccaagtagattaattctactacaagaaatctaactagttgaactatcttcactttggcaaagattatcaagtttgcaaatggctttgtagtgttagtgctaacttgcgtccttgcgattttgtatcgcgagtcatggctgactaacaagaggatgactctttgttatgttcatcagtctattcagaagttcatagctgagcctcaatagaatggaatttgctgcctatacctgacaaaatctatttagctgatagactcctgaccatctaatagaacagataatgcatccgtagagtacatgaccataaaaacagtcaatcaataccagtaaaagtcgcatccttgaatgatttgctctacagaatttttattacagaaccgattggtccccaaggcccaactgccattacacgctcttaaaaagatcaccgtgtattcccatttcggagtccaatatcgttgccacaattctacaaacaagaagcaacaatcaaggttggcttgaccaagatacatctagcagactagcacatagtacttacaacaagtaatgtacaatgggtttaaaaaaccgagctgaagacatgatacgctgagattatggagctaaaaccaagagcaacgaaagctaagaatgccatggaggctgaagcattgataagtttggcaaattgatccactccaaaccgagacacccaaacatcattgcgagaaagtgctgctgaagatgctgacaacaggaggtaagccaatatctgcaatgaacatatataaatagtcatgcaacgaaatcctatcccatgcatacagttctcagccaagatgccaatatgtgcagaacctcagagataaatgttaggacaatgccaaacaggaagttagagaacaagtgcagcataactccagctgatgagatatagcttatatcaaaggaaggacagaagaatgaagtgtacaacttgatctacaaactctatgcgcctggcacgatagaaccagcaacatctgatctacaaactctacgcgcctggcacgatagaaccagcaacatctgaactaaggataaagtgcacaacataatctacaaattttacgcgcctgcaccagaagcatctgaattccacatttttttaggcaaattatatgattgacttgacaggtacatgaaaattttcttacattgcaaacagcactgtgataatgaactgtaaaattgagtcctcgattcaagattgaatatgtcgtagagaaaaatgatcaactataacataaagttcatgaacaaccaaagtccatcccctgcatgcagcttacagcttactttaccccaattcatacaacttaagaattaagataatctaatcctgcaaaaagttgaccactgtctcggaatccaagcttacaacaatttgtaaccatagaccaatcagcaacagattaaagctcacacataatatgaaaccgaaaggacagaaaatacattcagagctgaagttcttgcctgatccattgcgagattgaagtacttccctgatgggtctcgaattatacgtctccccgtgacaaagtagtgcacttccacgaccaactggaaccccgagtaagtaaaagccaacacactcgcagaaagtgtatacctgcattgcagaagcacacaacttccatcaataacagaagctggccgccagagggggatttggcaagcatcatggtacggcgttgagagcgcaacctgtactcgttgtagcggcggaaggagtcaccggaccagcccggcgtggtatcggcggccatgacggagagcgagaccaagcagaagacggcggccaaaaccctgaaccctagctcggccctcctgagctccgaccgccgcaccttctctgggacgccgccaagaagccatctcttagaccccacgccttcttctccaccaccgccgccgccgccgactgatgcgacggcggcggtggtggtggttgctgctggtgcggccttctcgggcaccggcttcgtctccgtccccgcgtggtcctcgccggagaggagcttggcaatggtcagggcagactccttctgcggcgatccggttggggactccgccgcttccgcggccttcggcggcgtcggcggcatcgccttctccgtctccgtctccgccagcgcaagggcaagcgtcatgttctccggttctccatccgcttccgacgcctcccgctccagcatggattccggggaccccggtgctgggggagaaggcggcagtgatggtggtggagaaggcggtgctggttgatcgggagcgggagcgggagggggcgccgcccgcggctgtggagttcggttgtcgtgggggaggggaggagacggatcggcggtgggaggagggggcggtgccggggcctgcgaaggaatggggcgagagggatcgccggagtgatttggtgacggagtagtaggggcggcggcggaggcaggaaggggaggaggaggaggggttggattttggggtgagatgggagggggatcggttgccgggtgcggggtgggagggggagggtgggattgggcatcatcgccatcggtggccggctccggcggcggcgagtggattggggaggccattgctagtttgctcgatggttgttgaggtcgctgcttcggttggtgttcagttcagtgtagtagcccacactggtcggcagtagtgagaagaatcggggaaagggaagtggggaggtggtcaggtggactaggtttctcaagggaaatggacgtacgagtacgagagcagatttaaggccccctttgatctgtagaaaaagtgtaggaaatttgaagtatttcaatcctatggaaaaaatttctatgaaagcctttgaaacaaaggattgaatcatatactatcctttaaaattcctatggaatggctaatcctatagagattttggaggaaagttagcaagaggtccaacctcttggaaaaattcctttgagtctatctctctcatccgattcctgcgttttttctgtggtctaatcaaacggtcattcctgtgtttttcctgtattttccaatcctttgttttacacctgcattcctgtcagaatcctacgtttttcctattcctccgtttttccattcctgcgattcaaaggggccctaatagtatagccaattcatgtgacgcgcttacggatccggaccgatccggggctagggaaatcccacgtcatacgtccgatttacgtgtaaaactaatctaaactgattttttttcttaaattactaattcaaatcatgatccgattacaccattaaattcgttgtaattaaatcttcaaaacaagatcacacatggatatataccgacgaaaaaaatagcttattattgaattatttttaaatattacacgatgttccaccaggtatatcggaattgtttcactaagtagagcgaaaatgtttcactcatttaaatcaggtgttgtttcatcttatataaaaaataatgttttagcaaatagcgaaataatgtttcagttcactgcaacattagatctatacatagtgaaacatcgtgagtacactaggtgaaacatttttctgcggaaaaaaaaataaaccaaattcccttaataggggggttccaaaatatatgggtttttttgttgcaatgaaatgttcgttcactacaacattagacctatacatagtgaaacattgtgagtacactaggtgaaacatttttttttggaaaaaaatgaaccaaattcccttaataatgagtttccaaaatatgtgggttttttgttgaaaaaaatattttaattcactgcaacattgaatctataaatagtgaaatattgtaagtatactaggtgaaacatttttgtagaaaaaaggggagtgggtgggtccaacagtatggacgtgggggagggacgcgcgggggagcgtccgatccggctcccccgcgtcgggcgctcggtaacgagcattatcgcaactactagctccaatttatctatagctcattcatacaatagttacatactatactattataatatatggtcccacctgtcatacacacactgcgtcttgaaatccgtgctatagctagctataaatctgtagcccgctgctcttctctctccttatttatcttcttaaaatatgtttacagctggcttatagcttgtacctgctctgaacaactccttgatgtaaattgtattggacgtatccttgagcgtgatttactagtaataaaggatcagtaaattgaatcgtgaactagagatgagaaaagtgcaagttagtatttgcagccagagtatttcggtagaaacttgacgggtgtttggaaagcgcatgtaaggtttgtcgtctcaaaatcccaatcattacattagccttgcatgaagcattgtccaggtttactaaataagaactaatattcatgttacattggattgcgtattttatagctctattttttaatcacgcactctagtcaagtttttatagtactactatcagattgttcagagtgcaagctcttgacactaaagtgtgctcacctggttggctggttgttgtaccttagcggaatatactctttttctttttcttctaagagggattctaactcaccagagtcaccaagtgtgcaggattaccacaatgtacaccttttcccattggtctgtaagatgaactgtacaaattttagaagggtttatgcaacatgtgaactgcaacagtgaaatattccattataaaagctagagatgtctatgacactctggctcatgttaaggatgggttagtcaaaggtgttgaagtcttgaagaagcatgggcatgcaacgtatacttcctttcaactatgcactgatatagggatatattcatattcttcatgtacagcagatatgaaacctgtatggttgtatgacaagtagtaaattatttgcaacttggtggatttgtacacttgaaaacagtagaggcaggttgtttgtattcaggtatgctggctggatcaacaggtcgaacctcaccgggctgaaagaataggctgctatgcctgcagaaatgataaatgatagagatataaggatatgtttccccccaatcactaatagtgcagagtatacatgagcagcagtgagaaaagtttccactaacaaactccctaacattgttgcactgtgtttaccagaagtcctgcagataaaaacttgcaaaatggagtggaataaaatgaattgctggtttttacctccggaggtctagccctatcaacccagcttgtagaattgacaggttgtcagaatctggtgaaacaatgacaacggtatcccccgagtactgagtctctagtattgacatgagctgcgttacccgaacaaatacatctgcaacactctcatttggtgtaccatcactaataggaggtggcttgatgtctggcgaaatactgtctgatgcatacacctaaatccatagcaagaaagggaaattcaatgagaacaggatggaatttaccaagcaaaaaaatggctgatccataaaccgaagaagcttcagaaaaagaaacatagctcagtcaatatagtgcaaaatctgcaatatcagtactggcgtggaagtgtatattagttcattccctgatttctaaccaagaaagtatatatctatacttatcaaaggtaccaatctcactgcctatttcccagtaacctaaaaccaaacagaataaacttgtatgtttgattcatgaatcatgataaagtgagtacacgaggatatccattcctcaaattagttctaagaatgaacggaacttatatcctatatattacattgttcattgtttgttgagatatttaactagcaggtcgagaatactcctgtctgcgaaaacacttaaacactagtcaaattaacatattctattaatctaatactagtagcagtgctatcaggagccaaagatttttaagcccttcatggcagttggcaaccagtatttcactaattgcatcaattctcaatctagcacccaatgtcacctaaaaccaacatcttcacacaacagtcttgtatcactctgctgtgcgattatattgttaaaatgaccaacggttcttttactagttccggttattgcaacttcgcgttccacgagaaagtggcaaagatgcatcattcgggtgaagaatacctcaggcaatgtttctaggctcttcccttcaaacgcgcccaggccacgcgcatctaagaagctgtactcgggtacaatgtggctacaaatcaagcaaccaacacattaatacatgatcacgaattcacaattcaccggccatactatactactactatactagtgtactcgtgtgaagccgtgggctaagagagtgcgattgaagaaacagagataggcggaggcaggcacctgcggttgatctcgttggcggcggcgatgatctcggcggcctggtaggcgcgctgggtgatggagggccatatccagcagtcgtcctcgcaggcgccgaggcgctgcagctcgagcgcggcgcgggcggcctgccgcaggccggcgggggagaggccgctgtccacggaggtcttggagaccgggttggtgcggacgacgccctgcccctcgtacaccgactcccccgcgcgcaccaagaagtagcggttcgccagccgcggcggcggcatgcggaacagcccgcgcgccgaggccgccgccggggcgagcaacgggagcgggagcgggagcgacgcggatagaagcaggagctcgcgtctgcggggacagggcgagagggcggcgcgcggcggtggcggtggcgatggcgccaccggcgaggacgccgcggtagcgggagaggcggcttgcacttgcattttccttctcctgtacggatccggaggaggaggagctcttgcggtcttgccacctggacgg

SEQ ID NO: 493 - DNA, 20116 bp, Oryza sativa
agcgcgtcgggataagaatttataaactttattaaaactggtcgaaactcgaaaataatgaaaatgaaaaacggaagtagtgtaatttgaaattttaaattaaaccaaattttaatttactccggtagagtaacatcagatgtaactacggatttgtctatgctcatccttgtccattgttaggtttgcgaatcaaatttgctaccaccatacaagtatacatcacccgatacatcttgagacgaatttcaaacaattagcgtattatttttttaataaatatagtatataacttttggcctttgcaccaactaaaagtgcacagaactcatatttagagacaccgatacatgttttgtgaaaattaacattgactcgtatggttataatatggaaacataactaataaactctgtattaattcaaatatgcttatcaaatccagttattattgaagggagaagtgtgagaggggccatgatagatgaagattaagattatgtaaagcacataaaacaagaaagacattagcatatagctaattaagttttaattattataaacttattttagagcaactttcaaatagaatttttttttcacaaacgtaccatttagcagtttgaaaaacatgctaatggaagccgagatagaatctactccatctgtcccagtatactcgacgttctagcatagttgagccaaatcaagcctaggtgaaaattaccatatagccctaagggtatgctcaggccctgtttagttccaaagtttttttttcaaacttccaactttccatcacatcaaatatttcatacacacacaacttttctatcatatcgtaccaatttcaaccaaactttcaaacttcagtatgaactaaacacaacctcaatgtataatgtctacttgggtaataaggtaggacccaatattagtatatggtaagagaatgcattagcctggattccactgtcccactcgaatatatggcatgtgagagagaagaggagagagaagataaagtattattactttatttttatgggtagacattatgcatatggctagctcatcttaaagactaatatatggactactatcacaatgtataaagggccactttagaggcttaagacccccttctattgctacattatggctgccctaactggagtactagttactttaaatagccatgatgagtagtcattttagataaaaatacaccggccgttcctgccacggtggaatcatggacgagctgatgttcctgattacccggttagtaaaatttgaatcgtactctgctgcgcctgtctcatgtttatgctccttactaaaacgtcaagcattgtgggtcaatggaccacaagaagtaaaacgtcaaatatattgggaaggaggaagtacatcttattgagtagggtgtaagtgtaactgcgtcctctctaagtccaaaaggacaatttctaaggatgaatgcactcatctaaatttgaagtggtttttaactttgtatagtacggatggtgcaagtggataaatataaacaggtgctaattaaaattaagaattttgaaagcaattagagtaatactagtactacctgccaaaaggcgccccaacattgtggctttgcaatcaggcgtgacacggcacgtgccaatggtcaaacaggacgtgaacacatcattttgttgagcccagggcccagcaagccaagagcgtactgtacgttagataagatgggtcaaactctcgtctgacaacgtgattcgctcgctctgttctctgatctcccgcaagctacagtgccaacccaaaaagcaaaactaccccctaccgaagtctaccaaaaagtagtacggttctctgatatctttcattatttttgaaatttgaattactactcctcctacagctaaatttttttttctcgcattggagtgagagaacagaactagtatttgggttaggttgtttctgtttcgtaaatttcttatacattggaaaatatttggatgggcgcccttcggtttgaattgcgaaggaatttgtgagctttatgtccaggcgttcagctgtccaagcctttatgtacgggggccacctgcccgttgcgcctcatcctcctcaatcaccgttcgactcgctgcttcccctcttcttctcccccaaaccaaaaccctcttgacccttgtcgtctccgcaccgcagccgccgcaggcgaggcgatccacatggcggcggccgacaccgacacgtacgtcaccgaggtggccttcggcgacgccgtgatcaccaccaccgtgacgtcctccggcgccgccgtggaggggtggctccgggaggtccgcgccgcgtacggccccgggctcatcgtggggctcgacgtcgagtggcgccccagctacggccctgcgcagaaccccgtcgcgctgctgcagctctgcgtcgaccgcaggtgcctcatcttccagctcctctacgccgactacgtcccaggctccctccgccgcttcctcgccggcgccgcggactgcttcgtcggtgtcggcgtggacaaggacgccgagcggctgagcgacgaccacggcctcaccgtggcgaacaccgccgaccttcgccccctcgcggcgcagaggctgggccgcccggagctcagccaggccggcctgcaggccgtggtgcgcgccgtcatgggcgccgacctcgtcaagccgcagagggtgaccatgagccgctgggacgcctcctgcctctccaacgagcaaatccggtacgcctgcatcgacgcttacgtctccttcgaggtcggcaggaggctgctccgcgcctgatactgatagatcgtcgatcgaggcggtccccgtggcacgtaccgcaatcgctcgcatcctctctgcctaattctacctagattagattccagttgctgctgcatttcgctcctgctctctcgtaatgtgttaggctacctagattcagttgttgctgcatttttctcttgctctctcgtgatgttaggcaagggtttatcagatttgaggtgttatgggttttatgtttagtactgaaggaattgaagaatcggatgaaaaaacgttgtgccgatcttctgatctagactatggttaatgaaaatttccagtgccgatcctttatgcgtttttagtgctgtttttttatatctgtgctagatgatactgcttgcagatcgtgtcatcaactggaaatggctcctttgctcaaattgttctacaatggtgtgctagattatccattcattgaattgcctagcaatttggaacatcggttaaaattaggcataatatctttgttttgcttgggttgggtctcttactgtgatagccacttgcatcacattgtgtgcaatgcagttgatgaacatagggtgtgtttagttcacgccaaaattggaagattgattgaaattggaacgatgtgacggaaaagttggaagtttgtgtgtatgtaagttttgatgtgatggaaaagttgaaagtttgaagaaaaagttaggaactaaaccaggccatactacctgcatcctagctagtggtttgttcttctatcagcattttttccttatgaataaaatggtatgccaagccactgaccattaagcattgcatatgaagccccaggcatacttgtagcgcaaatatccagttatccactatataaggcaaatgatgatttataccaaagcattatgcagggctgctaagctgcaagctactcctatttcagacagatctggcaaatgaggtttctgtttgtcggtgacatgggaccgggggtatcatgactagaggcttgaggcagacacaatcgcccacgtggcctggcaccctcgggggacgtcgggcccgagggtgatgtgttcgccctcctcttagtccccccgagggggtcgggccgcacccgcctcggccccgagggccgaggcgccccgacccctcgtgggtttttgctccgcgtgtatgggttaggtgagcacagtagggctcacctaaccacatttattgcggtttggctgagcgtgtcacgccgcatgtaacgcagtgcagtgcactcatttatccggtctgtgaccagtcacagaccggtcaggtcgtgggttaggtggcgacaggcgatctgacgcacgcctcgccccatcccgtcaggacgagggcttctaggcgctcgtccccagctggagctagcgtgttacctcccagagatggcacgttagtcctagtcagatatatgctaggcttcatcctaaccattacaggcaagatgttgtgtgaagaagggcgaacatgcagattgttaaactgacacgtggtggacaagaatgaccgatttgtgaccggtctgacaatggtcatgtcatcagcagacagccatcttcccacgtcgcgcctgcctccggcggaagtggaggtaggtatgggccgtcccgtcagaagatcattcggacaatggcgatgcaaatctccgtccattaataaagaaaagtcaaattggagggagagatggggcatgtggtatccccttgagatataaaaggaggaccttgcccactttgagaggggacgggacttttccagattgggaacccagaacgagggagaggctggctcatactttgtagttccttcatacacgaatccaccaaaacacaggagtagggtattacgcttctcagcggcccgaacctgtatacatcgccggcgtcttgtatggttcctgtctcgcgaaccttccacagattgggagcttagagtctcacccagggtccccggccgaaccggcaaaggggggccagcgcggtctcccggtgaggagccccacgctccgtcatctggcgcgccaggtagggggctctgcgagtgatcttctgagctcttgcactctttcgtgtgcgccaagcttttcctattcagcctcatggctgagcaagcaaaggcgcacgacctctctccgagtgtgagtggcgacgacggggagccgaacccacgccgtcgagctcgtactccaccgccccctccacgccaaagtcctaagcggggggaggcgctcgagagggccgaaggatccgcgacttcgacatccacaggaggtggaaaagagcggcgagatggggagcgtcgtctcctcgtctatggtgacggcagcacgccccagggcgcgctccaagctgcgggcgcgctcctatgtcacccgcccgtcgcccatgacccggagtctccagcccaacgttggctggacgatgtggccaaattggtcatgactgcacggcagcatctagatgctggtgggcggtcctccgccaccaaggcctctggtgctgctaccaccggctccgcgtcgtcaagacgaagggcgcggcgagcggcagccgctgttcgccattcggccaccactccttcgtcgactccttcgacccgggaagatctgcgtggggggccggacgcccgcaccagcatcgagcggcggcgtaatgaccgacgtgctacccacgcaacggagggcgcttcctcgtccagagtgtcacctcaacacggaagcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggagacgacagggtcatggcgaatttctttcccatggccctgaaggggcaggcgcggggttggctaatgaacttgccacccgcgtcagtccactcctgggaggatttgtgccaacagttcaccatgaacttccaaggcacgtatccgcgcccaggtgaggaagcggacttgcacgcagtacagcgaagggacgatgagtcacttcgctcgtacattcagcggttctgtcaagtccgcaacaccataccatgcatccctgcacacgcggtgatttacgcgttcagggggggtgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgccgcttagacagggcggcgtgacaggaggaggaagaagaggtcagtccattccgacgacgagggtcatgtcctcgccgagtcgccgtcgagggcgcttcgcgggccacccaaaaggggaggcctgcgagcgacaaaaagaaaaaggccggcgctcccagcagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccctgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgcgaagttggggcgtgtcctcattgatggaggagcagccctcaacatcctttcccccgcagcctttgacgccatcaaggccccggggatgatgctccggccgtcccagccgatcatcggtgtgacgccggggcacacttggccgctaggtcatatcgacctcccggtcacctttggtggacccgccaacttccgcacggagcgggtgaacttcgatgtggcggacctcagtctgccctacaacgcggtcctggggaggcccgcgttggtaaagttcatggcggcggtccactacgcctacctccagatgaagatgccgggccccgacggccccatctctgtccatggcgacctcaaagtcgcgctcgcttgtatggagcagcgtgcggaccgcctcgccgtcgtgtccaagcccgagggcggcgacgagaggcttgacacatccgcccccgccgccccgaagcagcggatagtcacgtctgatgaggtcccggtcaaggaggtcacactgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtgcggccgggtgcaaggccggtccggcagaaagtgcggcggcaggccccggaacgtcaagccttcatccgcgaggaggtggcgcgacttctggaggccggattcatccgcgaggtcatccacccggagtggctggcgaacccggtggtcgttcccaaggcgaacggcaagcttcggatgtgcatcgactacaccgaccttaataaggcatgtcctaaggatccttaccccttgcctcgcatagatcagattgtcgactccacagcggggtgcgaccttttgtgttttctagatgcatactctggttaccatcagattcgcatggctagggaggatgaggaaaaaactgcgttcattacccccataggaacttattgttatacaacaatgcccttcgggttaaaaaatgcaggtcctacttttcaacgtactactcgaatttctttgggtagccaaataggacgtaatgttgaggcttatgtcgatgacttggttgtaaagacgcgtaaccaagaaaccttactctcggatctagcggaaacttttgaaagtctccgctccgcccgcataaaactgaaccccgataagtgcgtgttcggtgtacctgcgggcaagcttctcgggtttttggtctctgccagaggcatcgaagccaaccccgagaagatacgagctatagagcggatgcgcccccccagcaagcttagggatgtgcaatgcgtcaccggttgcatggccgccctaagtcggttcatatcgaggctgggggagaaggcgctacccttatttaagctcctcaaacgctccgggccgtttacttggacggaggaagctgagcgtgccctcactcagttgaaggcgtatctcagctctcccccggttctggtcgccccggagccaaatgaacccttactactctacttagcggcgaccccgcaagtggttagtgcggcgttggtcgtggagcgcgatgaggacaatcctcattccgcgcacccccaccctgtgcagacttggcccgggagagagcagggaggagaggcccccgagccgaacggtggcccaaggcccccgacgaccggagttggccctctgcccgcttgtcagacggtgctaggagcccccgacccccaggaaggccctgaggccactgtgggaaggccgtacctatcgccctttgaccccgaggctaaccctgtgctgactcgacccgggaaagagcagggagaagaggcccccgagccgaacggaggtctaaggcccctgacgaccggagttggccctttgcccgcttgtccgacgatgccaggagcccccgacccccaggacggccccgaagccactgtgggaaggccgcccctgttatcctccgaccccgaggtcatcagcacagaagacaagtgcgccccgcgaggctgcttggacgaagagtgccccagggatgcggcccctagcgaagagaatcggccccaccgaaaggtgcagcggcccgtctactttgttagtgaggccctccgggacgccaaaacccgataccctcaggcccagaagatggtttacgctattctgatggcctcgaggaaactgcgccattatttccaggcgcatcgggtcactgtggttacgtcttaccccctcggtcaaatcttgcataatcgagagggtacaggacgggtggtgaaatgggcaatcgaactttctgaattcgatttgcactttgaaccacgccacgctatcaagagccagaccctcgccgattttgtggcagagtggaccccggctcccgagcccgtctcgatccctgaggccagcacggacccctcgcagctgcctcacaccgcccactgggtaatgcagttcgacggctccctgtctcttcagggcgccggtgcgggggtcacgttgacctctccgagtggagacgtcctcagatacttggtccgcctcgactttcgaacgaccaataatatggcagagtacgagggactccttgccggactcagagtggcagctggactggggatccgccgcctcctggtgttaggcgactcccagctggtcgttaaccaagtctgtaaggagtaccggtgctctgacccgtaaatggacgcctacgtgcgccaagtacggcgtatggagcgccattttgacgggattgagcttcggcatgtgcccagacgggataacatgatggccgacgaactctcacggctcgcgtcctcgcgagcccagaccccaccgggcgcctttgaagaaaggcttgcccagccgtcggcgcgacccgaccccttaggggagacggatgcgcctgaccggcccccaaggcccgtcggagtccaggcctcgggacccgaagggagcgctccaagctcccttagattgattgcttggatctctgagatccaagcatacctcacagataagactctacccgaggaccgtgaagggagtgaacgcgtccaacgcatttccaaacgctacgtgctggtagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaaacaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtggcccgaggcttatccggtcgtcaagatcgataagcactctgcacttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaactaagaccttcaatatcctcaagaagcatggcgattcgtggatcgaggagttgccagcggtgctctgggcaaaccgaaccacaccaagccgagcaaccggggaaacgcctttcttcctcgtctacggcgcagaagcggttctcccatctgagctcaccctgaggtctcctcgggccaccatgtactgcgaaactgatcaagatcagcttcgcagagatgacctcgactacttggaagagcgaaggaggcgcgcggccctccgagccgcgcgctaccagcagagcctgcggcgctaccatcagcgtcacgtccgggcccgatcactctgcgtcgatgacctcgtcttacgccgcgtccaaacgcgtgctggattgagcaaactttcaccaatgtgggagggtccgtatcgagtgatcggtgtcccccggccgggctccatacggctggccacgggcgacggcactgagttgcctaacccttggaacatcgagcaccttcgtcgcttctacccctgaggggggggtcgggtgtcaggtttcgggctcgggtcaaccccgcacccccccctcgggtgtgcagggttggccgggggctgccacacatgcacattctcatttctctcatttcagtatttcaataaaagcagtttcaatttcctaagggctgtatctgtgccgttttttttcctttttgaagaattttgacttgaaataaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctccccaggcagtagtcccgacccgcgcttttcgaggactgggacttgggcacgggcccttaaatcaagctaagacacaaaaagaggatcacggcacagatcatcctcatctcattcgcatagcaaaataaaattaacacaaagaattttttcatcatttttgattgcagattgtaagttgatttatacaaaaaagaggcatgaaggccttagaagaaagaaaaagaaaaaactggagtctggagggggcctgggggctcagtccgatgcgcccgggtcgccggcctcgtcgtcacgatcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccggaagggaactcttccagcgccatccatggagagaagttggggtccctggcctggtaactcgctagtacgagttcaaccgctccttgggcgaggtccctcgaggatgacttgatggtcttctcgagctcctcggggagttgttggagagcccaggccatcttcgtgaggtgcggagcgaggccctccaggttggcggggcgtgtcattgactggcctttccagaggcccgcctgccgaccggcgcgatccagacgggagactgcatcccagagcatgccgggccctatctcgcccgccaagcggagggcctcggcttccccggcggatgagtctagcgcgcgctgcatgtccgcgacggtgtgttcggcatctgcgaggcgggcggctaagtcgctttcgcccgcagccgccccgccgatgcacgccctcgcatccagctctttttcccgcgcctcgagatcggcagcccgctgctccagtgcggctctctcggcgcggacggattccaaattgcgacgggcctgctccgtcagcgctgcctcacggagggacagggagtccgccaaccgttgcgcttcggcctcggcctcttcgagagctcgctcccgctcggcaagcgcgtcttcgcggaggcggagtgcggactcctcttcggcgcaggcagactcgtgcgccgccagcgttgcctcccgggaggtgacggcggcctcgcggtccgccaggactttctccgcgacgcaggcgcgctcctccagcgccatggcgcgcgcctcgagggcctcttcacgccgccggagcgccgcttcggtctccgtcgctcgctgctctcgggcagcggcggcatcaagaaccccctgggcggcgtcgagctttttcttcagctccgcctcccagttcccgtgctgaaggcggagggagtcctgcgcctcgatcatcgcagtggtggcgatgagggcagccccccgctcctcctccacctctcgagcgatctccgccagtgccgtcttgcgggcctcaagatctgagacgtgccggcggtgtgccttgcggcccgcttctaccatggcctccaccgagcgccgcccctcctcgacacgcgcccatgcggcgtcgagctccgcacgctccgcctgcagggcctccacctgggcgttgaacccatccaataccgcggtatttgcggcggctaaggcctgcagaaggggctctgcgctcagcggggcggcggaaggcgtggggaagagctgccttaagaagacgccgcgcggctcggcccgccaatggacgcgccggcctcatcgcgggccacccccggacccgtttggtcctgggcgtcgcccgaaggggtgggcccaagcgaggcgtccgcggcctcgtcgtgaactgcctcggaagccgccatcgcctcagcccggcgaacccgggcggcctcctcccgagcggcttcttcggcctggcgaacccgggcggcctcctcccgagcggcttcctcggcttggcgggcccgggcggcctcctcccaagcggtatcatcagcctggcgagcccgggcggcttcccgggcggcctcttcagcttcccgtaggcggtctgcggcctctcgccggtcagattcccgcctccgtgcctctgcggccgccggatcttcggcctcggactggccggacttgagatggtgggaggaacgcgatgggatatcactgaagcagaaaggaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcacggccccctccgggcgcctgctgccggcacgcaccgccccgccccctcggggagaagatgagggaggtgttcctcccagtttcctcttcccccgggcgtcggtagggcggttgccccccgggcccctgtcgcggggcccagaagcacgaccccctcccggggtagattgttcccccttgcggctcccgcctgcgccgtcgtggccctttggagcctgctcctctgaggccccgaccgctatcataatggtcaggatggaggcgcggtctggatcgctgcagagggggaggattccttggggaatgagggacgcctccacggagttgagattcagcacccgttggaccaatatcttgaaatcctcaggagcccagtcccatctcactccctggtgggtcctcatgaggtcttcggaccccgtgtactcccaggcgccccgagcgcgccgctggagcggcgcaatccgacgacggaggtagtcgccgtacaccatggcccctgtgagcccctgggatcgcaggcccgcgaggcggtcgaggacggcgtcatagccatcccccagatctaccggcgcccgccagctgggggcctgcgccgggggctggctcgaaagtcgaagatgcgcttcgtcggcgaggggggtgtagaaccagtcgctcttccagtcatcccactttttacggaggacgcaggggatgtagcagttcaacaccggcccccgcggcaggaaatagcagccaccaaccaccgacggcggcgacaccgactgcacggtgaagaaccaccggaacagccgaagagatgggcgcaccccaatgaacatctcgcacaggtgtgcgaagatgcccaatgtcatcactgcgttggggataaggtgcgccatctggagatcgtagaactccaggacgtccatgaagaaagaagaaaatggcggaaccagccctgccattgcgaaggggagaaagaagacggaccgccccgggtagtctagcgccgggcgtccctcacccagcattactatctcacggccggtggcagattccggcatgaagcggcgcggcaacccagcctgcttctcgctcacaatgcgagaaggcggcagcacgctaccatcaagcagtgcggagccccgtgccatggcaccggacgaagagaagatgaagagcgagcgcgtgtggcgaaagaagggcgcagggaagaaggagttaggacgcaagcggcgaaggcaaaggaaatgatggcgaaaggaaggagacaaatcccatcctcagtgcctttatacccttgccaacgctgtgcccggctcctcgtttctcgcgcccattatttcgccccctcgtttctcgcgcccacgcttccactaatcccattcgcccgcttgcggtgcgtgagatggatatgcggttgcggcagtcgagatagatcgtatcgtgcgcgcgttaattacgctcgccgaccgaagcaacattaccgtatcaccaggcgaggcaaatcggctcgcccagattcgtgcgccgctcaggtgatgtggcagtcttgaagagaccgcccattattgacagccaaattaccattaccggtgtgcatggtttgagaccgttgggttttttgcccaaccatggagaccggtcccacctgtcaccaggctttatgtcgcgaccgggaaaattgccttctcccgaacgctagtgtattaatccccgtcccaggaaaagccggggtacaccatacaaacatgatataaaagacacatctttattacatcgataatatttacattattacaagggcacttcaggcctgacaaacaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcagggggggggggtacaaggggataataataggggttaggttttgcagtaaacagcatttaaaagtcacttagttgcccaaagccattttgtaaagacgatcctagagctacacagtattattaaacaaggtcgtgaaccctcacgaacctgccttaacccaaggcctacgatgatttggaccgaactggcaacccgacctgggttccagctcgtcccaagccaacccaggccaaccattccatattttagttgttgagcaaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacacccgacttcatccatctccaatccgtgtacttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtgtgtccaattccaacataagccgaccattccatagtgtccaaatgatatgagaatttcccaagtctaaagttataaaaccacctaatgttgcctaattaatcagcgaagcatctacctaaatttaaactagggataccacgagtagagtacccactagttggggttttatttattctagggtgaacaaggtaataataataacaataacaataataatatggtcataacaaaggtaaataggcatggctaaataaaacagtgacaacgcgggaatttaaataaagcgataatgcaataatttaaatcaacataattttacaaactgggattcaatatgttcaaggatgatgtgacttgccttgctcagggagaacggccttccgaaccttcggcaacgaccgcaaaccacgcttcgggaacctccggaacgacgaaagctacgcgaagcacacaagcaaagctacaagcctataaagaagcaataacaacacataaaaagaaagcacatggttctttaggttataacaaacattaagagacttgaacgggtcgattcggagctcgtatgaccaggatatgatcatccgaagtttaatgctgttatatggagatttgcgaattattataattaagctttgcaattataaaacatgtgtaagcgctagcctggaaaagacaggaaggctgcgccgttgacatgcggaccccacatgtcaacctaaaggaccgcggtagaccggatacacagagacggtccacgggtcgacggaagcggaccccgtgtgtcaaccgaggcgagtggccaacaaacggactccactagacaccacacggcctgcacacgtggaaaccacgcggctaccgagcgggcacactaacacggacactacacggtcaccacccgcacacgtgaacgactaccgacaccggtacacgggtaccggggtcgacgaccgcacaacgagcacgggcgacaccgaaagggcgaggacggggcagcgaggggaggaaaccttaccaccacgcgacgaggcgtgggaacgacaacgacgaacgggcgcggcggagacagacgggcacaacggagacgaacggcgaggggacggcttcggcggcgatccttgggcgaaggcgagacgcggccggcacgaggcttgacgacgcggagccgaggacgaacacgaggacggggctgcagcgactcgcttgacgaacgcggacgacggacgagaacggcttgacggagggacgaacgccacgacgatcgggaacgacgagaggacgagggcgacgacgaccggggccggcgaggaggcgacgaggacagccggcagcggctgcacggggacgaggatgacgtggaacacgccgctatgatgacgatgacggaggcggcgccgcgagacgacgagccggcgagagggaacggtgaagacgacgacggacaccggcggtgttcggtcggaggggaggcgaggccgaggacgacgtcgcggctgcgatgccgaagatgatgggggtgtggccgaccggtgcacgggcgaggagggacgggcggccgaacaactccggcgaggcggatggagaggttcgcggcgatggcgttccggcgaaaccgaggagtggacgaggtggagggctacgtcaccatgccgagggaggggacggcagcgccggctgatgcacgggcatggcgaaaggggcagccggaggagatgccgccgaggaggaaggagaggccggcgcgggcgacggcgttccggcgaaattcgggcgaggaggaggtgatgccggggaagaaggcgatgccgcggtgtcgaaggaggagacggcggcgtcgatcggcgcaccggcgatgaacagcagccggctggagggagtacagtggcaccaatgccactggttgccggcgggggcaccgttccggcgagtttccggcgaggagacggtgaggccggtgaaggggacggtgttgcagagccgagggaggcgacggcacggccggacgatgctccggcgaggagaggaaggcggctggaggtggccggcgcgaaggaaagaggagggcgacggcgggaacggggctagagaccacggggaggctcgggatggggttaaaacggtagaacggagtgcggggatcccattttatatgagagaagagggagccggccacgggggaggtcggaacggcggtggaaaatccggccggcggcaatggaaggcggccggacttggcgcggccgttcccggcgattgggggcggcatttaagggggaaattagggggaaatgaagaggagtcaatggggattaatttcccctatttaatttgggaatcccatgcttgaatcgagcggatttagaggaggaagcgagctagggttcacgggagagggagagaggacgaccgggcgggaggaaggggacgacgcccggcctgacgcgtgggccccacgcggtcgggcgcgcgtcgtcaccgcgcgcacgcgcgcggcacgtgcgggaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaagagggaggagaggaggacttcggactgggcttggcccaaaggaggaagaggagggatttttaggttttctttttattgaactttgataattgtttttgttgtttaataattatttctggtgctctgaaaattcaagtaaaatttgagggctctttttagaccaaggagaatttaacaaaaattctccgggccacattggaatttttcttgtacgtatttttagtgtttgccaatttctttccgaattttaattaattctattattccttttagaaaataaattttaaattttgggatgaatttatcaggacgtgacactttaggagtggcgtcacgcccggccgcttcccataagaagggcgatcgccctggcataacgccgggggctactgtcggtgacatgggaccgggagtatcatgactcgaggcttgaggcagacacaatcgcccacgtggcctggcaccctcgggggacgtcgggcccgagggtgatgtgtgcgcccacctcttggtcttcccgaggggggggtcggaccactccagcctcgcccccgaggggcgaggcgccccgacccctcgcgttttctactccacgtgtatgggttaggtgagcacagcagggctcacctaaccgcatttattgcgcctcggctaagcgtgtcacgccgcacgaagtgcagtgcagtgcactcgattatccggtctgtgaccagtcaca

SEQ ID NO: 494 - DNA, 3333 bp, Oryza sativa
gctctgaaaattcaagtaaaatttgagggctctttttagaccaaggagaatttaacaaaaattctccgggccacattggaatttttcttgtacgtatttttagtgtttgccaatttctttccgaattttaattaattctattattccttttagaaaataaattttaaattttgggatgaatttatcaggacgtgacaaatccaccccccttacaagaatctcgtccccgagattcgaggaggctagcaagaagataggttgggcggtcttctcttcttgtccgacttcttccgtcgcatcttttataacaaacttgcctagcaaaacttctccactctggactgcttggctcaatctcctgttgcagatggaatcttctcttcacctgacttttccctggttgcacctctagctgacttcgactggattatggcacttgaagatgggacttcagttccagaacttctcataattcatatctttggcgtcaacctcatacaagttacccacttcacgttatgcgtcgatgtcagcttgtcattactaggatgccctgctcgttatcatgagaatatcatgcttgtcatttacttctaacttaccactattcacttcatgttgtcctcggttagcattcaacgtattcctttacacctttgaccttgatgtgttctttcccgatttctcttatcaatcacctttcgacctacttctttgcctggtaataaacatctttttcgatatcttctatcagtcatcttttgaccttggtcgctaagtattcttcactccgagagttgtggatgcttctggtggcgatgaggtcctttggtctgctacctttcagtgaaaccttgaagtgtttcgccaaaagctatactgactgtcattgcctttgatccggaaaagacacatctgaaactcttagtccaaacaaatgtctctttggttaatcacttgattttcttttccatcctcaggttggttattagctcgaggttagaatatagttcctctggcacgagaccctaggtcccctttgtcagtaaacaattatacacatgatcacatatccgcatcttccaaaagaatcctcttagaacttgtttttattacaaatctctcccatattacatgaatacaaggcactgtcttaaacaaaaagggaaggtgcttaacatcggtacattgtttccactatgggttagaattaacatgaggcctcacaggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgattattgtgacttggagttggaattggtggttggaaatccttgctaacattggcatcagtggtaccatagttgctatcaccattggagtctttctcagtgtcaaaattgctaaggttgtcattctgggttccaacattgatactatcgttgacatcttggtgaatgctactgacattgcacgctttattcgagtggtcactaatggggcaagaaccatggttgttggtggtatcatcattattagtattgctagtgttgttgtctgcattgcattcatcttcttggggcaggaactcttgatgcacaacaggagatccggtgatctgaagtggctcagtgcgctgtctttggttaccacctggaaatactgggatgttgacaatccttctcttgcagttcgtcatccgattatgctcactttcgagttgcatggctttgtccacaagtttctcaaaatcttcataatcctctagaagtagttgcactgcaaactcatcttttaacccctggagaaacttctcttgtttgtcttcatccgtttccacatcttctggtgcatagtgagccaaacgatagaactcatgcaggtactctgtgacggtcaaatctccttgcttcaggtagcgaaactctcgttttcttagtgtgatcattcctgtgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcctctcgactgtgcgccaccaatcactggcttccataggatcgacggccatggcaaaggttggaggccccgttttgagaaattctgataacttgcactgttgctggactgtaggtacttgaacgttggttgcccctgctgggttgttccgattctgtaatagttgaaaggctgttgccaacatgttggtttggttaaccacaatttggattagctctggtgaggtttcgttgatgcttttctcattcccattggcttgggttcttgagtcatcggatccatcattcccatagcctttgttaccaatgttatccatctgtcacaaggtaggggttgagagaggaagcatacaaggaaagaagagaccagaactagggacaagaccttaaaggaactaactctttttgttgatgtgttgtttgttttgcttattctgcaagttgattaaacaaacaacctagcatggtcacatcacaacccaccgatgcaaaccatgcgctacacacacaagcaaggaaacacactacaaacgaaacactagagggtggcttaggttctgcgacgggttctccaagatcttcactcctgcttcccagctggcttcactgcttcctccacttcactagcagatcctgcagtcttctggagcttcggcaaacaactgacgatgtcctctactgacctgaccatctagtactagttgaaaatccgaagaaggaagaacggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttctcccgaacgctagtgtattaatccccgtcccaggaaaagccggggtacaccatacaaacatgatataaaagacacatctttattacatcgataatatttacattattacaagggcacttcaggcctgacaaacaaaaataaacagcagcggactagcgggcctacgggttcatctttacaggcgctcaactggggtataagccaggacttcacctaag

SEQ ID NO: 495 - DNA, 350 bp, Oryza sativa
atccaaacagccttcctgtttcaacaagcatctcatgtagctatatctcacgctcagaattggcccccggaatttccctatcatactacaaagcaaatcacaatccttcctcgtacgttccgacaatttctcatcgttggcaaatggcccaacaattgaaaaatacagaaaacctcacgaagacgaaaacgaagcctaaaccatatcatccaagggaaggtgggggggaacaggtaggggaatagttggggttggggggctcaccgacggaggaggacgcgatggcggatccgcacccaaaggtcttgaagcatgcgtcgacgatcttgccggagctctcgtcgacgcgg

SEQ ID NO: 496 - DNA, 14496 bp, Oryza sativa
tcatcatgcatgaatgatcaatttcatgtgcatgctcgagttcttgacttataaaaaccagcagcaggtatgcatgtaagatccatgatccagtgttagtaactgattctttgatatatacttataaacaagatatttatgggcagtggaaaaatgaacaagagaggagagatatcgtactttgcatcgataaggtgtgacttaactacgacccatagactttcaagtggaccagtaacaactgaaattgccacggaacctagctagaacaatatgctatctgagatattcctattagacatgcatgaattgaagtgagcagttaaaaatatcaattgctaactatcggcacataaattctatacttatcgcatgcaatattgcatactaacttaggtactttcacaatatatatacatttaaatttgtgaaaaaaaacaatgcattcacttagacctcacccatttcagcagagaaaccagctactagcatatttgacacttgctagtttttggtgtattatctcaccgtgcatgactagttgcactgtaaacttaatgcatgccttctctagctatgtcattagtagaccgactcttagccaaacttcattgttatctgcatccagctagcgcgtgcacatcaaatcactttatcaggacaacaaaaatccaggcaatatttcaccttaattaaggaaaaatttaagtcgaaccacttggcctctatactcacaatattccaatatctcaaaaataaattcagattttcaagactcgtatcagcaagtacatttgctatagcttagctttgtccatggactacatatatcgagcaattaatcctgtggccttaatttttttttcaaagacttgaatcttgtggcctggagagtttcttccgatcttgtcacaggagcccagcaaattaaactcaagtcaaactagtgggggatatatatggactctgaaccgagagagggtggtaagtacgagcaccatgaatggaacagtggcccaacagtatcctacatttttggagccattgggggacaatgcatcgttgcaccattactccctactttgaatgccagagcgagatgtgaggtgttaattctcaagaacatggaggaccagcagacagcagaagataactgactgatgataaggggaagccgcccaagcagatctgggtctccgtactgttcctgcctgtcctccttcctcctcctcctctcctccgatcctcatcatctagctagctgatctctccacacttgtgtgcttaatttgactgtaacactggatggggcgctacagaagaagatcgaagctaggaacaagttgaaacaagttaaaagatctcgatctggttaaaatttcaaacatgccctgggagattcctgcgatgatttgcttctcccaagagccaagatccatcaatggcgcagtaaatattgcatttccttcccaagaaggggaatggaaaagatggctagtactagcaggtactagtacaactagtagctaggctcctcgcaaaagatgaagagaagggcgtcgtacgaattgacgcaggagatatggaaaacagcaacagcaagcgctggtactcctacggtacaggcatcaacaccgactccaattccccatccgaacagtgccatgctagtactactcctctagttggattacccaaaagaacacgaacgaaatgtttttcgccgagattttagaaggagtcgagtacaaatagcttggcaaactagaaaaaccgaggatacacaccgcctcacggcgctggaacacgaacgaaaaatcgcagaaatgcatcaattcgattgtgagagatctagaacctggcaactgcgcctatgcacgattgcgccggagaagaggggatcgaattaatctaaagagcctagagactcggaacagctcatggcgcgcggagcagtacaggggattccgtcggcgaccggccggcccgcgaggggccgagaggccagcttagctagccgcgggagggggagaaaacggccggcaccggatgacagaaagagcagtgagcacgcggccgcgacggcacgcccgccggtgccgtcacgcccggccgtgtgctcactctcttctgtcacctcgcgccaccggcccgcccgcccgccggccggagacaccgccatcctccacacccactcacgctcgcctagctagctagctcacacccccacgatgaaacccgcggacacacacatacctcgccgcgcgcgcgagcgcgtgaagagaccgcaacgtacaccaaccacacggcgacggatcgcggtcgagaagctgaggcgtgcacaccggaccggcccaccggccagtggatttatataggcagggggaggcgagagcgcgaggagggggaggtgcaccggaggtggtggtggtgggccagctgcgaaggtagcatgcgctagcctggacctggactagctagctagctactagcaagtagcagcagcaagctcgaccgggaagggcgcggggctagggtttccatcccggtggtcaggtgggttagtgggtgtctggcgtggtggctgcgcgccatgcatgaccaagccgcgccgcgcgctagctgacctgcggcgaattgaggtgggcgcgcgagcaagctaggctggcgtgggaattagtcgtgacagtgtggctgtgctgctggggcggacgaccgatcggcccagctaagctaaggttaacatcagagccgcgccggtattgctcccaaattggggaattagggtggtggggttgctctccaggagagaagggtattaatatggggagggccagtacgggcttgacacggagcacatgcatgcccccacatcgcgcggctaagctaacccttgcggttgagggctgtacaacaatatagtgtcaaagttaatttgcacttttcttttcgaggagagtacacatcagtttttctttttgaaaaaaaaattcctagggtgttcacagtctaaaagatgaagttaatgtttcatggtaaaatgatgtgttaactttcatattttacactattatttcgggttgaattgattcacgagatggcgtgttacacttttaactttaacctaaatgatgaagacatgtcctatcgacagctatcccatcagctaaagcatctcaatcatggttgaacacatcctcgtttagttttatgaagacaattttatcttagttacttctacatggtatgactttaaaatgatccgcacttaaaggttatattcaatcgtaagtagtgacacgcttttatggcatgctaggtactttaactttatttgttcaagcacctgaaagaatcatcctccatgacccatagggcaagagaactcctacaatattcctaataaccatcccaatgcacgggttgctcaatcacagacacaattaatggagatactaacaaatatattgccataagaggatagaactcataggtgttctctaaattattatcatttcgtacagaccccaacatgacatagcagtaaatgcatatattgcaaaaagatagcaagatttcagttcttatatcattggatatttgatcaagtgttcgctcagaaacaaccactgttgtcttacgtaaggttagtttatcatatgggcgcgacgcccgtgggctggcatggaaggtaatgattattctactttagtttaatcatggttttagttttagcccctcaaaacttaaatttaatttatttggtttcactttgtttcaaaagttccaatagtatttggtttttcactataatgtgttgcaaatatatagtaacgggcacccatccctgtacagagaaatggatgagagatgcacgcgggcatgggcgcctagctagctagccagccacagcggatctaccgagctctgcgctaacgaccaccagggaagtgaagtccagcattctggaatgccctccatcgctgcatgtctctgcatatgctgatgcaatttgacggtaccaacacgatgtgtgccaaggctgtagttgcaacggtaggagactaggagtgtactccggtcctcactagttataagccctatacatagctagctgtagctggtgagtggcatgcatgcctcccctgtggatttatgtatctgattccgaattttgccccaacccaaccccaaggcatgaaccatgcccctctgcagctcttcttcgtatgactatagtactacatgtagcgtccattggccgttgctagcaggagctaatgtggcatgctctcaatgaataactgaaagtcaggaagcataggaatagtgacattgttgatggcgcaggtatggtactcctccaacatgtatataaaacaaacctagcacaagatatggcatatcctaatactacaaatccgaatagaaagttgtccatattcatagtacaaggatgtgtcacatctcctattagtgttttttttaatggaacaaagggttatacccaagtactctggcttcgacgtcccgtacacaagtaggtttggctcatgtcaagtcgtacgtgtcaaccagagccggctctctataggccctaatagagaccttgtaataggccctcaagaccaaatatatttttacttgtaatatatacgtgttataaatcatatagtgtcgaaaatgatgtaaataaacattataaacacctaacttacgatgtaaattaatcaacgagaacaaaacaaaatcctagcccaattttcagactaaatataattaagcaaatgagaagatcacaaaactcactctaaacactaaccacgatgaaataaggtgtgaccacatgggagtcagacgtgaggataggcaacaacatcctactagctgggttggttcgtgatgggccccatataggcttgggccctaggcggtcgcatgaccggcctagagctctaagatggcccacccagcggtatgttaattcttttggcatctttacctcatcaaaattcatacgcggataatatgttacgtatactaccccttctcttatgttctacgagtactgtaagtagtacttaaagaaagttgagccacaagaattgagacggtaagtgaggatggaatatagaagccataaaaagttaattattccattcgttgcaaaatacaacaatataaagtgtatatcaaatatgataaattttcacccatattcttttatctatcattcacccacttccactattcaaattctccacctaccttttcttttcaaccaatcacaatcttctctcgttcaatttcacctacctgattacttcaatcctaaaactctttatgatttaggatgggtggggtactactggcttgattgttatagcttcagctccacttctcctataactagaacccaactaaacaatttaagtttttttttcaaaattttcctagctttgttactcactaccagcttctcgaaatatcaaattcctcgaagaggaccttttgcgtcaggatcctgaatatgggcatacacttgtggtggtgtgcgtgcatgcatggcctgctggtaatcttgaaagcatgcaaaagttaactctctttttcgtctccaaaagtaagagccctgtagatttagagctagctggatcaatgatcaatgagagcaggtataatagcatactataaacatattttgagaagataaaaaatgagagagaatagtagcgggctactgatttatagctagctacagcatggacttcaaaatacatatgtgtatgacaagtgggaccaggtattaaattgtgtactatatgttataggtaactattatatgaattaactattgactatagatgatttagagtgagtagttagctatactattaaaattgctgaaagggacgcggttaaaaaggacgcatcctggccagctgccacttgacttgctacttgccagagccagcgctgcgctcacgcattaacaaatttggcacgctagctacctcggtgtggtccttgatcagttttattctccatttaccctttgatcaaagcaggctcaaaaacaatatatgtgccggtacaactaagcaattaaactgaacaaagcgttttcgtggtccctttaattcgaacgaatacattgtacacagcacagtacagtgcatgcatgcgcatatgtgcatgtaaatatatatgtgcatgcgcaacatgtacggcgtcaagcgtgcgtggtgctagcttagcctagtattgtaggagtactagctaactaaagattagttagtgttgagaacactaatcaaagcttaatttttgtataggaccagtgttattctcgatcgccggatgatgctctagtccagggtgtggtgtgcatgctaacgcattacgcatgcctaatgatggtccagggtcgtagtgtgttgtgcctttttcaaaccgatggagcagcacttagtccatggcctttccgtgagctttaatttgtcgattgttaacaaccgaggtgggcaacattggttaattttagccagaacggtaacaaaagaaacgtgagacagacacacagcccaagatcgatcgagagctagagaccatcaaattgaaaattaatgtgcaacaaaaaatcaagcaattaatcccgtttaatttagtttccttcgttccaaagaggctgggcatctaattgcccggtagggagctggagatgaaaccgacccaagaaacgtaacagtacgtgcaaggtgcaacacgtccacacacgcctgggagcgagcaggatcgatcgacaggcgtatcccggtcgatcgatcggcatcttgtcttctctcttttcaccgattcctttgatcagcttgtgggggccgtacgtacgtgtccgtggctagctttaattccgtgcgtgattggtgcagtctggtacgacctggcgtcctgcaggccacatgacacagagtgcgcgtgggcgcgcatgcacacacgcacccccctgctgcaccgctgcacgtacgtacgtacgtactccctccccgctcaccgcggcgcggccgccgcggtaaccagccaggagcccaggaggccacgacgacgcgcgcgtactcctccatccatcggtgcggtgccgagagcgagaaccccggtgtcctcctaaccccggacgcgcgcgcccgctcgcgctcgcggtcgcgcacggcgtcctgcagcctgcagcgcgctcgcgctggccggtgtaagccagctagcgcgtggcctgcaggctgcagccctgcaccgttgcacggcaggagcgggcgatcgagcggccgcgccggctggagtgtatgatgcgtggatcgatcacagtctcacggatcatgtgcgcgtttccacgattccactgtgtattgtgtgggaattaatgcccacatgaccgaacgtggtttgctccagaggaggagggtgctcgatccagaggtgacctctgcggcgcagcgaggcatgcatgcaggccggacagatgaagggatgtggagtagacgacgacgtacggacgtatttactgcatggtgtacgaaagactcccggattggaaaccacgagcctgcctatattaggaagttttcaggtcaggccgggcagaaatgattatactggatttttcattaaagcaccggatcgacatgcatgcatgcatgtagcggccatggcatcattacaaaacacgaatgattactgtttgtgctgcagtcaggatttactgtaccgttctgaaagtgaaaatggtttgcaaaaaccaaatgactatgaaaactagcaaaaagaaaaagaaatggattttacaaattacaaaccgaccaccaacggtttcacaaactgaatgtttttcacgaaaaccgatcatatttattaatcctagctgcagttaggtgctgcccatacatgacatagatacatatctctctggcgcacatgtgaaaccatatgttcagtggctgataccacaccaataatattacagacaatttctactgctgtggcatcacagtccacacacatccaattaagcaacaagcacatatagctctaatcaatttgaactgagtccaatccaactccattcatgaaaaaataactatataaggtatattattactgtccaagagagctttggccataaatttctgttacactatttcacttacagtaattttttttttgcaaaattaaatattattggattaatcgttgttcaaagcatagaactggacagtgaaaaaacgtcttgtatttcttctgaacgttatgttgaaactattttttccttgtgtcaccaagaggtccaagatgaagctagcatttacaacaaactattttaatgatagataatgcacccatcgataataagctgcatgcgctgacttcgttaatcttaaattatatgctctttttaaaaaggtgcgaatgctatttatcaacaagcaaccctgtccgagcagttcataaagttctagtctagtatcttgaaggcatgccactataatagagtatgcacgcacatatataagcatctgtaattgtactttgtttcggacaagaaaatcgcgcgtggaagaacacaaaagcaatagtgcatcttactagtacattatactatatatcaaatgggccatggccggagcctggttcatggcacttggctaagtgaactatctgggcttcaccaaacatctaactgggcctaaccataaccagaagtccagaacgcaagataagcaggatgacgaagcagagagagaacgtacgccatgatcgccaattcgccattggtgaaagaaaacaaaaaccttccgggcgttggggactgtggccccggcgagaggagaggggactgaggacaggcagaaacggagcagcaggctggggtaggggaggctttatgatctgttgtccactggatgatagaatcgcatgtgcggtgcagacacatgaatgccggcctgctcgacgaagacgcagcaggaagagtacttgggctgtgtttacttcacaccaaaattgaaagtttggttgaaattgaaacggtgtgacggaaaaattaaaagtttgtatgtgtaggaaagttttgatataatggaaaagttggaagtttgaagaaaaactttagaactaaacacggtattgtacacacactcgtcgctccaaattctaccctgcctgcatgcagttcttcaatgcacaaaatgtttggtgtgtactacgagagagtgatgaggtgtacttgcctccgaattccggaattttgtaactcgaaaggattcattttggtactggcataaattcaggttgagtttcacctcaagcaaagtaattcgtgcggtagttcgattctgaatttctgatactactggtactgtagagactgactctgcttgaaaattacgtaggaaacctgactttctgacaacgcaagaacctctcttaagcaatgaaacaaccaatcagcaaagacagctaacatattctgaataccctgatttcaaacgtgccagacatcataatgaggtgatcatttttttagataggcatcataatcagatagtttgatgtgccatcactcataataccatgctaatgcagcacatctttttcgtgtatgctttacgtcaagtatgaaaaattccacgagtaggccagtctgataataagcttctgctgcgcatctccgacctgtcctgtgtgccttccgttccaagttgagctatagataagaagtttggactgtggatgtgcacataagcacccaccaactccacaaaagcaaaagctcacccacttacccctgcattggctctcagcatgagttgcatcagttgctagtagctctgatgggttataaagttgcctcccatttggatgagagattgagagcactcagcaccagtggcaatgtggtttccactgccagtgatcgatgcatctagacttctcatgaagaacagagcagtatcagtagagcaccaatcagttattagtagtagtactcagaaagcaattcatctgaatttggtttggttcaagaaggaataacataacaatctctttaagaagataaggaaaagagtaggtttttgaaaaactacggagacttttattttttgacgcaaaactacggagactttgaccaaaagtatcacaaaactaagtagaaacccaagcaatattctgaaagatagataaaacaagacactgaaatgcagtcctttcccatacttacgtatgaaaacagaggcatcttgagaagagctcagctggatatggacaaatggtgatatggaacctcctcattaacccaagcaatattctgaaagatggataaaacaagacactgaaatgcagtcttttcccatacttcagtatgaaatcagaagcatcttgagaagagctcagctggatatggacaaatggtgatatggaacctcctcattgagtgcagtacgaaagatctgtcggtgcttaatcattcacatacttacttgagaatcaacgtacaatgattttgacagaacaacacctgacgcagacaccagcaacgcgtgatgcgtctctatgtaccctgtaaaatactagtatgaaacagtagaaaggcaggaaaattcagtacaagatggcaaaaggcaatgcccctggaatgcagtcgaatatgcatctttttgtctgtgttagaaaagaaattcaggtacagtcaagttattaagttggaaggttacagttcttgagtaatcttttggtctctgcactaaatcactataatttctttttttgtttccttctgttgagtgagaatttgcaagtttgaagaagaatgacaaagaaagaaacaaagaaggtgacacatgacaaacttcagtagactgcagactgtagtccactggtgggcggtcagatgatcggcggcggcggcgtctcccagacgtcgaacacattctcctcgttgtgcagggcgaagaggcgatcgcctccgatggagaagtcgcagatggcgccgccgtggctcctccgcagcgtggacgtcaggacgcactcggggccactgaagacggagatgctgtcgttcatcgacgagaagagctgcccgccgtgcgtggcgagcttcgggtagcagctcttctcgctgggcaccttccggttcatgaacttgctccgggagcttcaccgcacgccgccggcgttgctcctcaggtcgaggaacccgaggtcgtcgtactggttgatcacgcagacggaccgctcgtcctccatggcgatggcgtggagcacgcgcttgtcgtcgagcgacgcggccatgccggcgtcggaccacgaccaggccacgttcttgtcccggaaatcgagcaggccgatgaaacagttgtcggtcttggggaacagggtcgccaccatgagcgcgttggtggcgtccagccattggagcttgtcggcgtcgcccaaggcgcagccaggcggctcgtagaagaagtcggcctgctcgccggtggcgcggtcccagacgccgatgccgtactcgttgagcctgcccttgcagctggcgaagatgctcgagtcctggtcgaacgccagcgcgccggcggtgaaggacttggcctggcggtcgtgcgcgacgcggaagcggtgccgcaggtccccggagacggcggagaacgcggccatcccgccgtcgcacttccccaggcgctcgcgcgcggcgatcaggagcgtggcctcgtcgaggtacgccacgtcgttgacctgcgagtggtcgagcgacaccgggcggcgctcgtcgagcatccagttgtagacgtgcacggcgcccccgtgcgcgacgcagcaccccccgtcgggcgcggcgcggatggccgtgccgtccccgggcgcccgccctggcaccgacgccgcgaggcggaggcggtcgccgtcgaacgcgccccaccgcgcggcgcggacgtggtcgaggagcccgtagtagagcgcttccctgtagagcagcttctccggcagctgcggcggcacgtgcaggctccccgtgcgaagcaggtcgagcagcaccgcgaagcacgccgggttccggtcgatgaaatattccgccacgcctcctcctcctcctccaccaccaccgccgccgccgccgccggcggtgggggcaaggttccaggacgagtccagcagcgccccgagcatggactccctcccggcgttggcgagcgtggtggtggtcgtctcgaacacctgcccgcccacgttgaaccgcacccgcccgcctcccatcctctctcctccttcccccagcaagcaacccgatcaccaattcaccatcagtccatcatcatctccaggattccgcgcccaaatcgagtgggggaatcgtgcgtgcctcgagagaaattgggttgggttgggggagaagacgagagacggatttgtttgctatgtacgcagcgcgcgccagcgacgggacggagcggacggggagacagtcgggcgaggcgacccaaccggtggtgtttgctttgacgtgacgacggaatttagactgaagaaatggccactctaaaatgaacttttgtcccaatcaatcgatcacagacgggaaaaaaatacttcctagtacaacctaataatgtaaagattttttaaagagacatgagtattacgaaaatatttgaaaatagttggataaatgttttgattgagaaaatacatgaaaagaatgattatgattgtggattagactcgctcacgttagatgcaacggccagcgactagcgtgcgaggcagacacatcgtgtcgtccggagcacatagccagctgccagcatagttaggctgtgtttagttcaacgtaaattttatattttggttgaaattagagatgatgtgactaaaaaattgtgtatatgacagagtgatgtgatggaaaagtactgaagtttggatcaaaatttagatctaaacacagccttacagggaaggtcagcttcgctctctccaatcatcgcgttcgctacggcgggcgggccgaatctttctgccgcctcgcctcgttgcgctcgctcgcgcgggttttaatcgttgcgttgacctccttttgctgctcttcctgctcctgtcgggatcgtggctggattgctggaaatggcgcggcgagttgggcgaccggcaccgcggctagcttggtcgcttccggttgttggggcctttttccagggcagattctacagcagtggagactggagagaggaaaatggagacccccgtcgatgaaacgatgtggacgctcatcgtgcccgtgaggggatcagaagtgcaggacacacacacacacgttgacatctctcatctttgcatgttacagtatggggcagtagtacaggcgtgtatgaatgcgcagagacatggtcaatcctgattcctgagtccggctaatttgaatggttggtggtttggtgccacggtcagctcaccataatattcgcacagagaagaatttatggacagtggactataaagatgcaagttgtaatccatagcatttacatttataatttatagtattagaatgtgctatatgtcatattaagtctgtttttctatagtacgaaaaaggtatggagtatccgtattacatcatacaccgatttgttttttatgaaacaaaaagaaatacaactaaagagcatccctggaaggccaaaaagtacggagaaattaagcgatcaaatcaacttgtagtgttgtgtattataacatgggagcatctcaatagaaactaaaattttcagcaagtagtaactaggaactgcaaaacatgtaaagagagatttagcgttacaaaacagcgtattagagaccaggtgcgacttgcgagtaataaggctctgtttggatcacagccaaacattgccacgccacagcgtggcttgccacagacctgtggcggaccttctccccgcctcaaaaatcactgctgtggtgctatggcattcaatggctaccaaccaaacagagcctaactcaatataataaatgcaccgagactaaaatattcctttccaaatatataacctaagattggatttgtccaaatccctattagtggaaatatataagattagatttgtctagattggttatagtgaaaaatgtctaatccgtcctagattgagttgataaaactttccttttgaacaagactattatcaaaatttaaaaattttaactataaataatgtctaaaatatttagtattttaaaagtatggtggtcatatgtatagattgatcttaaaaattgcttcaacaaaatcatatatttatttatattttatattatattataataaaaattttcgtcaatattgttttttaaagactatatccttataaaaagatttatcagtccggagaggtattttttaaaacagagggagtacaacttatggttggtaccaaaacagaagaaaaatta

SEQ ID NO: 497 - DNA, 63513 bp, Oryza sativa
atatttgctagaggctcacagctgaccacaaggaacaaaagtaacacctacattacaactaccactgcaactgctacaactaccagctgtttcgtgacggtcgattagggcaagacttggcaggcaaccagccaagggatggaagccatataaattgctaggctgctcatgccaaaaaccttcagactgcatgcctcataagtaccccttggaagaactgcacaaggccagagcaaattagttatgagccttccttctgcgcttctttccagtagaaattttagcagacacatgctcttcctcttcagatgactcgccttctttctccttttgctttcttttggtcgaaagaccatttgtcttggatccatcagcagctttgggagtgcttgcaccttttggatttgatccgctggatttagcttcatcttttgaatccttgtgtttgctgccaccatcattttttgatttgcttgcgcttttagtgttaccagtctcatccttgttgcttccctttagcaggccatcctttgtcttgccagtggatcgagatgatcttccaccttcattcttgagggcactgccacttttaggtgtcttggatatatcttcatcatcgttttctgcacttttccccttcaaaggactgtcatcattttgtgaactattgctggagcgcacacctttagggcgtcctcttttcttgggaggatcagcgacatcagtgccacgatgtttcccactgcatacaaaacaagacaacagtttcagttaaggtgttgcatgtaggctggatcaatatggcacatccatatgaaaagaacctgctgggtgtttctatttttccttcctttgtttgctcacccaagctaactctaccccttctgccgtgcggcctggtaaaaatgatcaaagaactcaaatatataaaaagaaagaaagcaaacccatattataaaggataatagctgatgatgaacgaaactggagcattaggtaacatctgccagcagtatgcatgtcgcagcaaaatgaacaaataaattatgtgattacagttggaactcctgatcataaatagtaaagttccaatacaaacagaaacacagtaaatcttataatctatatggtagaaacataaactgaagataatggatgctgggaataatccaatcaaccacaactcaaagctcagaaaatcaaggtcattcatgctagagcaacttattttgtctccgttaacccattcaagaagcattccaagcatcttgaacccccatatcaaagattcaagataaggagattgcaggtttataggaatgacaatccgaatcatataaaagattttagtgctgatgtaactaagaaagtcatcaaaactttaagaggatatcgatgatgcaaagtagaatatttatttacatacatatcagacgatgcgtcaggattgttgtctcgcccctgcaggtagcagatgaatcagaaagtggctagaaaggatagataatggcgtcaaactgcatggacatacctcatcaatgaattcccatttttcattcttaaggtgtaggcgttcaacatctccatcatcataaacaacctgggtgccaaaaaaatgaaggtatccaaagatgaaactgagctcaaaaaaaaaactagcatttgtagtgatttggacagcaaaaaggcataagtcagagctcatttcccaatgcacaccttgtgcttttttgaagcaacatcaaatgactcaacaacacctttatagaacctgcagagcaagaaacagattcagaacaagccaaacaacacaccagtaaaactcatgtaagaaatcacatatcgtagcaaaaaagagtgaggagaccaggatagataaaatataggtgtgtaactcaatctagaatgaataattgtactgcatatattattaaagaaaaggtacatatttagaaacatcatatcaaagtaacgaataatgcaactgaagcgtcgtctgcaaaagaatatgccatgtcaatctagatcaagaaatttatttagaaaataatgttcatacatatgaaaatatcatcataaccaatgaagcaatgggtactagttagcctacaaacacaatcttaacaaactcctacatttgagaaacataaatgatggttatagaacttactttctgtcatcaggccaccacactttgattcttgagccaacaagatttcctttaagaattttgttcttcttgggctggggagtctgatgaaagcaaagaaaaagatttgaacaactgaaacagaaatcagcttgcaacaagactattcactaacagcaataagaatcaagtatgcatatacctcttcagcttcctgtgcacgtttcctttttgagcccccactgtcacctgcctggcctttgtttttacctgttttggccgaagacttgggagatacgatatcctgcgttatgataaaacagtcattgtggtcgatcatcatcatcgcatgcacaaacatttcaacacaaacccatcagatttacaccaaatgcaaataaagctctatgaatttcgccgtagatacaaaatagttggtggcaggttgccaagccaatcaggaagttaaaaggatgaaaggcagagaagtttaaaaatatgagagccatcgacccaacatgttatagttttggaaagcataaaatgttttgaggttccactatttctaaataacactcctaccaggaaaccttagaacatggagtcagacagatataaaactatgaatatgtaaaacagaaatccaaccttctgctagtgatatacttatgcacgacctatgtgcaaagcaaaacctcaaatcatctactgttgacaaagaaactacctttaaactgagatcctcatcagtgtcttcatcgggtggagtatcttcctgctgtttcaaattttccttctgcttcttcttcgaagattccccttcaccagtctttttgaatgaagacttgatatcatcatctttagctagtcgccttgtagcccttccaccagaatcactaactgcgtcagcttttttagactctaaacctgatactttgccttttccaacattcttcttctcatgcgactttgatgcaggaggccggccccgctttcccttgccagcaggtgtgttatcaacatgtttcgatttgtcatcagcagctctattcccagtctctggtggcagcttattatccccatcatcagtctctggggataactccctagagactaaaatatcctcgttgttgttaacagccttagaatgatcaaccacttcagaatcagtggaagtatcaagtttatggcttttctttaaattgtgatcagatggcttttcaggctctgtggtgattggttctggtatttctttagcaccggatatcaaatcatcagtgtcttttgcctgattgtcatcagaaggcagttcagccttcttatcagaagaggatggtccacttggagacttgaccctgtctattaaagcacaaccattgctaaccgccgaagtggaagtattgtttggaggagtaccgtcttttccagggcaattggcatcttgctctaattttgatgattcctaaggaataaaatatgttcattgtgatatctatctcactttcaagaacttcagattgaatgtcagtagcgacatacctgagctgactcatctgaaacaatcttatgagataatttcccatcagccacctgcatcacaagctttcatagtcagcttggctgaaataaactaattagtatatcagaagaacattggccggtatgatatcatatcagattgagagaatttacactacaaacttttacagatcacacagttgataacaccaggtcatggaccattctattgactctaccagaaaccaaaaaatatactaacatacaatcaagcatatctttgaataacaccaaaaaaacaaaattaatcccaagaccactgcttgatatttcacagttgatactttttcagtcaatataactttcaaccgctaagacagcattccagggtccaaattctagttattacctgatgggcaacgtgacattttaaatttaacatacatattactccagaaagaatgccatagaattgcctgtcaaaatagtttatatacagcatgatatttaaattaaaatacagttgatcatacaaagaaatgcctgtcaaaacatttctatgtctcgtgttcctctcccaagtcccagtggtggctatatagcataaaccatattatacctctatagagtgacagatctaaccatttccagtagcaaatagttgaactcaatgtgtaagactaaaaatatgtgttaaaggttgaccacctctaataaaaagaacatgagcagtctttgcccatttgaacacatctgaaaatacattgagaatgccacaaaatgcactaactctatggtgagcaaaccttaattaatattcaaaaaggaaatttgttagtagtttgactgaccatatcctttccaggggcatcagaattgtcggctactccagcatctaaagcatcttcgaacaatgatgtaacaacttcgctgtactcatccaagggagtgccccgaagtaaaggagtaaacactggctttaacttctcataacacttattaattaccttctctgcaagttcgaaagatgctggaagagtttcctacagagcaaatttgaaattttagtgaagatgatcagatctattaattttaatatgaaagatgtaagtgaattcgaattactttttcttcctttttaaggttcttcagaaggtaagatgctagatcttgaagcaggcaggatggcatatcttgctggacatcttcgctctcatcaattacaaacttcatcacagtttccatcgaggtgatgacattctcttgatgagtattgctgaaataaatataacaaagtaatgaattataggataaagaagacttaagaaaattaacagaacatacgcagggcagaaccatgaacatagacataaagcaaatatacacaggaaaacacataggaactattgtgactttatgagttttcacgtcaaagcaaattgtgaactgtgtaaacttgttggaacaaatcatcatgcatgcttttgcacattattatgtgataagagaaaagcagaaattagcaggttctagacaaacagacagaggacaacaaaggattaaaattacttcatggcagattgtgccattatattttacgcagggaacaaccgcttgtcggttttaaaataaatgatgaacataagctaacaatgaaaaactggggaatgggatatggcaactcctcggtatgtaaaatttagcatcgatatgcatgtaaaaaatgttattccccaaagatttgcaatcagaactgatagctgcggtcaatttggtgcttcaagtaaaaaatcaaacgcaacaacgcccaatgatatcgacaaaccatagtaatactaatacatgatgtttcccttaaagtaatcttaactggtgagtgtaattgcaaatgcagttctaacttcttctccatgtacataatcatgccaaattagcagcataatattaatcaggcatcttgcaagtcaataccagaaccacaacatatccctagtcaatttaagaacccgaaagaatcggcattctcaaggtgaagaaaatacgaaatgaaccagcaaaagaagttacacacgatatggttctgaagaagtggtgaaacatgtcccgtatcagatcgtcgcagtcaagatctagcatcaagacacagctccggaccttcgcaacggtttcaagcatcgcaaccctccttgcataggaggggctttccatatcatccaacttctcaaaggcctcaacaactctggtaaatacatcctgcaacaaagcaagtgacaatggtcagtgtgagcaggcacaacaattccgtagcgataaatcttgcagcagagccagtgacaagggtcactacaagcaagcacaacaattccatgacgacaagaagacatttaccttcatgacatcatcgtcatagggggcctccggggcagtgatcctggtaacctccgttaaacaggaggcaacagcaagctttatgtcagggacactgtgatccagtaactccttcttaatcagagcactcattgttggccggagagccttgtgcatgctctccggcggcgactggtcaaccctggccaaccaggtttctgcctcctgcataaacgaatgagcagttctaagtttctacccaattaataaataaataaaacattctatttatacagatccaaacagcgaggattaaacttcacatcaatataacaaccagtacatcctatcatgccaggctccaatctccacggcaacctagaaacgaacaacgcgagagaaaattataagaagaaaaaaaaaagcagggtcaggggcgctcacctcgattaatctgagcagctcgtcgtcggcgtccgggagcgaggtgaagcgggcgccgatgtcgcgaagcctccgctccacctccatgtgcgcgccgtcggacgccatcacggcggggcgcgcgcggtgccgccccagcgggagaagcccgcgcgaagatctaccccgagaagtagtaggaggagaagggggagacagttagggtttcgcgaggggactggagggggagggggagggggaggagagggcgagagcagcggtagtggggggtgggagatgcgatagagatggagtgtgttaagatttgagaaccagattttcccctctcaagtttttcggatcccaaactgttttttttttcctccccttttccctcctcccctctcgcagctattcgttcggatgtcatctcgacgactctcgctggggtttgggttgggcctttgggccaaaatcgaaaggcccgtcaaccgattgattgcgttaactgagttataaaaaaacaagattcaaccacaatggcacagtataacacaacaatgtttgtgaaaaaaatatattagtgtgcatatcgttagctttcctaccagcctactaataaaattttacgtcgtttggaaaaagctaaaaatgttttgcggcattgaggttccatatttgaaagtgcagaaattgagagatgatttgattgttaaagttgttttgaggatccctgttatcttggctcttaaaaaagctgggtcaatctgaggaacgatctatgttctttaaataaagttatttgagggttattaagacatccaatacatgtggtgggagatgtgtgagatatataaaatgactctggtctctatataaggtttataatcatatactatgaaatctattactctgtctgatcaaatttatttgacataagtcgggtatttctagctagatgggtattgtatttgtcacatacaaacatatctggacaaccaggcgaagtgactttttacagagccgctcatatcgtatagcacataatatgttcatatgtggtagatttagaccacgggtaacttagagaaaagatataagagaaaagagagaggaatacatttgtgaatataaaaacaactgattaacatggcatgtgaaaatcagtttgttgatgttgcgttacagaggaacaaataacagcgtagtataaaaaattgttgcgatgcggtttcttgcataacatggagcccaaacaaatactaggtttattatacaaaataatcagtaaacattttgaatttaaaataaaaaaagaacatctacacccatgctttctcgagtacccctacacttatctacttaacatgtgctttctctattagatctaagatttgaacttaagaaacacataaaaagacaatcagatgatatagcatataccgaaaaagttattgataattgggtagtctactataataaacctttgattaaaatatcggatatcgctaactcaatcctttgtttggaaaaatggcatgatatatcgaagaaaattacatgaggccggtcctaatcttctggatggcatgtggtgcttgagctaagtcatcagcgctatatttgatctgatgatgttggcaaaagtggcaaacacgttgttggtgaccaacaagggagaaaccggggaaaagaggaacatggcgagaaagatgaggaaaaacgtggaagaaggatgactagaaagataacccagcatgaacaattaattaatacgatggatgtggaaatcacagaggaatttcttcttcgttacccaatggatcagatttaatcatgatttgattgggtagtttaggatatgccaaatattgtccccacctgtgtagtaatctacaactatattcacctgtaagcgtagaatccattttttttcaaggaacaatgcattgaagtgataaacaatatagattgattcagggaacatatggcacatccttttgcacaaggggaacaaattattgggacaaaacgacctagaggatgagagaatatcaaactcttccttattcctttagctattattaacaacacattatatggggatgactatgactcctagtcggtatgcatcatccgacaaaagtgcattttcattcgatggattgattcatcgcccaagctaaccatggagctatggtttcttggcaaaccgcccttagagacccgcaggggggggggaggggggatatatcggatatatgaagtgactagagtagaccaagtctattagcgatactttgaactataactttattaatgccgaaagcaaaagataaaatagcaaactatcctgatcaagtaccatatgaaaagaacattgcaagccaagtcatgccaatctaaggagcgcaaacaaagtacgaagatcacggtatatacgagcactccctacagaaataaagcaaactttatgaaataattagggcatatgactcattgagattttaagtcaagcaagtagctagactagactaatctagatagcttaccatatttatatcttatcttactgaaataatgcacaataattagggaaaaagtaatattacaaaggacaagatttatatacttaataccgttgagcactgaagaaagaaatagaaagggtgcaagggttacaggagagtgtgaacatgtagctaagggatttctcataaatgtaaaagcatttttgttcttaaaaatgtataaaaaccatttcccatcttacaatttgggattgcattttttggaaaaaaaaaagagaaggaatccacaaaagtgcccaacacaaagcttcgaccattgccgtcccaagcgttcaaattttccacctcgaggcctacgggcggcctgtacgatttacctgttggttcggtcgctccgttcttccggcttccgcctttcctcgtcgcggctatacggctattatacctaccagccaccacaccacccttttcccacacttctccactgactcctcgagatggatcccgcgccggcgacccctcgctggaacctggagcggccgtacctcaccggccgcttccatcaggtacgcctcctttctctcctcctcctcctcctcctcccctgtctcggctgcccccattgccgcctccgcctcatccaccctcgcgctctctctctcgcaggaggccaaggtggctgcggcggcgcagggggccggatccaagccttactccctcgactccttcaggtgattcgccggttaaaatttcgcgcgattttttttttggtgctcgcctcgtggtttttctgatgccccggagttcgtttgaatctgcagccccgtcggcggcggcggcggcggcgctgagagtgtcatcggatcgtacgccgtctcagtgcaggtaccggtagcttgtacttttaggttgtttagctggcttaattggcttcgagcgactacttttttaatggaccgatgctagggtttaggttccggttccgcgcttctacttcgagctcaatggttcgggttaattggaagaattcgtcgtgttttttttctctctacatgtgcatgaactgtaaattgttgttaaccagagtctggattggagctaggaatgttattgaacactgtattttgattttttggactgcctacttccttgaattcagaaaacaatattatgtaacggtgctaggttagaattttcttttgatattttggttcatgtggtcaatgtagtgtgagtagatataatttcagataataaaatattttgttacataactcgaatcttctgtttgaatttgagtgattctcagagtttgttggtcggtggtgttcatgacatactgacatgccgtgctaagtacaacatatttgttgtaacaatgtcacaaaatagctgcattttcactatgttgctttaagcagctattctatgaggctcaatattgtaatatcttcattttgcacatctttaaaattatctgaagtaatttagctttcacaaacaactgaaaagtgtaactccaacctatctgttattgatttgcaggagcttttggtcattgatgatttgttatcagctcttgtgggtattgagggacgatacatttcgattaagagagtacggggaaaggaggggtatgttgtcttccagattgattcttcaatggaccttgcactccaggtaaggcctgaagagtacaacaactggatcatgaattgcctccaaaaaggcagatgcgtttggtacttaactctttgggtttttgcaggaattaactcgtcggatttttcccttatgtgaggattttgtcttggtataccattttgtggagtccagatcacatttcaagagtggcctggtcaaccatgctctagctgcagcattgagggcattcctcttggtaaactccctctttcgagccaggaatattttaattaatttgccttgactacaagctttcttatgtttggaaaaggtggcaaaaacgaatatactaacaatttcatattatatagtaaaaacagtaatgcctgaatcatgagttcaagtgttcagttgtttattctgacatggaaacatttgcataaattgtattggtagagagtaatcttattacattatccttaaattaaaagaaggcctatgttttccagtattggtcctcatatgtgtatttggcacgaagttaagtgttttatttgtttatcaggattatcaggcaatggttgctcaactggagcaccagttccgtcttgggagactgtcagttcaaggattgtggttcttttgtcaggtgagttttatttactgcattaattatttatcctgatttgattatcatttttaagcacagcaagtcctgatgtgctttttggcagaaggatgatgagttcattgaacgcacttgctgttctagtcgagaaagctatctccaataacaccagtggttctgctacacttaatctacttcaaagtcaggtatttcacctctgagatacattttttttcttttgcatctctctttctccaagtacgagaatctggtgggtatgaatatcgttttcagtaggctcctgcaatccaagctgaacagactggttttcttatcggcataacatatttctttaacatagccgatttctcaacattcagttttttgttgccttttcattctggtccacatgattagctctttcatccatgtattaaattgctgtactcctttcaacataggcaaaggcaatggctggcgatagtgctgttcgatcattactggagaagatgacagagtgtgcaagtgcagcgtatcttaagatgttagaaaggttcatcatgttcatatcttattgtctttgctacttatcggttcttacattttgtgttgaagttaacaagcattttgtaattgccagttcttaattggattgtagtgttaagacttaagacttgtttagattaaaaacttaattagcttgtctgctgtattttgataatttcagcttctaatgggcttcattttaggtgggtctatgagggcgttatagatgatccttatggtgaattcttcattgctgaaaacaaatccttgcagaaggtaccgaatgacttagaatttctggcctacttaaattccatcgttctctgcattttcataagactagaatactgggtttgttatattcttaagataatcagaggctttctttgattttgataggagagccttactcaagattatgatgctaaatattggcagcaaagatacagtctaaaagatggcatccctagtttccttaccaatgttgccgccacaatactgacaactggaaaatatcttaatgttatgagagaatgtgagtacactgtccaggtatgcatgattattttctgtggttgcatcactagatgctattttatatgtgtgtgttataagaacacacttgtcttacatactatgcttaggttcccttgtcagagagttctaagctgatgggctttggttcaaaccaccaatatcttgaatgcatcaaatctgcgtatgactttgcaagtggtgaactcttgactctaatgaaagataaggttacaattgttcatagcaaatgcactattagatttcattttcttctgtggtctggattctaattttgttttatttaccgtgtagtatgatctcattgggaaactgcgatccctcaagcgatatctacttcttgaccaagtatggagaaaattgtggagaacatttactctattatgtattattactccacatcagtactctttaaaatccacactcgctgggtatattctattaatacaatgatattgatagtgacaatgcatgtcatgttgtcaacttgagtttaaacacatccatatttattttccttgtattagttctccaatttgctttctttgttttgcagggtgattttctggttcactttatggatattgcccgagaggagcttacaaagaaaccagaagaaatatctgttgaaaaacttcaggtatcctgttgtgcagtattgtctgtctgtttcttgctatagtctcatggcggaaactgatttttgactgctctggtctaagctgatccttctccagtgatatgttattccttcttcgttatatgttcttttgaatgaattgccattctatgtttgcagtctcttgttgacatcgcgttgcgaagtacggcagctgcttcagatccaagtcatgaagacttgacttgctgtgtggtaaatatatcatctatgtctcgtcaaaccgtattgtgttttgttaatcaataatatttctttgtctatttttaaacaggaaagaagttccctccttaagaaattgagcaccctgaaagacttggattgtgcatatccttcagacaagcttgtggcagctgatgttgaccatcccatgccgttaagtgtgactggcttggaaactttctgcctgagctacaaggttctatcttctgatattttttattcgttgttctaccttctgacagagaaatgatatgccaactatatatttcaggttcaatggccactatctctagtaatttcaagaaaatctttgacaaaataccagttgatttttcggctgttgttccactgcaagcatgttagtcgacaattgtgtacagcatggcaaattcaacaagtatgaatgaaccttttcttcacccccattatatcagcttaattgttttctgtttactcgttgactgatgtagaactctcaaccagggtttccgttctgtcaaaatcctaggaacaccagtcctacggtcatcaattctttgccgcagcatgctcaagtttgtaaacagccttttacattatctaacctttgaggtaaagcatccatatcaccatactaactgttaccaaaggtgaaaaattgctaaagcattcttttgggtcatcaggttcttgaaccaaattggcatttgatgcatgatcggcttcaaactgcaaggagcatagatgaggttttaacaacgttcttatgatgaagaaagatgtattgcgaaaggggtacattaccattgctgttgatgttgtttgcaggtcatacagattcatgatttcttcctgcagaagtgtctaaaagaatgcttattgttgttgcctgaactccttgtggttcgtcttcttgctcttttatatacagaagtgtttgtcgctgctgtacgttatattttcctattatctgagctctttttggagagaaaagaattaccagtgttgcaacaactttacctcctcttgttccttttaaaacttgttgctttcttgtgaaagctgaaagtaatcactgattgagttcagaattagatttcttgcgatactggcattccagtaatggaaagttaggaactaggcaggtcagtgatcaggtcatctgactgcaagataacaatggcaacttgtctctttactgttaaagaagaaagtcactgtctttaccacactgtgtatccttagcttgatttgtgtgaattatatcacccggtgactagcagttttacccttagccctctgtttcaaaaatacatggtagtttgttttacactgaaatactgtagaagattcaatgtttattttattcttattattagtatatttgtcatgtgcagaaaatcgagaagctgaaagctctgtgtctccagtatgcgacttccatccagctattgataccatccattgatgttgctaagcctgaaaatacatcaaaatctagaatgccaagatcaaaaataaaagaaaccaaaaacagaggccagcaactgaaattggcatcggaaaatgttgtaatgtcagagtcaatcttgtatgattcacatattcagtctttttcacacaatgttaattttgtatcaattgaacatcatatgatacaatcttggactgtttgctgcaggaaattcgaggcagaattcaattcagagcttcaaagtcttattcctacgctgagtaacagttcacaggcagaaccatacttgactcatcttgggcagtgcattcttggtgtgggagttgatcaatgattgctgcgcgccatgttccgcggacttcagacgattgctaagtttgcatgtgcagtgtggaattcctcatccccgtcaaggcggtgttcttgtgaatgtattgaatattgatgaaatatgcatggtatgcttcaacaagatagatagtactgtaggatttatgtagtgttagttctcttggtggtgttgggccgtgggtagtttaggcgtttctagtttgttctgtttgaagattatgattgaactcctacgaagagaaactgccctgtggtactgctgccaccaatgtaacttgaactagatgtgatgaattagtgacaccactaacaatttgtcttgggccgttgtttccttggaaaatataaaatatgtagtggaaataactatcgttgaatttaaaatgggcgtctgatatttagtacgtacatatgatttgcagtagtacattatttcccttgttttccagccacgtgcgggccgtatggtttagggcccctttgaatcgtaggaatgaaaaaactaaggaataggaaaaacgcaggattctgacaggaatgcaggtgtaaaatagaggattgaaaaatacaggaaaaacacataaatgaccgtttgattggaacataggaaaaacgcaggaatcggatgagagatataaactcaaagtaattttttcaagaggttggacctcttgctaacttttctccaaaatccctataggattacctattccataggaattttaaaggatagtatagtattcaatcctttgtttcaaagggtttcataggaaatttttccatagaattaaaatccttcaaatttcctacacttttcctacaaatcaagtgggcccttaagctgaaacggattcgcagctactacaagcctgcatggggtgcccactatcgtgcggcctgcgacgtgttgggccggaacgggattcacgggaacgtgctgcgtgtaccgacggaccgagcgaccgaccaatgatgcggtcaggctgcaacgaaagctgccttgctacctaacgccgcggactcgtccaccagataaacgtcgggtccatctccgtatcacccgcactggatccggactagtggcaatttgcctaattcactccccatacaaagcataacaaatggcaagggcataaaaaaaaagttcaatgtgtttggtgaatgctgcccttttttgtaatgtcaattcgtggtccaagctgcactagttcaagtcttgaaatacccgtgtaaaattcgcggtacatatacaacgcacatatcatatgctattatgcttattaaccaatccaaactcaaataagatgcgattttcttcaagtctcagcgatcaataaccttattctgggttaatatctatactatgctatattagtatctctgtctcactcgactctaacgttacttaaatactactcagcccaaaatataactacttcttatcctaaagtatactccatccaaaaaatacctttgtaccatttgagtacagtttctggctccatcaccaattagcctaccctcatttaacttttactcaatcctacatgaggctgtgctcggaagatgatgttgggaacaaatcttatgtacatgtaaaaaagagtacaactcattagcatatatttaattaagtattagtttaaaaacttaaaaaatatattataataatttttaaagcaacttttgtatagatttttttagagaaaaataatatcgtttaacagtttggaaaacatgagtatgaaaatcaagagaggaaaagttggaaacctacactactgaactcgaacctaaatgatctcccatttgataatgggcatggtagtttttccctttataatattgtcagtttatcctacaaagtgtatttttcttacaccaaagtgttagcgcacatagattagagtccctttgaaatatacaacttttacaaatatacaatatcttcaacattcctcaatagctatgaaatatacaaatcttacaaatatacaattctttaaaattatttattagcaagttaggaagattttaggcctccatagtttggctaaatatggataatacaccattcgacgtattagcaaaatagtaataatttataggtaaaatttttatatatacgttcttagcgatttaaatatccatattgaaaaataaatttcgatcgaaaaaatttcaaaattaacgatggggaccttaatgccaacagcctgcacccttcgttccattaaaaaaataaacttgtgactacaaacctctggcgacgttccaaaatacaaccatcagtaagattttccggcgacggcgttggcccgccgttggatcgcagggaaatccgcgtccggcgcggcacacattacacatacctccgtgctccatgactccgtgtacccacggacccaccattttcctcgccgcagtaccgcaccgacccgcagttagctcacttcccactcgcccacttcccccaccccactctgcctccggccactgccgtctctcccattccccccaaccccaccaccaccgcgaaacaacaagacgaaaatcacacgcggacgcggcccggtcactcactcacacgccgcgggacgagacgaaacggtaaagaatccggcagcagcaagcaggagagcgcgagctcggcgtccccgctccgctccacacgcattgcccgctcgcccgcccgcccgcccgtgagcgcgagcggctggagcgatggggcggcgcgggggcgcggcggtggcggcggcgtgcgggcggtggtgcctggtgatcctggccgtggcctccgcgctcggcgtctccgggccggccttctactggcgctacaagaagggcttcgcctcctcctcctcctcctcctcggtctccgcttccgctgcggccgtcgtctccccctcctgcccgccctgcagctgcgactgcccgccgccgctctccctccagtccatcgcccccggtgagctcacctagtcccttccctcccctcccgtcagatcttgcaaccgcccgttcgcctgatctgcgcgcgcatagtttgttcgataaaaatccaatccgtaggttgaaacttgcagcctgcaactagtgttgtgtcagatcgatgcgggaatcattgcatatttgcagtgtataagagctgaaatcagtactaagtaataggaaaactgaactaatttgcgtgctctctaccttgaacgcttgtacatcgctatcaggccatcactgactggattttgcaattttattcctttgcagggcttgtcaacttctcaacttcaggtttgagctcttccttccttcatagtccctttagctgagctttatctttatttatccaatattcccatgaaatcggttgagtataattgttatctgatggaagggtggtagcattcgtgcttaagtcgtatgatgtttccgggactgaatggtttggtatgcaacctgttacctgtagttttgggaagtaacctcagcaactattttgatgcctgggacgattaacgtgactaattgagtattagggtagctctttcaattattgtgctatgtaaatgtggcactgttaaaatggggggaaatttcatttgttgctaagagcacccctcttcgcatacagataaaaggatgcgtttaaacatttactacacctctttggtgtgtagcactagtatttgttggcacgcatcacactcacagaagcttaggaccaaaaatctgcctgactctgcatactaaccagattttggtactttgtggcaacatattaacagtatgcacctttaagtggatttcttactggtatttccagaaaaaagaaaggggggtatgactcagtgtagtaatttattgtgttgtgtagaatagttagtgcagataaagctaaccatttctgtaatagttttcccctgaaatacttgagcccctaaaattttgtcttgcctggagccctggacctgcacatactgcttttatgatttctcctaacatctttggtacaatgctccattggatagggaaattctctcgtgttgctctgcaagtagttgttataccttttgtataaacgactacattgctccagtctttctgagctgtagctagtgaaatattttcaattcgctccttcccatggttgaatcaattttgttctaccccctttttcgttcacgacaactgcttgatcttattttgttgtacctcctttttctttcataaaaactgcctgaccttgctggtgccattaagcatttgacttgaaacatacaggttgtggcaaaaatgaccctgaacttagtaaagagatggagaagcagtttgttgatcttcttaatgaggagctcaagctgcagcagattgtagctgaggagcatagccatcacatgaatgccacccttgttgaagctaaaagacaagctactcaataccagcgagaggcagagaagtgtaacgcagccacagagacttgcgaggaagctagggagcggtctgaagcggcaatttcgaaggaaaagaaactcacagcattatgggagcaaagagctcgccaattgggttggcaggactctagacctagagtcacaaccatttgatagcttgacatgtcgttgtatttcctttttcttctacaggtaaaattatttttggtagctgctggattgcatcctgcagccaaaccgagcagtgttaattgtacggctccacttgtaatgtatgtctatgtattatcatcagctgtgccaagagcaagaatatcatagttaaatgtaactagtatacatttactcaatgttcggatttattgtgacataccggagatatgctgtggaatgtggatgacacactttgtttatgatgcaatgtacgcaattctagtcttagctaacttaagctatgcttttgttcttgtataacgaagtatataaatggcgcataatgcattcttccctatgatttgttttatgggacattagtcatcctgtgcatttgctccataagtctggttccaaatagtgatatttacatggttggaaacctgacagatagccaacatctgtgttatgttggtcaacagaagtgtattggaacacgtgtgtagcaaacttcattttagcggtgacagatgagttcctgtcttcctagaggaccttagacatcaattcgtttaaaaaatatttacacatttgcgttgcgtttaaaaaaattaaattgttgcgttgtagcaaacatcatcattgtgtgaaccagatgagttagttacaaggacggacaaattctcaatactcttttcaaaaaataaaataaattctcagcaacttttaaagaatggaaccggaacaaagttctcaacgaataaaaagaaaatctccaaaacaaaatggcaaaatcaaataaattctcagcaacttttaaagaatggaaacggaacaaagttctcaacaaataaaaagaaaatctccaaaaacaaatggcacaattcaaaagttatcaacaaataaaaagaaaatctccaaaaacaaaatggcacaattcaaaaaattatggcccatgcaggtctcgaacctgcgaccttcgcgttattagcacgacgctctaaccagctgagctaataggccaattcgataaatttgtgttatttactgtatgcaaggctattggccattatcctctctcgaacctacgttaccctgcacgcttgtgtattttcatcatcgaagccatgaagatcccacgccgagcgtaccggcctctgaatctcatgagccacatctcctcctcctcctcctcctcctccatggtaataacacggagcgtaataaccgtagtgccccacgccgccgcgcctctgaaactcatgagccacatctgctgttcctcctcctccattgtccggcggaggcacaggcaccagatgatcatagcaactcggaacgtaagcgcaaggcacaggcaccagatggtgatgatgacgatgatgataatacgggacgtagtagccgtgcctctggaactcgtgatgagcctgcgcatctgctcctcctcctccgccttccccgtgatcatcatcttcttcctcgagagccaggatctcgaccttcttcccggtcttcttcttgatccgcctcaccgccttctccggctcgaagtcgccgccgcccgtcaccgtcaccttgttctctcccctctccacctcgactttctcgactcctgcgtaagtgtagttggtcgaaatctcaggtaatatgctttgagctgaagattaaataggatgtgtcttttggtggttttggtttgttattaattagttaccgtcgattttctctatggctcggcgaacagatcgttcacaggctttgcaatgcatgtagattctcagttctagtttgatgctctgtacaaggaaaacaaacagtaagacggtgtggttaaacggaaatgatggtggtgattaaattggtgctttggagttcgtccatgtgcgtagtatgtacgagttcgcaacttggaaagaaaacttacgttcgtggagctagcattttcttcatccatgatgccggcctactgaacacggtacggtaagatgtagtatgaaaatcaccctgaaaatgtggaacatgtagtcaggtagaaagcaaattcagatgggcagaagtagtaaaatccataatatggtttcgacattccaatcaaagtcacatgtgaaaattcttcttttttttggataagaagtcacaatgtctttgaaccacaattataaattcccaagcgcatttcatgcagattaaccaaagacatacagtcaatcacaaccaatgaaaactcgcatgctggagcaaaattttcagaaaaatgcataattaagtttcatgcatgcaaagttagctatcctccttcacctggtcgtctcattcatcaatccatgccgatcgcgtgctctctcctggccaccgcaacgcctgagaaaacgcgaaagacctgacaattacacggattggtagaggtaataatctagctgttcttgcgccaatgttcagggaagaaagagaatctcttctattgtacccgctctcgctgtcctaagaattcgatcgaccctgtttgggaagtcgcattgaccatcaaaccacttctcggccgatcccgtcgggaccgggttgtctatttatgaggtggtaaagagtgataggactagaagtgggggagaagaggtcgccggaaagaataacctgctagcttcacgcgatcactcccggccgcagcctaaattcgcgtgtcgttgacaggaggctcctcctctgaaatcttgtggcagaattattcctctgcatgcggttgttgcggcattgttcctctgcataagaggcagcggagacggacggcgtcgccgcttctttggacgggcccgccggcgagagcgcgaggacggggctcgccggagctccgggccggtggtggtagggacggaggttcgggaggcgggggagaagaaggctgtacgtaatgcggcccatggttcctgggcctgaagtagttgtgccgtagcaggaggcccacaaccgcggcgacggggttgggccggaatgggggttttcacggattattttttttcatttttatttactttctaaatgtttttaaaaataaattaatttttcaaagttttgcaaaaatatactcctcccgctataccgtatagagcggaacatataaaacgtcctcctctcctacaataggatggactatgtgacgtagcacaatgcgaaaggacgtaccatggtgattttgcaggcggccctcttcgcgtcctcccaaaggcgatttagtttgcggacattagcaatagtgtgttgatgtataggatacaccatggtaattttgcatacaaccccctccaagtgataaatcgtcttaggggagggataaattgctctagagaagatcagaagagttataaggagccacctacaaaatcatcatgcacgcccctcttgtggagcatcacatcatatagaatgctttattgtacgttgatttatatgccttaccttacgatagaacgggtggaaccgatttatatgcaccacccaacggtaggatggaatgagtttatttcttgtaaaactttgaaataagaatttatattttaaatcttttaaaaaataaatataaaaataaaatgaatcgttctcacgtgtgtgacgtatttttttcagccagatccctagtttggatcgcgattattcgttgctatccttaatttcgcgaagaagccctaattttcgatcatggaatttttcaaaaacgtactccaggccagtagaccaggagtgctattaatcctgtaactttgcaaacgagaccctatttggatctttattattgcttacgatcctcagttcagacttcagagagagccatagccagcccgccgctccccgccgctgcctcttcgctcgtctccgtcgagtccgtcacgcaggtaaaatcccccgccgctgactcgcgcgctgatctcgtgtgtgttttggtcccgatttgggccgagtttgatcggcatgccgcctgggtggtgttgattcgggtggccttccgcaggggatagttggggggatcgatccactggttctcgaactgccatagtacttgctttagaggtagcggtttcacttgtgtgatcgaccaatcagccatttctgctcgattaaattcggccagacctgtgtaaattggggtttacgcgaaccgaggaggtgttgtagctgtgagtattcatgccacatgcccacattgatcaaattatgctcttcaaacacatgaatctactaaatttagaagaaagaaaaaaaaacagaggggctggcaatttcatagtggattcatttatttttgtcatctcatttttctaagttcttaaggaaatgttgtgcaaattaagcagaaactgtaataccccaatgtggtttcgtattagcacctgtttgtgtgacaggagattctcagattttagatttgaggaccatcaatccctcactacttcactagcatctacttgtcatgggataaatctgaagtcccaagacctgtataaacgaaatttctccaattctcatgcagatcgtagtaaactttggtctctttgtttcatccagatcgggagaggtttgacagtgcaatgtaatcgataagcaaaaccgacagatacaccaaatggcacgcctgtgcagcttcttgtttgcaatgatgtgatctggcagaaagaaggcttgttggttgagactgcagtagccttgggcagatacacttgatgatttattgatgcagaaattagtgcttagcaacataatgttgtctgtgtactttattaagctaaatggacaataaatatgctgatacaatcagcatgccattcctcgaaacgaagtactaaagagaataaatatcgaagaggtttttcagcaaatagctatgtcttcctcgatgagaagaggtaggagcattatctttcatagttgtttgaatcgagttattctgaatccctgaatgttgatgaagcttctatgcctaatctgcagcaaacccaggagttagagcagtcaggaagccctggagagaaagcagtccaaggctccaagctattagttttttcaagaagagaaacctgtgaccttttggtgcaatgtcctctttgggagatgttctgcacaacatcttgtgaattgtgatgctagatttcatttcctgttgcttgctttgcttccagctgactgtatatacatataggtgctggtatttctggctctgtgtgcagcagattgcttgtcatgtgctttttttttttcagaatgctctactgattacatatttacatcttcccagaaatcttgtttatcaaagtcagatttttgcacattttttttggagagatcctttgcacattttactcgtctactcatctgacttataattatttttttatcatttcagcttggtttcatgactctcatctagcacaagctcccggtctgactcaagccgagtgggctgggcctgggccgcatcacgcaggcacacgagctgggatgggatcatttggactcttccagttcgcgccttatataatgacctcacgcacgttggctcgtcaatcatcatcggagcagacacgagagcggcgatctcatctcaggcgcaacgctctgcaagtctcggagcgctgccggagctggtcgctgcacggcgagctattcggcgatggatcaggggagctcttcgtcgatgtcctcgtgctcttcttccacgacggcgtctaccgggcccgatcaaagaagattgtcggcggcggcaccgacgttcgacccgtctatggcctcgagttcgtccatggcggctacgacggcgggcgttccagggagctcgccggcaatggcgcctctgcttacctctgcgaggatgtcctcgggctcttccgcaagttccactacttcgttcgacccagcaggatcgtcggcgttggcacctgcgcgctccccgaggccctggattgtcggcgtcggcacctgcgttctacccgacgacggcctcgagctcttccacgccggttatgccggccgttcagggttcttgccgcagattcctgagcccaccgcttcttgttccggtaagcttcgaaaggagttctttgtgtatctttttgttgtttcgaattgtgattttcttcctggttcttgtggatcgatgaatcctttttgcttcgattcccaagtgcttatcttggctctcccgaatcttttgatctttgggttctgcggaatctttcatggttcttgttttcttgttttttttttggctcatcttggctttcctgcataatcaccttcttgttttcttggttctgggttttaactcttcgtgtttatttggaatccttttcttgaaggagacaaaacgtgatatttttttataaaaatgatattagcgatttcactgatgaatctttgagaattttcttggtcctgtatgaaaaaaaatgccatcttttgtttgatgttcggtagtctttcacattttccttgccttagatagtttgctgtcattttatctcgggcagcgattaattatcgtgatatcttgatcagactttccttcggagatgctctggcatcatccttgtggagaacagaagatcaaaggaggacggccggaccttcttggtcgtgagtttggtattcttgctgaacagaagaggttgattcagagacatttagatctgaaagaagaaatgcatttgcgccataacaaggagatcgagaatgccttcatttcggagacaaggctggcccggggtgtggagcaagatctgcttggggactgcaagaaggccgtgctagtgcagcaagatcaatctggaaaagaagaagaaagtcatcagtgcctgaggcagctgcaagacgtcaacggcgagcagcttgtgggggtgccgaagctggtaagtctggaatcaattgaactaccggtaatgttgaataggagggttattagcatgaattgttgaatttaggaaaaaaaacaacaactgcatctggagatattttaaaacataagtacacattacatgcttgagaaatatgcagatttgcaagtgagtcccctacagaaaagctactgttacactatcggtaatgttgaataggagggctattagcatgaattgttgaatttagtaaaatgacaccagcatttggatatactccctccgtttcatatttataagtcattttgactttttttcctaatttttttcgagaatgcgcaaaagatttgcgcatctttgtattatgattagggaattaagtcaacaacttacaaaccaacctgaacagaaaaaagaaacaaagagaaactttattaagtttgaccaagtttatagaagaatttagcaacatttaaaacaccaaattagtttcatcaaatctcattgtatatattatgataatatgtttgttttgtgttgaaaatgataatatgttttgctataaactttgtcaaacttaaaaaagtttaactaaaaaaaatcaaaatgacttgtaatatgaaatgaagggagtgttttaaaacaaggaagaagtacacacttgagaaatgtgcagatttgcaaaattgcaagtgagtctcctataggaaagctactgttaggaagtatagttgggttggcacttacagcttaagacatgctttgctgttatttgtcagggtcttcctggagctgaagaaaacgttgcatgcaacaacactgcttcccataaagaattcagtgaatttccaggtccagatattaaggtatatccatgtcacagaagtgtcaatgtcagatactgcaattcatggcagcttggaaatagtttaccgacattcatgcctcatgctgcttagaccatcttataaaatgctgcaatagtattcaggtcatcttgcaaggatgataaccatatttacgatacgcttctgactgcagtttgggagcatcaacatcagagatataccattgctgcagggaaggcaagctgcagttattctgcccaatcctcagctagatagaagaacttccggtttaactccagctggagccagttccctggatcaggagacagatcaggagctgaatgaaaagcttttgtagtagttatgaaatagttactcagatcgtgctcctgtggacttgtgcagttgtgttgtgctgtacttacaaatctgtcttaaattgggcatttgtcatgctgaaaagaatccgctgaagatagtggtaaactggtacacaaaattctgtcttgaaacacccattaggccattaggcccattagtcagcaagaacatgttgaaggcagtgtcaccctgctgtgcattatataactcagaatagcaagtattctttggctgtttgtactgaacaatagctctggtagctacattctgtaaatttttttgccttctggaaatgaaaatcagcaagaacatatactgtcaccctcctttgtataatgcaatgtagaaaagtgagtattctttgattgttgtactgaacaatagctcttttagctacactgtgcatttttttttgcctctggaagtaaaactatgaaggggtctgcagttcatcagtgttaactgcagcagtgcagcattgtaaaaggtggaataattaattatttgccactcttacgagtggtgctaaatgatttaccactggacccacatataatagacacatgagggtccacatgttatagacagcgagtggcaaataattaattaccaaatcttaagggtggccaaaagttaaatgtctcggaaaaggttgtttctctccctgataggcctataatgtatctgcctcgttaaggcccgtttttctcaggctaggcctggcccaatagccggcccatgctaccatccacgagttagatcgagcgcagcagcagaaggatcccttcccatttcctccaccttccttctcctcgactgactcccaccttcgtcagatctgccattaccgaaacccagcaggcgaggcgaggcgaggcgagcggaccccatggagcccggcgtgagcatcgagtccgggtcggcgatccgcgtggcggtgctgccggtgggcgggccgatctcgccggcgcgcctccgcgactacgcggcgctggtggcgcggcacgcgcgcgtcgacctcgcctcgctgcggccctactactcggagcaccagaagagccccttcgcgcaccagccgtggggcggcggctgcctccgcctcaagttcgtgctcggcggctgcgtgccctcgccgtgggaggacttccagtcctcccgcaaggtgctcgccgtcgtcggcatctgccacctcccgtcctcccccgatctcggccgcgtcgccgccgacttcgtcgacgccgcgcgctcctacccctccgcgctcgccagccgctgcttcgccttctgccccaccgacgcgcaggtaccttttgctaccgctgctgctgctgctgctgctgctgcgtctcttcccaaacctctggatcacgtggttgttttggtagtgcgcggctcagcaaccactcgtgaattgagttggccatttggttgtggagttgctatactgaatacgtgtacctatggcttgcgcattgggtagaacctggcagcttcagagtgttccgatgcttgttactttcgggtgagatctgagtatctgacctctcgatcatgcaatccacgctgaactaatacactgattctattgcttgagagttggcgattttgcatcacagcagctggtctcgtggtgttaattcagccatctatgtgttgttttagttgatgactaggctgtgctcagttttcttgtgatgcattccgctagcatttctatccttaaactaatgtgtacttgtttatatcatcatatgccagtctttcttgcataatcatattaaacttcaccaaatcttgtatctacattccttgtgtaaggaactagggaaggtcatgatttactacgcaccaagcttctatgtagtgttgctatgttgatggattatattcatagctcttgccccaacgttctgatgccagccttgatgaattgtttatttgatcactccatgatctgatgtgattattatttgcattgtttgttctgtagctggtgcagaaaaagagggataatattattatgttccctccttctgatcaacaatcgttggaacttcatatgctcacgatgatccaagacctttctgcttcgctgttgatggagtttgagaaatgggtcttacgtgcagaatcaacgggaactattctaaagactcctttggattcacaatccagtcttggctcagaggaggttcgtactttaggtgttccgagtattttgactagtgtatgttgatgacataatagtacaacatttattgattatatgagataatatgcttccacattttctaggtgattaaggctaaaaaaagaaggctgggtcgtgcgcaaaagataattggagattattgcttgttggctggatcacctgctgatgcgaatgcacattatgccactgcaatagagcttgcaagattaacaggagatgttttctggcatgctggagcccttgagggtagtgtctgtgcattagtggtaagcatttgtatgccttattaagctttgggattgaaagcattccttgtatcagatcatactgcatgatagctgtaatgttatacactgcatattcagtatgatagctgtcatgcttatacactgcatcttcagtgttacttgacataagatatctagatctaatgtgagaaacactgcacttgaaatttccaccagaccccactttaaccccacccaaattttctttgggtctagattctccaatgtctgaaacttttataatgtttaactccaaacaacatatttcgaggacttgttaaatcattgagaaagggatccaacaattacatttccatttctttccaatatgctgagaagtgaaaactggttcattctcgcttcttttcctcacctggttagaacattcccatgacaaggtttggcgataattttatgcttataatcaggttgataggatggccgaaagtgaccctgttttggaggacgaagtgaagtttcgttattacaccattatccagctatacagaagagcaactttacaagacaatgctcaaaggtattgaatttgtcatgtcattccttcacataatgattgctttacccttttacatgctcaaaagtatgtcacgaggcacaaatgaaagaattgaattatttttatcccttttgttttttcttcttagctttgctgaaaactggatagaggattgcactccctgaaatttttacttggtgaatttacttaataaactaatatgtcatttgcacttgttctttttcttccttagagtttcaccagtcagctttgagcttgaagctgcattgaagctggcaagatatttgtgcaggtgagtctccctattattatatgagcagcacttggttagccaggttctttgtgctatattaacaattgatttctatagaatgaaaatcccaatatctcctttggtgcttgagtagattcttatgcttctttagttataattatttgactggaaaaactagggtggaatgggggtctgagattgttgaaagtatactttacttaggtttgttttgtccattgaattttgctctttctttataaggcggcaatgtgccaaggaggtgtcagatttactaatgggcgctgccgatggtgccaaggctctgattgatgccagtgatcgcttgatactctatattgaaatcgcgagactttttggtacacttggttataaacgcaaggcggcctttttttcaagacaagttgcgcaattgtatctccagcaggataatgcatatgctgctatgagtgctatgcaggtcctaaccacaactacaactgcataccatgttcaaagcaggaagaccagcaaaatggatcatggtttgctcaaggtgagattttgagagcttgcagcattgagaattatttccattattcagaatactgcaccatattcatatgttctcctcaacttctccaaacatgcctcgcattttatcaacttggatactgctttactcagtgaaatcatgccatcatcaaaatgtgctttctttttatgctggaaatttcacggaaataaactttgctatgctagtcacgagttaactgcacaacattttgccttttattcatctttatatattagtactccctccgtctcattttaagtgcaaccatgagtttccatgcccaaatttgatcgtccgtcttatttgattttttttataattagtatttttattgttataagatgataaaacatgaatcgtactttacgcgtgacttatgtttttaatttttttcaaaaaattttgaaataagactgacaatcaaagttgggcacggaaaatcatggctgcacttaaaataggacggagagagtagttgctttccttttatttctgttgatgtggtgagcagggtagaataaatgtcgttgacaagaaatataactcaatttaagcattttaggacgggtatcaatggttaagaaagatacatgaaccccaatgcaaactgtattaatcatgttagtaaacattcctgctttattaaagagcatgtgagcactttgccagcatatattttttattttatggtgctcatcttgttataccagaaatgatcattcagatatcattcgtttaatcacacaaaggacgagcgtaattattatattgacaaattggtgttgagtttatattttattttacatataatgataatgacgtatattgaatagttttgcattcatagctttactggttatccttatttgattctggcaatactgatcctggaaaattgcatcctcagtctgtagtatcactatttgagtcacaatggagtacccttcaaatggttgttctaagagagatactgatgtcttcaatccgggctgcggatcccttatcgtcgtggagtgctgcagcccggcttcttcggtcattttacccactcatcaccccagctggtcagagtggcttggcaagctctctttcaaactcagctgataagcttccatcgggcacacgttgtgccgatccatgtcttccttttatcaggcatgtcaaattaatgaatactcttattgctatgtttggggaaacttaaaatagatactgtaggagtccttttattttgttgcaaaactgtaggaactactgttgaatcaggaagaagattttgatcgagcatgtttctttatttgttttctgagtttttatttctggtgtcctttttttaactcaggttgcattctttcccactgcacccttcacaaagagagatagtgaagcgcaatccaaataaaaaagagtggtggactggtggtggtccttctggaccttttatttacacacctttcaccaaggggggaacatctggaactagcaaacaagaggtaaattggattgtgggagagccagttcaagttatggtagagttagcaaatccctgcagctttgacctaattgttgagagcatttatctctctgttcattctggaaattttgatgcctttccggttagtgttaatcttccaccaaacacttccaaattggttctgttatctggaattccaacacaagttggacaagtatcaattcctgggtgcattgttcattgcttcggtgttatcacagaacacctattcaaagaggtcgattgtctactccttggagctgcacaagggcttgttctttctgatcctttcagatgctgtggctctagcaagtttaagagcgttaactttccaagcatttctgttgttcctcctctgccattattagttgccaatgttgtgggcggagatggttctattcttctatatgaaggtgaaatccgtgatgttttgataacactgacaaatgctggaactgtacctgttgaagaagcaaatgttgcattgtcagggaagaaccaagattctgttatttcgattgcccatagcacatggaaatctgcacttcctattaaacctggtggagaagtgacattcgcagtgactctcagagcctggcatcttagcccgacagatttggaagcagatggcagcagatctcctgcaaactcaaggaggatagcaagagaagggagtaatcctttcttggatattcactatgctggtgggttcttggtgcaacattcaattttattagtgcatcgaagtcacatcagtttaacatattcccatccatatgcatccctaccaactgtttttatttatcctagattcaaatgtttcagcaaaacacagtaggaattagctgtaaggaattaccatagcaggatagaaacagataggcaagtacgagtagcttgtttactactacatccgtttcatattataggttgttttgacttttttcctagtcaaacctttatgtttgacctactttatagaaaaatatagtaatattttcaactcaaaacaaatatgttatcaaaatatattcaatgttacatatagtgaaacttattcggtgttgtaaatattgctattttttttataaacttagtaaaacttaaagaagttagactaggaaaaaagtcaaagcgaattataatatgaaatggagggagtatgtgtgttaaagccccttgtcagttgttatttattctcttcgatgatgtttacagtatttctttctctgaaatggcgatgctcactctttagcctgtcttagaaatgcataaccaacaaccttggcctttctaagcataaacaaatgaaatgtggagagtattcttttttaatgatcagttaggctgtctacagtcttgaggaatgaggactgaatttcgactttctgccattacaggtccttcagggaactctgagagcaatgatgtttctctcccacctggaagacgtctggttgttccgttgaatatttgtgttgtacagggcatgcgacttgtaagagcacgcctgttgtccatggaattacctgcccggtttactgatgctcacttaagatctgtcagtagcaaggacaatctaagcaatggcagtgatgcgattcgtaatgacattagcttattgaagattgatccttataaaggaagctgggacctccgtcttctggaacttgagctgtttaatcctactgatgttgttttcgatgttgatgtctcagttcatctcgatggcacaagtgtcgagcaaaaaattcttccagaggataaaacggccagttcggcttgccacaaaactcgaattgatcgtgactactctgctagagttctcatacctcttgagcacttcaaattacctgttcttgacacttccttctttgtgaaggaaaatggaagtgatgaacctcttggatccagagctgccacgttagcagaaaagaatgccaaggcggaactaaatgcttcaatcaacaacttgatttcaaagataaaagtgaagtggcattctgggagaaatagctccggtgagctgaatattaaagatgctattcagacagcattacaggcatctattatggacatactgttgcctgatccgctgacattcagctttagacatgccaaggatggaacaacagccaaaactgactcttcgaaggagcctggtgacggttccagtcgttctgctgatgagagtgttctgaggtgtaaggatcctatatttgctaatgaaatgacccatatggaagttcaaattcgcaataacactaaggaaactattcggatgaacctaagcatttcatgcaaagatgttgctggagagaattgcttcgacgaaaatagcgcaactgtcctctgggctggtaatttaatgatgacattatctttcctgctatccttgtctgttttgacattttgttttctgaaggcagcaaatgatcacggttaaggaagatcacaatatttacattttgattagtttttggctttccattgaaccaatccgttaggttacagtttgtcattgcattctgcccttaatctgttcatctatttactcacaaatgtcctttttggtgcaggtgttcttagtgacatatatctggaggttcaaccactgcaggaggtagtacatcctttttctatctacttcctggtccccggagactactcgctgcaagctgcttctgttataattgacgcaaccgatgttcttcgtgctcgggcaaaggcagagtcgcccgacgaacctatactatgccgtggatctccattccatatccatgtagttggtacagcttagccggactttcttggatttagtctagagcgtgccctgtatcgtgcgtgagtttcgtgacatgtgcagctgcgaagatcatgtagaatttttatgcacatctgatttatttgagccgcatgaaggcttccctgtaacacagttgtgttttgtacagtgtaaaagcatagtgaaggttgtttcacagacgcgcgaatttgctggttctggtttcagcatctcgatgtaaattttttctgtcctacgaagaattccatacgtatgagctctcatttctgccattaagaaatgatggggatttaaaaatttcgatgcatcaatacaagttgaaatccatcaaccatcgattgttacttttcatacgcatggatagtcatttctgccgttaagaaattgttggggttttgaaattttgatgcatcaatacacccatcaaccagcgattgtttaatttctttgcaaacagtgacaaggacaataaggcaaaggtcaagttgtcaaagaaggctgcatccctagtcttgtgatcaaatcttttatatgcttcttttcaatcttttatgtttcttgggcggaggtcctcactggcatgcatttgtttgttgcttgaagtacagcctggcaatcgccttgaagagcaggagcttcaagggaagccttcgccggtgtctgagctactgaaggtttgtgtagaggcagataagaatgttttcaaattactaaccttgcatactgcagtcttatgttttgaaatggacatgataaaagttacgaaatgctctgattgtcttgacaaacttgagcagtggcgaagtcctacccctttttgtccgtgtgcaattgcaatttgtagcttgcacaaaactttcaatgggtcgtgcaagatgatgtgaacttctgacattcctttacttttgttttcatggtcataagtgtgcaggattttatgccctccgcaagttgcaaaaggtagttatagaaatagaacgaaatgaggctcgactggagaaaatcgctaatgttgcaagggcggctcttacgaggatgaacaatggggagacactatctcaggaggagatgaaatcgtaccttgaagaaattattcgtttggctagtatctaaggaactgatcccaggatagtgtaatttttcatcacctctgtaatactcctatgtcatacgatgcgtaatcaaacattgcaaatttgcaatcatatgcccctccagctagatatttggttaactgtttatttcttcaactctataaattagttgtacttataacatgatgcattctgctttaattctttaaagtaaaatattctcgtcatttgaattcagagagtaccagcctgtaggacggcttagctttggtagcacggtaatcaggcttaccaagcttacggagccatcgtttcgcttattcgcggaataaatgaaacggcatatttgcaaacgaaaaataagttgtgaataaaacttttatatacgtgttcttggcagtctagaagtaaaggctggaaaataaacttcgatgaaaaaaacctcaaaatcgactccaaatttaaggttgaaaattaaaattttgactgataaacataagcatagcttttgcttcgtgttcgtataatgtttgaactttgaagtgacagaacgaaacaaacatcctaatcgtaaggcactcgcatagtatagcgctcgttgtgccggtgccgttcacaatcacacacgtgcaggccatgtacttcctagtcacgattactgaaattatctcaaccaaattgggaagacgagctttttttttttttgatagatcttcacatcgtcaagcattctacaaactatatgttgattgaatgggaaaacgatcagtacacagacagacatgggcgcagaaacttcttaagattttaagcttgacaagtaaagtcaagtcaaattcctagtacagaaaggtaaactcttgtctagtcaagatggtagacacgagaaagacatctaggtggcatcaaaatctcatgatcaaagctttcagaaccctgaatatctcctcatatacatcttaagcggctgtgaaaaccttcttccctgcaccactctttgaccctgccggaatgaccttcagcacattgaacctcacggtctttgacagtggcctgatattaaacagatagttgagtaatttgtggatttctgggatgaagcacacaaaataactgtactttacttggctaagattagaaaattcatgctcaaacattcaggtttgtattcactgaggtacacaacattcacaggtcaaagtgagccgtcacaaaaacattcaaaggaacatgacaagctttacctgcactggccaatgatcacgtgatctccttccttaacacggaagcacggtgaaatgtgagcaggaatattggagtgcctcttctcgtacctgcatcagcatcaataaaattaattttatgaacaaacagcccaatgaggcattatagaactgatacccagcaaccaggttaacttgcctctggtacttcttgacaaagtgcagataattcctccgaacaataatggtcctgttcatcttagcactatgacatgttccagctatgatacgacccctaattgatacagtaccagtgaatgggcatttcttgtcaatgtaggttcctgcaagaagtagcaaactgaggatatgcagaaacctaagtagttttaacagaggaactctagaaccaggcatctaaagatatcttccaggactagtaaaatgtcaataggaaacaataataggagtaaagatgatctcataagtcgtaactacacaataaatggaaattaccaatactctttagttttagtgaatgctaagcttcaagcctggcaaggtgaaagcatttgggcagctactacaaatgttttaagaaacaatcattcatgcttgtctaccaatgagcacaacaactataaatctgtcttcttaactacaatagaggcaaattggtctacaactagagcacacaggttaagacataagaacaagaaaactgcactgggaactaagatttattgccttaatttgaaaagagattggcatattactgagcgatcatcaaccagggtggaagacaaattcagagagcaggcaaaccatgctgctcctgttcaattggaaatgtgtacagatagaaacagtagaattcagtgttgaaatctaacgcgcaataactatatcaacctggacaaaccatacaagcaaaagatatgtttagttgtttacaagccaagaattaacaggaacataatcagaccttcgatggcttccctgggtgtcttgaacccaaggccaatgttcttccagaacctattcccgcccttgccaggcttcttccccttggtggttttcttaggactggattccataacagatcatgagccacgtaccacaaatacaaagaaacagacgcacaaaaattatgaataaagaacttgctcttaccagagaaaaaccttaggctgcttcaagaatgccctctcagtctgcaaaaacaaatgagcaaagacgtttaatttctgttaaacctacagcaactaataacataatagtccatctaccaatccatctatacagcgatcaaaattaccaccagaaggtaacaaattctagagcttaaacaactgatacaatctgtataatccacctagccatttcgcgctagcatgccattagagactgcggcattccaacagctatgcaccaaaatcacaacgctacgcagaaaaaaaaaatcaccaaccggactgcacccgcacgcactagatcacctactaccacaacgccgctaacgaaacgagatcttaaacacgcatgcaagagaaaaacaaacaggtcacaattgatagttgatacgagcaactcgggaagggttctcacctgctccgccatgatcgccgcgcgaggaagagacgcactggcgcgagacggcggcggcacgggaggagcagcagcggagaagaagaaattcccgaggctttagaaccctagccttcccctggttaaatccgttcactcattacacggtggcgtgaggcgtccaagcagagtgggccgagatgggcctgaaacatctcggtgcagggcctcatgctaacatgggccgcaacttgagttggaaataaataagttcactctaggtccctcattgacatcaagtttgaattaggtcgttaaactaaaccgctaccagatgtaatgcatccctcaacttgtaaaacaggtgtactcgagatcctatgacagtatattgtctgattttagttaacgtgacgagttaattgggatcgatctgggttccatgctgactcagtcggggtgacagtagtcaacttgtcacgttggccaaaatcggcactatactactctggaacatcgagtatacaattttctacaaagatgagagatccaaagtaaacttatttcagttcgaaatgcatcgcattgctggttggcccataactcttaccggcctactactatatttgatgtggactcggttctgcacagcaggaacgtcggaataagttcccttgtgacccttataagtgtcgaaatttaatccgtgaccataaactacaaaaccggatatctcgactcataaaacagatatgcttgtctaccaatgggacataaagatctggcaagacgacagctattggcctaccgctgcgtgtagatggccgcagggtccaacgaagtagcagagcaagcttggaattgagaagaaaacatccctgcggtccagcaaaggcgatgtcgcaggcttgctcgccgcggatcctgcttggtgcggcttggtcggatcaccgatggcggctgttgcttgccaccgcctggctagcgcaccgatgctgccgccgctttgaccctcgccgcccgtcgcgggagaaaaagagagagcggcgaggaagagaaggaactggaggaaggagagagagaagggacacgtgagtctcacaatttcttttgcgtgtcaatgataaatcggtcccacacatatttttaattctaaacgccacctaaacgccatgtcaatcccacgtgtaaaggagacccggtcaataccgctacgtaggcgtcacgtcagcaaaaccgtcaagggagttaaattgcaccggtcttaagagtttagaggtcgagatattcagttttgtagtttaggctcacggattagatttcgatcatttttaagggtcactaagtgaacttattccccgtaacgtccccggagtggggtggtggcccaagcctgtagtatgttttgtcgtactgtagcatctaacacaactacacaagggacaaacaggtttaaaaaaagaaaaaaatatgaaaacaccaggacaaacatcaccagctgcgtctttattgctcttggaattgtctcatcttttgcatcacgaaccgttgcatcaccagctccgtggcagggggatagtctagacatgacatcgtagtagtctggtttgctctgagaagtgagaacgcattttcgcgtccggtgccggtggaaacgaatttaattcctcggcgcacacgaagaaaaaagctacactccagcacgccagaggcagtagcaacaagccaacaaccggacaataaccggtgcgcggtggagcctacggatcgacgacgacgggtgcgggagcggtgtcggaatcggcgagattccaagaaagcgaggttgggcatgggatcttgcttttgcggctctcaatctcaccggtgtttctgcgtgtctgccttttttttaagctaaaacttattttaagaatgatttttttcagcgccaaatcgtatagtgctgaatttaaacatatcagcgctaaattgcacgacgctaaatacacgtcagcacaccgactcatcctcctatctgcggtggcacggcattcagcgtcagttgacgtgggatttggcgctgaacaaaaggatcatttctgaaataagtttgggccactgtttatttgtaaggccccgtttagtttcccaaatttttttcccaaaaacatcacatcgaatctttgaacacatgtatgaagcactaaatatagataaataaaaaaaactaattgcacagttaagaaggaaatcacgagacgaatcttttaagtctaattagtccatgaaattagtctagtggtttttaggcgagttatgaaattagtttttttattcgtgttcaaaaaacccttctaacatccggtcaaacatccgatgtgatatcaaaaaattttcttttcacgaactaaacgtaccctaaatttagttcttgtaaagggtcattgtcaaaatctgtgtgtctgccgcgttgcacttccaaaagggcagaaaggcgagagagaagtcagagaacttgggacaggtgggcgagaccgagacctgccgctgctggcacccgtggccccgtgtgggcaatggaaaggcaggcagacagcgcagcgtaggcacgcatgcgcgcgcgtgccggatcgccatcgatcgatcggaagaagcgaagctttctcgctcggcgccgcccagggagtttgttcaccgacagcatcatgtatgcgccacaatagcggaggacggcggcgccctgcctggcggagaggcccggccgggcgtggttctatgggtgcgtgctcttggtagtggcctgcctggcctgcacttcacactgtacgtttgatttttggttcccttgcgaggtggcaaaagataggtccagcttgttcaggtcgttctcgttcgtttgaaggatcacacaagccattaaggcatgagcttaaacattgaccgatatttttgttggagtatgacaaatagtcaaacatcacgttagaagccaatagcatcatatattgaaaaatgaaggaagtacaaaattgtttagagagtgtgctctataatagttgagatgataaaggctcccatcggatggcctaatcagccaaaaaaaaagctaaaatttgaattttcaagcttaattttgagattgattttgagatattttcaacatagtttctttttcaacattggctttcaagtcaccaagaacacatttataaaaattttacctacaaattcatttttattttctaataagccgttttgacttattaggaaataagccaaacgatggggactaaaggatctaattattaatagaaaatattttttattactgttgctttatttttctcctatcattatgcaaccaagtttacattttataaaatttaagagttgttgttttttttgataatggaatataatatcccggtctttgctcaaaaagaactacaaccaattattacaaagatccactccagaagagagtgtagttcaagacaagttgaacacaccaaacaagagaagagaggacctaaactgagaaaagcaaaataaaatgtggagctagaaggcctcgtcaaggcctaagactgaagttcgaagccaatgcatagaccaatgacaatatccttgcacgaaaaggtttctccaaagcggtgcccccaaggaggatgcgacgtggatcgccgccaccgctcgttcggaaccgaagcaaggttttcacccagagaatatggtagggaaaggaaaggggtatgctaaaacaacacctccaagaagtggaacgacgccaaacggcgtcgccgttgtcagccagccaaatagctcggcaaggctttcgcccgcgattccctgtccaaacccacaccaccaatccgcacaagaaggatcatcttcggtcaacaacattgtcctttcagcgattcggccaaggccaccgcccacagttgttcccgccgtccacggcgcgcccgcacccgaactcctccttccccgctgccagacccctttcccgccttcacataccgccgccgccgacgacgcaccatcagccggatgatggccttcaaccatcgccgccataggtaccattgtcgacagccaccaccgccactgccacagccaccaccgtcgccagccaccaccgtcagccaccatcgccaccgccaccgccaccgccacggacatccccgtccagccaccaccgtccagccgccaccgtcagctaccaccgtcgctagccagcgccgccagacgccagctgtccagatccggccggggtggcacggattagaggtgtagcgcgaagcacgggtcgccggcatcatggaggaaggcgtcacgggcacggcgttcacagcaggaacattgacgagggcgccgcgcctccctcgtggtggcgaggttcttgacgagggccggcgtcgcggcacgcaccgcagtccgccgtcgtcgtcgccaacttcgtcgccgccacatccgccaccatcgccgctgctagccacctccctgccaggtccgcggagcagcgccggcgacgaccgagcccatcgccgatcaccccggccaagcggggagaccagatctggtgacgccgtcgcccgtcgctggagccgcggagaaccgacaccgtagcgccccaccgccgtgcccaactccgcgccatcgccgcgccgtccccgtcgccacgatctcgccgtcccgccgccatcgtcgccacgcccgcgccagagcgaggtggagccgaggaggatggccccgccgccgccatcccaacgcgtcgcccggctttgccggcgacgagctccggcggcggcgaagcatggaggagggaggaggaggggcggcagcggcggctagggtttcggcccctagggtggcacaatttgatggtaatctgaatctctctccaaacaaatagtagaaaataaaagaaaaagaagttgttgttgagttgttgttaaccagagcaatgcccctactctctctcccttctacccagcaaactattggctcctctcaatatcgcacgaagggggcaacaacagttttctgccaaaaaagaaaaacttaaaagttagtgttggttaaagaaaaaaaagggttacatcgatcacgtgatttattatatgttgaaattataggcatataatgatttaatctattccataaataaatcatgacattacagatgaaaactagcatgaacgcatcattagatctacacatgtaaactacacagtataacatgaacagatcaaatatgcgcaacatattgaacacgtaccgaggtggtggaaagaccggctgctcggtcgaaacttttcgcaggcgtctacgaaggcacgcaccacgcgagcgaagaggaagacgagccgtcgcggacgaacagggagcagtcgcgcaaaacgcttcccaaaaaccttattgtcgccttctcccggtgcaggacgtcgaaggcagaggttccggagacctgctctcccgatcgcaggtgcacgccagcgagcgggatggagtaatctacgagcgacggcgcagcacagagtaggaggcaaaccctagattgatttcgcatgtgttgcgtgaagacggcgggtcggtttatatagagaagggtcgcttgatcagggcgcccacacgatctccactgcgcgtaaccgaaccggataagtcacgcgtaacttatccggactccacgccgtttgcacgcatcggatttttcggaacgtttccacgcgcgccgcctgccctgccctgccctgctaggccaggccaggcgagcgagcgcgcgcgtgtgttccccatcttctctccaccacacatgcttcaagtggctaggagggcatcctcccttttaaggaggtccccatctcgtagaataagtaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccgattaaggttgaacatccacctagaactccaagctacacttcttactcacaacttgaacaatggactatgccttgaattgcatgtcttgtgcaagcaagtttcactcagagtcttatctggtactagaccgtctgtagactacccctcgggtggagcgtataagtcatactcctaggtctatagtaagcttcctagaagattcacccaaaatctccatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttagagagggtatagattggtactctcctctagtttactaatgatttgttcttcccagattctaattcacgggatctccgatcacatagactgggttaccaccatagtataactcacatgggtctcaaacccatctccttcgatgcattgtctatcacatttcgtgatagtccctttgtgaagggatctgccaggtttctagctgttgggatgtaatccaacattataactctggagtttcttaatttcacatgtctagacaatttcatattatccttagaactattcactttgacaattaccgtttgattgtcacagttcataaggatagccggcaccggtttttcaacaataggcagatccattaatagatcacgcagccattctgcctctacagtagcagtatccagtgccgtcagctctgcttccatagttgacctcgtcaaaatggtctgtttgcaagacctccatgaaacagcaccaccacccagtgtgaagacatatccactagtggctttgatctcatccacatcagagatccagttagaatcactataaccctccagtaccgcaggatacccagtatagtgaagccccaattccacagtatctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaatttttcttgttcttgcgaagcaacaagctaggatcataagttgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgccccaaatatcagtatgtcattaacatacaagcataaaataactccctcacccccaccatggcgatagtacacacatttatctgcctcattgactgcgaagcctgcagatgtcaatgttttgtcaaatttctcatgccattgcttaggagattgtttcagaccatacaaagacttcaacaatttgcacaccttgcctttttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttgtttctgagtatagcccttagcaacaagccgagccttgtacttttcaatagtactatcaggcctaagcttctttttgaacacccacttgcatcccacaggtttacacccatagggtcgctctgtcacctcccaagtcccgttagcgataatagaatccatttcactacggacagcctacttccagtagtctgcatcaggagatgcatatgcttctgaaattgacttaggagtgtcatccacgaggtacacagtgaaatcatcaccaaaagacttagctgtcctttgtctcttactccttcgaggagcttcactgtcatcctcctcagtgacatgttcatgtgtatgttcaatttgttctggtggtgtgattgaactgggaattatttcagatggttggctcgaactactatgtgtatccttcattgggaaaaagctctcaaagaaggtagcatcacgagactccataattgtaccaacatgcatgtcaggtacctcagatttaactattaaaaatctataggcaatgctgtgataagcatatcccagaaagacacagtccacagtcttaggtccaactttgcgcttcttcgttttggtacattgactttcgccaagcacccccatgtgcgcaagtaagaaagtgatggttttctcccaatccatatctcatatggtgttttgtccttatttctattaggaactctgtttaacacatgattcgaggtcaacaatgcctccccccaccatgccttaggtagtcccgcagtgtccaacatggcattcaccaagtcagtcagtgtgcggttcttcctttcagcaatcccattagactcgggagaatagggaggcgtcctctcatgtatgatgccatgttcctcacagaataagtcaaactcgtttgagaaaaactctccaccacgatcagacctaagtctttttatctttctatcaagttgattttcaacttctgccttataaattttaaaatagtctagagctttgtctttcgttttcaacaagtacacatagtaaaatctagtagcatcatcaatcaaagtcatgaaatatcgttttccaccctttgtcaacaccctattcatttcacaaagatctgaatgtaggagttctagtggtgccaagtttctttcctcggcagcattgtgaggcttgcgaggttgcttcgattgcacacaactatggcacttagaacctttgacaatggaaaacttaggaattaaacgcatgctggaaagccgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagaaacgactactttattagactcaaaaaccaacttaaatccgtctctagttagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgtcctgataagaataaaacaataagatgtcagcacaaacatgtacattggccccagtatcaacccaccaattagtagactgattaactgaaaaaacagtaggtaaattaccatacccgcttccatcttcagtgttgccaatggtcacattagcagacttagaagtctgccctgcaggtgccttcatccccttgcgctgtggacacttcctagctagatgaccaagttggccacacacaaagcaagtcctctcatcctgattaggattgttgttgttcttcttctgcttcttgaagttggtggtttgctgagctttgtatttccctttactcttgttctaggccttgtgcacaacattggcactggactgtccaccatcgcccttagacgcgacatctttttcccgagctttctcctcaacatcaggagatgctatcaacccctcaacggagtattcctgtctcttgtgtttgagtgcagtaccgaaacttctccaagatggaggtagtttcgcaataatgcacccggccacaaatttgtcgggtaagacacacttaaggagttcgagttccttagccatggtttgtatctcatgagcctgttcgactacagaacggttgtcagccatcttgtagtgatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagatagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataagatttttggattgttgagattataggcatataatgatttaatctattccataaataaatcatgacattacagatgaaaactagcatgaacgcatcattaaatctacacatgtaaactacacagtataacatgaacagatcaaatatgcgcaacatattgaacacgtacctaggtggcggaaagaccggctgctcggtcgaaacttttcgcaggcgtctacgaaggcacgcagcacgcgagcgaagaggaagacgagctgtcgcgaacgaatagggagcagtcgcgcaaagcgcttcccaaaaaccttattgccgccttctcccggtgcaggacgtcgaaggcagaggttccggagtcctactctcccgatcgcaggtgcacgccagcgagcgggatagagtaatctatgagcgacagcgcagcacagagtaagaggcaaaccctagattgatttcacgtgtgttgcgtgaagacggcgggtcggtttatatagagaagggtcgcttgatcagggcgcccacacgatctccactgcgcgtaaccgaactgaataagtcgcgcgtaacttatccggactccacgccgtttgcacgcaccggattttttgaaacgtttccaaaacaaaaacgaatccgaatttgcagcaaaacaaaactgcaaaaggaggctgcatagaaccaattttggcggaccattcgacgcgtacatcgtgcacgcgcgccgcctgccctgcccaggcgaggcgagcgcgcgcgtgtgttccccctcttctctccaccacacatgcttcaagtggctatgagagcatcctcccttttaaggatgtccccctctcctagaataagtaaggtggtactaaactccacatgcatgccatcctatgaggtgagcttttgtgattttccaaagaattaatcttcgagtgggctaaggcccattcattaattccaacattatatacataccctgttttatcctcagttgcacaaaatatatttaagcagagacaaaccagtacagataaacagatatacatcgaaaatgatataacaaacaattatcagacaaagaaaatcgtttaggtgttttaattaaataagggtggctgagatgatagtagaatgtttaataggcgatggttaaaagaatagatagtactccactttaagggcatgttcactttgattccattttcaaacttaccaaattttggaaaagttgccaaaaaaaatagttacatttagtttgctgccaaattttagtaactatataagaaatcatgccaaaaatttaaagttgccaaaattttagtataattgccaaaattttggtaatgccaaattttggtaaggttttttttgacatcaaagtgaacaggccctaaaagtacacttgtcgtgggactaaggaagtattatttaataggtgttgaactcttcccgataaatagactcgatgggttcttttctacttctatttcttttcaacttcgacacacttgattttcaaacacacgctttctaaactatcaaacgacgccttttaaaaaatatagaaaacttgttttttttaaaaaaacatattaattcatttttaagttttagtcaatgcttaattaatcactctattttgcatgtagggaggtgaagttctcaacctctacctccgaacacaaccagtgtattagttttgagagctttttatagtttcaattatttaagaatctgcaactcctcaatcatccaaggttttgtttaggaaagtttaagattttagacgtagttatgatcgagaagaaactagcggtgttcaagttcattttcctaaattatacaactataatttcttagattttaggtgaaaatataaagtatttacgagagctgaagattctgggagaagctaatactatcaaaaactcccaaccacagtttacaagtttcttccacaatctacgacttctccaaacatatcatattttcacccagtcttgagatttgtagtatataatatagaaaataaactagaatcagaaggtgtaaaactaaaaattttcagatacttcttagctacttgatttttcaccagcagttccatatagaggcgcctaaaaattgaaatcatcaaccccatgtttcttactctcacataagttgggtgtggctcgtcgtttccaatccgtccatccgagagtgttggcatggacacccacagcccacaggggcaaacggagaggacggagcaaacaacgtccccatcgtttggcttatttcctaataagccaaaacggcttattaggaaataaaaatgaatttgtaggtaaaacttttataaatgtgttcttggtaacttgaaagccaatgttgaaaaagaaactacgtttgtcgaggggtgaccctctctagcgggaggctgtgaggcccccctttgagagttcggccgggggcagcgggtgagattcgaggatttggtgagcgaaactgtgtgtgatcttgatctcggaggctcctctaagacgataaaacaaaagaggtttatataggttcgggccgctatgaagcgtaataccctactcctgtgtgtatgattcttctgtgcttagaaagtccctaaatccctggtatgcaagctagggttagacaagctttggctcagggatcctcagtcccatcccccctcctcgctaggcatggtcctccttttatactctaaggagataccacatgtgttgcgagtgctacctagggagaaggaaaaatattatctatattaattacatgtcttatgccttagcccagaagctatctgcacgtcggttgcttcgcggggcccatcaaatcatgcagggtgcccttgtcattctccatttaatgaatgaggacttccgggttctcgttcacaccagaaaacgggaacccgggtcagttcagagtggttggaccagctctgaccgaggtaagaggctgtgaagccccttatcattatgatgggacgggacggagcacgctgctcgccgcctgacacagggggcgcccaagtcattcaccatttaatgggtgaagacttctgggctcctattacaccgagaaacgggagcctagctttgaccagagcgggaggaccgactccggctgggataagaggatgagaacctctcaccatcactatttgatgggacatgtcaggctgcacgccgcctgacacacgagcagcgcataggcgcactagccagttccattggtcattcgaccggtcacagaccggttgagtacactgcacgccgcatgcggcgtggcgcgacggctcgggtcgtcataaatgcgggtaggtgggcacctgtaggccgacacctaacccaccgtacgtggtgacctagagagggggttgggggagccccgacccctagtcacggaagggggccatcgctgcccgacctcgggcccgatcccccctcgggggagggccacgtggcgcttggggcagccttctccatctagtctcagccagggagtggccgccaccccaccttaggcctgactccccttgggggagggccacatggcattggggggcagcctcctccgactagtctttgggaaggagtggccgccaccccacctcgggcctgacttcccttaggggagggccacgtagcattggggggtagcctcctccgactagtctttgggaaggagtggccactaccccacctcgggcctgactccccttgggggagggccacgtggcattggggggcagcctccccgactaaacatgatacccccgggcctatatcaccaacaacgttgaaaatatctcaaaatcaatctcaaaattaagcttgaaaattcaaaatttgactttttctttagctgattaggccaaccgatggaagccaacgattttattggttgggggtggacctttcttttattattgggatgtcaaatatttagctggagataaaaatatattcacaccacaaatccgattatagttctatgaaaatataatttctgtatgaatttttgggcttacgctggggacgctccgacacactaggagagattgcgattgatccgtgtgctccgcatcagcaaatgtccttcgcatgcgtaagagtgtaagtggatcagccgcgaacccacttataaatcagcataagcggatttgcggcttattttagtctataagtgggtttcgcgggttagccacttacaccccggcatgcgtgtacccagcagtagcacattcccagcgtttgccggccacacgtcgaccggcgccgcgcgccagcccaactgccgctcgctcaccatccgctgtcatgtgtggatgtgccagcctgattgatcggaaattcggattgcatctcgtacgtggcccggtcgccatgatcatcgatcagactagtacactatactacttctgtctatatacatatatacatagtttcagaatgtgtcatatcccttcaaaatcgtttatattataagatggatgaagtagtatttagacgataatatccttccccaaatcattggccatacatgcaagttggcgtctattaattcctctgcctctgaccggccaaccttctcaaaccacatatacacgcgcgtgtaccgtgtgcgatcgggacatcgttcgggccgatcggttgctcggatgatcagctgggacgacgacgattttggctgttcaaatctgaaaaaagagcggcttttgagccctccaaacgccggctgattgattgacagatcgattcagcgtatgcggccacggaaggagacgatgatcgccgcgctagaggccgagatctgcaacaagccaacacgctgagtataactggagtagtagccaacaactgcaaaggatgtcgccaactgcgtacttgcaactactgtaattgattagttagtcatgcgcatagtatcttagcccataaacggagcaaaaggccggttaatctgctgcatcttgccctcttccttgccagctgccagctgccagctgcgagctgcgagggccagccggaaagcgatcgacgcgacagcgattctgtgtgtttttccgtgggagagacggccaacgacgacgcgacgtcagtcatcggctccccaggctttggagcttcacttttttgcgacggaacagaacacatcacacatgtttatgtttctggcgctgatactactttaaagagagaagaacaaaaggagtttcggaggagtgtccgagcaaaggcaggcatagagctgataggtctattggttctactgttctacacgcggatcaggatcccttgcagtaactgtaacttaaacagtttatatgtgcatcataacatgatctagaatggaaggccagcacatgaagcggtatcataacaaaaatactgtagcagaaatgcactgtacaatagtatgttcatactatagcggtcctctagagctgttagatccgaaaacaaatggtcaagattatgtacagttacagtaacaaatgtatttgatttcaatcctctacatgtttagctgggatttacttttttatagaccgcgggatctcagcaggacaatattttcgataggtttggactaaattttgcttgaatttactgatttaaatttgaatcatcaaaaaccattcaaaaactgccttgcaattgaattttgtcccacgttgaaaccttaaaattacgaaacgcagaggggggataatggtcaggtctatcaaagcaaccataatcagtaatcgcactcataaattacaatcttatactcagtgcccgaaatgaatagcaggtgcgctgaacttttcactacttcataatcagcagtcgatctggttcccgatctctaccctataattttccggttctataatgtcacatcctaattttcgttccaggatttataaattatctaataaattaataatagaatttatattaaatgttctttaattttcaagtgaagttaaatgtgggaaataaaattttctaaatttaaagcatggttggatttaatttttattaaattcttcatgattaattatactctctgaaattttctctgattttttttttcagagctcaattccttaatgatacaaagaacagtttagtaattagtaatcaattaatgatctaattataattatgttaagtgcttttcttgtttaaaaatccttaatttataaattgttgcctaaaagggaattattagaaatgatcttaaaagcctagaagagaatatctaattttaatttgttaaatctcaatataaaagtgggctagataaaattttgttaaatacttctcttgtttctatagttcctagatttttctgggatttatttgagccaaggaagtatttttaataaatggaattgcatttcatgaataatttaaagggaaaaaggtttttaaaagtcttcttttggccccaaaaccgctctctctctccctcggcccaagtcggcccaagtcgagccgcccgcgcgcgcgcgtgcgaccgccgctgacaggtgggtcccacctgtcagtcttcgtcttcctcgcgccgctgccgtcgcccgagccctagcgccgcgccgccgtcgtctccttccaaatccagccgcccctttccgtttccggtgaaattaatagaggggaaatgatcttctcgatctcctctaccttttccttttggaatcgatcgccaattcagttggaaatccatggattcgagttcgattcggatcgatctctctcctccgaaccctaaaccttcctttccgtcgccggtcaccgtgggccttcgccgccgcctccttgcccctataaaaggacccccgagcttccctctacccgtcgccacccttgccttcgtctctcgtcgtccgtagcgccctagccccgtgagacctcgtgccgctgtcgtcgcagccgctccagccgtgtgccgccgtcgctccagtcgtcgccatcgctcggggaggtcgccatcgtggtcgccgtcgcgtcgccgccctcgtccacccctccgtcgttgctgtagatcgccggagcaccgccgtcgtcatcaagccgatcttctccgccgccttttcctcgacgccgtcgccgtccgttgatcttccgccgccgttttggtcaccggtgagttcgccgcgtcgctctctacgtgctggtgccctccgttcgtgccgtcgcgccgtcgttcgccggcgagcttgcacgctcgagccgccgccggtggtgacgtcaccgctgacgtcatcgtcgtcgtccatccgtgagccgcggtggatccgatggatcttggccgtccgttttggatggatcaatctcggccgttcgtttccgtgagccgtcgccgtgcacccggtccaccgtgaaccctagccgctgacgcaataattcctttttccttttcaaaaataattcattattgcgtcataattcaattaatacccatataagtattttaatccgatttaatctttaaaaattcataactaattcatcttagctcggatttagttggttcaagtctctaaatttttctaaaattgagatctacatgttaaaaatatccacatgtactgtttatgcttgtttttgtactgtttatttggtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattcctttattccttgataccttgggttattataacttgactagttgagctttatatattggttcaggtagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataatatggttcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacacatggtagacatgatgttgaggctgtgtcttgtgggtacagcggtacacctctggccagagtaaaactattcgaatagccgtgcccgcggttatgggcgggttgagcaatgttttttgtgattagtctcacacctctcacaataattattgatgttatacctggtaataatttgtttagctcctggtttggagttagatctgtacagctgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttatacccctgttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattattagtgaatttccgggcgtgacatataataacattttagaaaataacacggacttcaaaatatatttttgattttattttttattataatatatataataaataaatacttgtttacttttattttagtaacttaaaagacatatatagatctatatatgttgtttgatgttgttatagttcttttaaataaaattattttgaagttattgatagtcagaaaaagtttgccctcactttattcaagacgtaaagaattataaaaccggagtaagtagctatttttttttcttttgggaaatatcacatccagatatgtatggccaatatacataactgtggttcctgtcttaaaaaaaaaactgtggttccttatcatgtggaccataaattattgtaccttaattaacggcggataattaagatgcgcgatggagtcctatataatatctgcgacgatgattgattattataaggccatgcgagtgtcagtgtctcatcgagtccgtttacctgtattgttaacatctcttttattatagtcaaaccctaaaacagtttttacataaagaggtactcccttcattccaaattaatctatatatagttttttttatggtatttctaaataatctacatatttatgttcattcattaagtctattcgttatttatgcattagagtaaatagaaattgatgcatgcatccttgcacacaagtatttataacccatatgcaatatcttgatttgctattggctaggaaatagtggggatggtgcatgcattgagtttgttgctagagtaaatatagtatgagagagttattagcttttcttggtcttagtgtgcctgtgaaatatataaatcaatttgaaatgaagggagtatgcctgtgaaatatataaatcaatttggaatgaagggagtacgtaacaacacatgagttgtacccctggacaccatggtaataatagagtgttctaatgaaacactgttaatataattattcctccatgtggagcacatagatgtactagacgattaactaatggataaatgtccttatcaattatcacagaggagcacgcggcatcatattgtttatgaaaattctgatcttcctttcgtgtttaaggaaagcatattctgtaaagagaattttgatcttttccacggcgcttgacgtacgtagttaaaatgaaaaccataaccataaccattgtcatgatatatatagtgagtttagatactaaactccgttgttaaatattatataatgctatttttttttggaaaaacatataatgtcactgacttttacacaatacatttcaccattagtcttatttttttttaaaaaaaatataataactatttactttgatgtgacttgttttattatctactccctccgtcccaaaatataataagttttagctcttaggatttgttccaaaatataacaacttctccaccaacattctcttcccaaccaatcacaatcctccaccattcacttttcgtacctaccgccactacccatccaattacaaccctccaccactcacttctatatactttcttaataaccgtgtctaactctaaaacttcttatattctgggacggagggagtaagctactttatgcatggcttatcttatattattttcatgtgtacactaagttttaaatagtagaatttgctaaacgccacgtaaaaaaattcaatatcataccttttcaaaatggagagagtaatagcatggagtatgactgtatatgtttaactatatataacgtatctagaaaaaaaagcaaaggataaaaactctaccgcggataaaatcaaatatactttgagggagtaataaaatggagtaattgcaggctctccgtttatgtctgtctgcaattattatccaatatcccaactattctttctgtcacaaaataaatacagttttgtattgttcatatttaacgtttgatcgtttgttttatttgaaattattttatgactaatatttttattattattagatgataaaacataatagtaatttatgtgtgactaattttttaaaattttttcatacacttttttaaataagacggacggtcaatgttggacatggatactcatgtatttaacaatgatgagatttgtcggtgtactatgttgcatgtgcaatattgcagagatgaaatagtcatgtggttgattgtgatgttttggatctcataaaatcctgatgaaattaccacgaatatggtgacgtttatatctcagcactaaaacaataaaggagagtaagcagcaattcaataatgtataattattttgaaatttgcagtggaccggaggtcataggcacatctcaatacaaacatcctgataaaaatgccagcttacagatggataattggatatgttcttttagtaaattgcataagaccctgagtacacccccaagatgtataaaatcagagagattcttacatgtagcatataatcccaaatattatgatactattttgtacaataccacacaattgataaagtctactcaaatctgacatgtggtatgaaactcttagatgctctcacatatgggatgaaactattacatatatgctcacagagtatggtggatgaaagaactcacggaatctacatgtcagatttaggtatcgtttgtttggcttatggttttatggaacaccgcttctataatatttggagttatgtatcaggatccataatctctgagattttgtacaccttaaacgacgatacccatgattcaatgcaatttactttttgttttttactcccttcaggccttcattccaaagcaaaatataagcagccatgtacatagaaccgacaagagtcaattcattaaaatttccatagcaaccatgaaaataaattcttaaactccattgtcagtggaaattaaaaacagacatataaacgagcaacgagtagtaagtgaatactgtactctgtacacaggtacttatatcattagcgtgaccatattattcactctttctttgagctgatgactgggtttcgttattctctcaactttctcaatcattactttctcgtttttcatgtacagtgtattttgccaaaaaaaaagttctatagaaattatctctaccttttattataaaatttgaagatgtttccactgatactatggtacgtcgtccgtatttaagtcagcttttaagttcgttcgtttttaaaaatacaaaagtagtcgtataaaaattccttttaaaaatttcgcatgctaacttagaatgagaagacggattcctaatttatttagaattctcaccaggtcataagaaagcaaagtacaggatgtaaccatcatcctaataaggattctgaattagatatcaatactatcaaaataaaaatcccatatattttttaggaaaaaaaatctaacaataaaacgatttaaatagcttttacccgttacgcacggtcatcttttctatttttattaaaaaaatatatttaattaaatgtgtgctaataaatcatgtcgtttatgcgtacgtaagagattagttcccatcacatttagccgaacacagcacgaaattctatttcgatgggtgtaaagatgacaggaacatagccatgcgcatctctttcaggagcaagtagaaagaagaacaaaacgggattcctcgactgaactcatccacgatccatccaaattctcctcctcaaaaagagaacaaatttttgagtggcgccggctagtctgccaatatagaggccacaggccacagcaaccgaagcagccatcatttctgctccccaagtgagctctccctctcctaccaaaaagaaaaagaaaaaaaaatcctaaaggcagtgaaccaccggccacgtcggcagcagcttccccccattctcctcgtcgcgccaccgccgccgacggggaggcgccgcacgatatatacggtggcgcaagcggcggtgagctagctaggcgggcggaagaaaggggggcgtggagggatggccggaggagggggagggggagggg

SEQ ID NO: 498 - DNA, 41666 bp, Oryza sativa
  unsure (1)..(41666): unsure at all n locations
cgcgtacgtgttcccgctctactcgcacgccatcaagaaggcgctggggtacaaccagaaggcgctcaccatgctcggcgtcgccaacgacgtcggcgagaacgtggggctcgtccccggggtgctcgccaaccgcctcccgccgtggctcatcctccttatcggctccgcctgcgccctgctcgggttcggcacgctctggctcgccgtcaccaagaccctcgtcatgccgtactgggtggtacgtagcctcccgccctcgccctttcagtgattgtgtgctcgtcttggcttttgcttgtttgcgtggggatttcttgctgtttttgcctgatttgagctcctcatcggggaggagattgagggatgatgatgaacagttttttattgagggacctaaaattttagcacatacgaagtagctctcaaattcccaattttatctttttttaaaaaaaaagcgattattgtccttttggagcgtaatttctggatatggcttggttgactgaacgaatgtcgaaggtgatgatcgactagcggcatctgtagaatgttgaaagatgtgcgagttttttaactgtatgattgacaacaacgccggtagatattttcctagaataagcgtgaaaccaaatgtggcatatgtagttctttacttcctgccattcggtagaacatgtcagactttggtccattctttaggtgaataattgttgactatttaaacaatcatgcttgcaaatggggcacaattggttccggtactgagagccacagcaaacctagaactttaatttcgcaaatctgccaactcgagctggtgacctggtgtattcgcatccctacaacttcttatatagttttaagtgttggtgacagattttggcaagttaatgccctaaagttattttcaagaagcagtaaggctgactttaatcagttcaaaattctggttttagtaaattgcataaaaatatcacatgtaaagacatttactgttcagttttacatgagttttctgttgcagcagcaacagaaaactatattatctgtgtgtgccacatatataaagattatgccataaatgaggaggtcaaaatataagtagtaaggcatgcttagtagtgctatctaggttgtctcttatgattgccatgttatatatattaaaaaaaaagtaggtggcagagaaagggggtgaagtgagagaacgtgtcatctcttatacaagagacgatatgagagaggacaccgacacacaagactgagagttctgaggtgagtatgcgattaaaagaaggggaattataatggcatttatgatagagacaaactgttagagatcatataggttgtacgtgaggttattcttgaatcttgatgagtcagatttgtaggagattacattaggggtctctttattttacatggtctaagttcgtattacttgattgaagcattggctgacacccaaatacccaatacaacatgattgagattcctgaatgtgatggttgctcaacttttggtgattttcaactttgaatagccatctgacctgcaacgcctggggatgtcattcattggtgtttgtgaccactgaaaggttattgctgaagttggtatgaacacaatttttgttgggactttttccattacaaaatacattgacaatgtaaaagcaagccaaagaaaaacagtgaagttcatgcatccttagctttatacacttactggtaaacatgttctggtcttgtgttgtgtagctgtttattattattatatttgcttgtgtgttgcttttttgtgaccctgaatgtctaaactctaaaatgccagcccattctgtatatattaatgttttcacaatttagagacatacattagacctactgtattgcttttttgcattcgtatcgtattgttttagggaaaaaatgtttgttgttttgagccaagatttaatcaatccaacaagatattggtattacactgtaactttttaatcactgtaaataattttttgccaaaatgatatggaattcctagtcgacatttgatactttttttaagttcagagctcactagaatttccatagaaacaccagtcactttacaatcagtgtcttcatcttcaaaatctcagccgctgaatgaacttcttggacaaaattagtccctttttagtttcatgatcgtcctgatatgttcaacatactcaattcatgaatcaagatactccattaaccgcatagtttttccaacaaagtagaattgtctcacaaagaagccactattaaggcacttattttctttgaatgttgcaagaatttcctgtaattgtaaatgttctgaatctccaaagatccaaaaaaatcgatcatcatgtctcttttccctttttatgtactagtaaatgtaaatcaggcgagcagtacacgtgcatgctatccttatggagagatctgataaagaaaataaattatgcacacgcttagaaggcaattggttgtttaccataaatattttatctgtaatgttggcaagtacgaaaatgctgactagtgttacgtgcatagaacttttatatctgtaatgttggcaagtacgaaaatgctgactaatgttggcaagtacgaaaatgctgactagtgttaaatgctgactagcttcctaaatcatggaaccgcatcttggtaaaattctgtctcaaatgcctgatgagttgtccatatctgatatttcttgctcatgttgtagctcatactttcaagcgagtctttttatatttagcatattttgttggatgcctcttgcagttgtgcatagccttatgtattggcacaaacagcagcgcatggttgggcaccgctgcacttgtgaccaatatgaggaactttcctctcagccggggaactgttgctggtctgatcaagggctatgttgctgtgagtgctgctgtctacacagaaacatttaatggaatgcttcagaactctcccacaaaccttttgctgttgcttgctttggggatccccaccgcatgtgttctggtgatgtattttgttaggccttgcactccatcactggatgaggacaacgcagcagagcacagtcatttcatgttcacacagatctctagtgtggttctcggtgtatatcttatggtagctacaattctcggtgatactttaaaactaagtgacgctattacctaccttttgtttggtataatgatacttttgctcctttctccactggcaataccaataaaaatgactatttatccaaacaaaccaaaaagggaaaagactagcacccttgcactgtcttattcgactgatagtttgtctggtccggatcaagagaattcagaaccacttcttggtggcacttcaacatttgtcactggagccaacgattctgatgaggctactgatgtggatcttcttttggccgagggtgagggagccgtgaatttgaaaaagaaaagagggcctagaaggggggacgatttcacattccgagaagcattggttaaggcagacttttggctactatttattgtgtacttttgtggagttggaactggtgtcactgttctgaacaacctagctcaggttgggatggctgttggtgctgatgatactactatcttgttgtgcctcttcggcttctgcaactttgttggccgtatccttggtgggtctgtctctgaatatttcgtaaggtcagctccctttaaccactttgcaattactttattcattcaatttctatcattgcatagctgacatatatagcaactaacataagccaaagacataacattttctgttcttgcctactgtgatgtactgatattactccatatgaccatatgaggccaaaagccactatcacctcagcacttcctgtgaaatcctggcagactactcagatgagctggccgctgatatttatctcctgcagactggcaatcactttgcatattcctagtcatccacaatcctatgattttttctttactcttgttgttaagctacatgcttgataactattagttgctgcttctgtaaaatgattcgagtaaaacctgattgcaggtcaagaatgcttcctcgccctttctggatgatgtgcacacaaataatcatggtgataaccttcctccttttcgcaactggccttcatagcttgatttatgtgtcaacaacatttctgggcatatgttacggtgtccaatttgctgtcatgatcccgacagtctcagaactttttgggttgaaggactttgggttgatgtacaacttcatgttgttagtgaatcccctaggtgcattcttcttctcagctcttctcgctggttatatctatgacaaggaagcggcgaagcagcagccaggcgtgttggaaccttcaacctgccttgggcctgactgtttcaggcttaccttctacgtttgtgccatcgtttgttgctgtggaaccctagtgagtgtggttttcatagcgaggataaagccagtttatcagatgctctatgcaagcggatcgttcagacatcctcggagtcaacaactccattgatggcacgcgcatgaacacagactattttggagagaattatcagctcggtgtgtatagttggctttcttatcacttcatatcccagtgctgtattgtcctactgttgcttggtccgtccccgttggatcggagagttattttgatttcatctgtacctgttctgtaaagcttgtgatcagtagcagactagcagttaccagcatacagccggctgtcgaagggatgaaacttgggggcgcgtatacatggtggggccgttcttgtgcttgtacatcaagtttgagaatgttgtacaatatcttcttcatcccactgacgctgttaataccatgagtgcaatgagcctggttatgtgtcttcttttttttttcccatggaaactgattatgtgtatgtgtcttgttttctatggtctgaacatctgaatttcagtagatgtgtcccaagccaactcccaacttgcaattactcctaaaaacgatacatcaaaagttcttacaaatacctatgaatgtaaactaacacaacgtgatgagcataacatggagcgacacttccgtcccttaatataagggattttaacattttgcttgcactgtttgaccattcatcttattcaaaaaaaaaataatagaattattatttattttatttatggcttactttattacctaaagtactttaagcacaacttttcgttttttatatttgcacaaattttttgaataagacgagtggtcaaacagtgtaagcaaaatatcaaaatcccttatattaggggacggatggagcatatgatttcttcgattttctgcctggaatatgggtctctccgagtctgtgtctaaattaggaaaaaagagcacctaagttatgatattatcgtaaaggcacatgtagtaagtggtaaggccgcaaactaggccatatcaaataacctgaacatgagggtacatgaaatccaacttcctactccgtcagtcaaaaaaaaaaaaaagacaaaaaagacaagggactatctacagcagaatttttttgtgaaaccgatctccagcagaattttcatccactgaaatgcgcaagtaacagccaaagcactcaagtggtgccaccgtgatgagctgatttgcaacttgcaagttggcgtactttgctccgtcctcctcgtggatgacttgattgccatgttgatgacagtgttgggagggagaccagatccaacgcaatttatcttaagcaggaaccaccgtgcaggcgtgcactccgtgcagggttcaggctcgctcgactggacgttgcgatgggcgtccagttggttggatccgagtggccacggaaccaaatcgcacctgaaattggctgcatcttccagaaccgtgggccgttttgcggtggttgcagcgctccggtgggcgccccgcgtcccccctcccgggcaaaaccaccggcgccgcggcgcccggcgacgttgacgctgttacaggtgggccccgggtgccatgttgtgaagcgttgggacctaccgacagagacgggatcagaattcaatttcttccgtaggacgcgggaaccgtcaacgctggccggtggcacctggaccctgaggccagtttctcccaattcccaagatttaatcttgcacgcaaatcattggcccctcagggagacttgtggaacgcaaaaaagaaaaaaaaaacggtggtaacggcctacggtcaatgcaattgggtcccgccctactccctccgttctggacaagagctgattttttactactgtattgtactaggagaagtagcatctccatcttttttttaaaaacggagtaaacatgaatttatcggagagaagatgaatatgtagtcagggcaagtaaaataagaaaatcattaacacatacattaattgatttctaattattacaaactcaaaatttgatttatttgatattttaaatcaacttctatatagaaagtttttgcataaagcataccatattgaaaaacgtgctaacgtaattcaatgaaaaatctgcatcttgagaagaaaagaccaccactgtgttttttatgtaatccctctgtcaaaaggtaaaattaaaggagaggacaacaatcaaaatattcctcattaatagcagtgaactactccctttctcacaatttgatcatcatttgaggtttctgaggtcttcccaaaatgatcatcttataataagtgctctttgtttatttgtaaagagtaaatatgtatcattaaatatgctacatgtaaccaaccatgattaatttttattggtgccactccatgcaatattttaaacatgatgcaatccacggggcatgaagtgtcacaatagtttaaccgatgatgattaatttcatacggatgaaggaggtttttattgtctttagtctctgcgctccttacttgtcccttctatcccaatataattcaagctaggataggatgtaatatatgatagtacgatgaatttagacatgcatttattcagatttgttgtattagaatatatcacaacatattctttataggttaagttattttaagacagagtgagtaggtaactattaaattgggatagatagagtagtactattggtagtaggtaggtaggcgacattaaagaaataaaaaaaattttgatttgtaaatcaagtgtagataaaaatgtagaagttaatttattttaagataaaatttgaacatcaaagagttgatttatttttgaataaagggtatattccactccatgctaacaccgtgagtagctgtatctcccaacattattgcttgtctatgttgatcattaactatcccaacttattgagggaacacatcgccatctatctctaagagctaaactctagctactacagcttattttaaaattagaatctccccaaacattttagcttttggtttagattctaagggcctgtttagatccatttggaatggcaaatggcaaatggtaaaagttttggtggcaaaagtactagttagtgtttagatgcatgttaaagttttgccattctagcactaaagtgaaagagagaaagagatggggagtggtcccaaagcactttttggcacaatttgctactatggactttttggcacaatttgctactatggactagcaaatgccaaatgtcaaattgccaacttttgctactagtgtttagatctaaaatgacaaaaagtgctacaaaatgacaaaacttttgccattttggaggatctaaacagggcctaagaagctgtacttgtagaagccattaactgggaacccaattttttaaaattctcagaaaccgcctataaactaggttggatatgtaacacatgctaatacaaggaatctggaaagacttcttgtctagattcgttgtaataggatatgtcacatccaactaaaatcccttatatttagggacggatagagtattttttaaaattttaagctcacaaacaatcctttctgaatgtaagcacctttctgacgtatatataccatataaactttccgtataaaccagaccgctgactaaaaaattgcaacgactccaatccgtgtgcagaccattgtattgatgtatactaggagaagctttttcagaaagtacagtagtaccaagtgcaaagcgagatgcttcttcgtgtgcacagcataacagcttttccgctgtggacgtagcaaaaaaaaaaaaaagaaagaaaaaccgcaaagtcaagtaaacttcatcaccacaacaaaaacgaggcccacccgcacccactcgcccccgacccgcattttattttctcctcgtctcctctcctctcctcctatcctccgccggacgcgcacgcacacgcacacctacgcatcgccgcctcctcctcttcctcccactccgcggaagcgcgtaaccaccacctcgttcgttcttatctccaaagccgaagacccaccgagccgatcccgacgcttcccccatggctcctccgctcctcccccgcggcgcggccctcctcctcctcctccgctccgccgcccgacggccggcggcggcgtcctcccgcggcttcctgtcgagcgctgcggcgggaggccgcgagggggcgctggccgccgccgcggtggcggtggtggggtccggcctgggtctgtggctggtgcccccctcgctcgcggactccggcgaggcggtggccgacgccccggcggtacagatctcggtaggctccggctccggcgcggtaggcgccgtggaggagcgaggccggaagaggaggttcctcctcggaggtgagcttcgcttttgcttcttatcccccctccgcgatttgcttcccgcttcacgattgatctcgcgattgttctcatggagtgcgtccgatcggtttgcgcgtcgccgccgccgccgccgttgtcccgtgatgcttgtttcctttacttctctactaagctttacggacgctttgtcatgttctctgatttctctcccgtaaacagtttgcgtccgtagcgtcgctgctacttttccgatcgtctttttagcactttaattgctgggatgagctggtggtgatctgcgatccgtacgacgatttctttgctgcgctgatctatctgcagataagcgataagtgacaaacatccgaagagaaaatccaaactagatgatgcggccgtttgtagtgttaggaaagtctttggcgctttctgcttctgtctgagtgcgttaatgcttctcactaccattatatttgcgcgttgaactcaactgctcagtgaagttgtagaatggtttaatgattttaattgcttttcttccacagactcgttccgcagaagggtgttcttcaattacgagaaacggatacggctgctcagccctcctgaaaaggtaattaatttggttcattaagtgtaaaacccgcttaatttgtgttggtcggcttgtggtatcctaattcaggtgtttctgcgagtagatctttgaatatttcgcgtctgtgcggaacccggaaggggaagtattcatgttgcctgctgacttgatgagagcagtagttcctgttttccctccatcggagtcgaacatagttcgggagggaagattaaggggggaacgcaatcctggagagttgcactgtgctccatcggagttcttcatgctgtttgacacaaacggtgataggctcatctcctttgccgagtaagtgtattttatccacactaggtgtaatacttaaatcacttgagtgttttcagaatgtttcaattaaagggttttaactttttcctaaatactgccgctgggatctttgcatgattccctttgagacttatagatgaagatcccttgggtcaatatcataaatatttgcaccctattttatcattggcttaggttcaatttctaagtaggcttgatgctgattatgcttatggtggttttctaggtacatcttttttgtgacattgctcagcatccctgagtcaagtttcagtgcggccttcaaaatgtttgacgttgaccacagcgggtgagttctatttctactatcgcacttgttctagcaacatgtcttgctgtcagaatgatatgcatctgctcggtacctcatattgccctgtttctagtattactagtcttggtctagtaatatgaccctgctgctagaatgatgatatgcatctgccatataactgttctttaattaataaacctgatatgtttgcatgtttaacaacatcaccacatctgttagttaatggtaaaaacaataggttactgtatataccatttttggtggtttagttcagcattccttttcttttcatgtgtacaccttttattactgaagctgctaaaggtatgtttccttttgtgctcttggatttgtgcataaacaaggacacgtttaaatattgcctttgtttgtgctatattgttgtttacctgtgaccattcgcatgcagttaatttctcttctcgtccagaaaagaccagctctttatgagcatctgacttgttagttgatggtaaaagaagggtatgaacaaattttggccagcttattctctgttattttgttgtccttatctgttacttgtcattttcagggagatagacaaagaagagttcaagaaagtaatggcactgatgcgatcctataacagacaaggagccaaccatagagatggcttacgtactggactaaaagttggtcagcctgtggaaaatggtggagtggttgaatacttctttggtaatgatgggaacgaacctctacactatgacaagtttacaaattttttgaaaggattgcatgacgaggtgattcatttcttctgttcttcaatttctgtaagaatttagtccaatgacttgtcatgaatacccattctaataactgtcttacgactcaattaaactgagagtctgagaccgtatttgcattgtgaaatgtataacacacatctccatatgttttacatgtttctgaactaaaaacacctaactttatcatatatgaccaaaggttccaacgtagcatattgtgtctgcgtgccctcatcgtctctatacttgctgaaactttgtatcctcattccttttggtaggaatatatcactatatcagtaagctagctagtggtacatactacatactgatgttattgatcaacgtacataaaagaacaaaagaatctgtacaattatttgttagtagatgtttcctatgcgcaattctgaatctctcttaatccattcacctgcagatcattcgtctggaattcagtcactatgacgtcaagtcatctaatactatcccagcaaaggatttcgcattatccatggttgcttctgctgacatgaatcacatcaacaagctacttgatagagttgataatttaggcaatgatcctgatctcaaaggagtgcgcatcaccttcgaggtttgacttttgcatgatcccaagctgtacttttctttaaaattctttttccttgtttgatccttagttcattgctgatattccttggggtctttaggagtttaaatcctttgctgatttgcgacgaagattggagccactggcgatggctatctttacttatgggaaagtaaatgggctgttgacaaagcaggatctcaagcgtgcagcgcaccatgtaagtttggctactaagttcatcgtacttaaattcgatatctccaagcaaaagaattgattttgaggcttttcttgatcaaataaatggtctccatggtttttttgttatcttaatgctcacttactaaactgataactcctgctgctcaatacttgattactatcaccattgtgcatccactaagcgattccattccctttttggtttgtgatgtaggtttgtggtgttgacttaactgacagagtagttgacatcattttccatgtgtttgatacaaatcatgatgggaacttgagctcggaggaatttgtgagagcattacaaagacgagaaactgatgttcgtcagccagcgacaccaggctctatggggctgttgtcttactggctaaacttcaacaagtgttcttcgcttacacagatgctgctcaagtagattgttttgatccttgctagattcttcttggttggatttccgtcacggtaagcacatcaaatttacctaccgttaacttcttccgtctgaacatgctatccgtttctgacgctgttcccattgatttcaggagatgccgaagcgattttgctgtaaatatcgtgtgggttgtcaaagggtgccctgtcacatagcagctgtaaatattttatagcgcctttcttgcaggggtagattaatcattcttgtaaattaaggcctatgcaaaatgtaactgatactctgataagacttttgaaaggttaaaaccaactttatcgccgtggttcgtattatgtgtttatactgtgattttttttgaacgatcagcagcaccagaccgagcgatgattcgttgaatagagtaggaaaaaattacaaaggtgctgtgtgctatctgtaggttttaaacctcaaactaggaacaggacggtcaacggcaacaatgcgcatcacaaactctatgcgactatgcaagatatagctgtacgcaggagacgcgccatagttcagggcaaaagttgggggaagacaagatcacaagagaggcagcaacatgtaaggttgggcctgcagtttggccatcatttcctggcgcagcgtatgcatgctgcacaaatcgctgtggagtataaattggctttgcattgcgcggccactctgcccatgtccaatgatagagctggctctccatctactagcttgtaccacctgactgcctgccgcctgcctgccggattgttctgctataaggccaacggatggaatgcttggctggtgactgggatccaattcttgcctcagcgagactatgcaatccttgcccagctaagcctcagccggagaaccacacaggcccgcagttacccaacgatcggcgcctagctgcaattccatatagttgcaagcaaaggggtcagcagtttcagaagatgatagtgcgaagtataacataagtaacggtagggctgtcaaaaaaactcgaagctcgcaagctgcttgagcttgattcgttataggcttgattcgagctcggctcgaatactagacaagccaagctcaagcctaggctaaggctcgcaagcctagtaagctcgagctcgaatagctcggcatggcttgattagcataagatacattgcatgtaggaagatgttcttaatgggtcaatgtatacttatcatcgtgcttgacctgctcaagtctcaagacctcatcaatgcttcttaataaagcaattatccggttgctagtaatagtactactattcctattagatgtagtagctagcttttgttaattgcaatgtttcaaatccatgaattcatgagaaaagctgcagaggcttcattcaagacaagtagcactcattaattttgactaccgataatttgcattaatatctcttatacaagagtaaattctttggagtttcaccaagtcaagctgtcaagctcgagtaggcacgaagctcgcttgagctcgaactcgagctcactcccaagctcgatcaatatccaggctcggctcgagctcggctcgagttcatgtcaagctcaagcctacatagccaaactcgctcgagctcggctcgttgacagccctaagtaacggcgctccgtcactccgtcccaggggcgacgcgggcggcgaaaacgccgccgcctctctcttcccctcctctctcccaccttgcagccgccggcaaagccaggcggctgcaaagacggctgcggcggggctcctcttctccctcgccctggtgcaacggttggggcaccgcgagaccggatgacgggagcacggcgccggcgtcgacgcccagatccagcgccggcgagccgggattcgaccctcccttggccggatctgggctgggacggcgacgacgacacgagggcagcgcaacggcggcggcaacttcggagcgagggccgcgcggccggtcagacggtggcgcgactccccgacggcggctggaggcgcgggctgccgggccggcggcgactgcggctgaaggtggcgcggctgcggtgcgtcggctgcagctgaggctgcacggcgtcggcgtcgacgacactggaagcggtggcgccggtgccggatgcggtgcagcggccgggatgctggacacatttgccggaggcgtagaggcggctggaggcgtgaccgaagacactgggcggcccgggtggccgttggtgggcggtgaggtggcggcggagtagtggcttcggtgaggccgctattgggcttggcggcggggtagaggacgctgacgacaaggtcatcttccttgtggttggccacgcgttcactgtgtttggggagctcctccccttctttgtggggagcttttaggcacggtggaggtgttggctggcatacagggaagactcaggttgctaaggcgaggttgttcctggtccggtcccataggtcggattcgacgtagaggccgacgagcgacgtggaggcggcctgggtcagcgtgctagggagtggcggcagggtagaaggcgctggcggcagggttgtcttccatgccgtcggccaggctaaccctgtttggggagctcctccccttctctgtgggaagcttcttggcaggctagaggcggtggtcagtccataaggaaaactcaggttgctgaggcaatgttgttccctacccagactcccttaggtcggattcgacagggaagccggcgggcggcgcggtggaggcggcctaggtcagcgcgctggcaaaggtgatgggtgttgtggaagtcttgtcgttggcaggactggaagccggctgacggaggggcgtcgatcgagtgtggcagaagccatgtgtcgccgatgtttagttgctggtttcgaattgggcgacgaaccatagcgatagggattctgagcgaaagcttagcccaatctttgggccaacagtgactacattttcaggcgtggtaaccctcctaagggaattgttgagcagttgaggtacccctcctccctccgcaaggagctctgggtgaaaaccttgtccctttttgggacggatgatgatggcgtctcgcgttgcaaccctcgcgagggcgtcgttttagagtctttgcgccgaggtggtgttgttggcccgatggcgatcggtctcgcatagcgacggccggttcggtgctcggcttccctctctgtatcgtgtgtttgggcggttggcacatggttcgaggtgtgtgctttggtgcactttcttcctcgacagtaaacaactcatagggcacaattaagcctgcaggtaaatatcacacagttgatgaatgcaaggacgcacagaaatcaactccgcacatggaaatcgaccaaaaatgagaactgcaataactcggattcatctgatcacatttatctacatatcaaaatcctgtggggctacttcagagcacaaattcaggaatgaccactgtaaatgttccttctcctcacaggacaacagattatgatggcatatatatatattcatccttattattgccggagaaaactaccaactcaagaggaggcacctactactaagctagtactagtaactagtagtaatacatgcatcaagaggggtaattaaggacataaaaatgaagacaaggaccaacagtgacccctccttccctgtgctgtgcacactgcacagagaaaaattaaagatcgatccatccatctctaatagtctccactaattttaatttaattcttcttctttgagaaccaagggaggaggaaatccaggtgacagatcaacggggagaaagaacaaatcaagaaaccagtgaaaaaaagaacacttgaagctgttgctgcatccgtgtcctcctgcttctccttgcgacagcagtagagcttcaacggcgccatggtgagggggtgtgatgcggtggcgtcccccaccacgcctgcaactgccgtgcaccattgccaccaccaccgcagtagtgcgcgttcaagaaaccctaactttggaagaaaagggagagtggaaggggaggaactcaccggggagaaggtggccaccggagaagacagctacccacggagagcgtgtgttgttgccgctgcgtccgggttgcgccgcgccgcgccgcgccacgccatccccgccgcagcagcgccccctctcgttgtgccgccgctgcgttgcacgccctcgagagggttttttcctcgccaccagagaagctgaatatttcccggcctattacacggggaaaacaccccgtgggccgggataaaatctcgcatgggcttaaccgaacgcctattcttgcgtgggccggtattcttcccacgccgggttgatccacggggatcgggccctgatcccggccgttcccggcccaaccgaacatggcctaaagaagaaaaaaatcatcacactccaaatttgatctcctgaatgtttagattccttcatcaagttcatcttcgcctataaaaatgaaatgaaatcagtattgtttaaaacatgcccaaaagcatcccctaacactgaagtaactgttcagattatgctcatatggtattcaccgctttatgcttcatttgtatatggagtaatagaagaaaacaatattcaagacatgttagctatgtgaccttgttaaggcgatacatatgattggaacaatagatttctgatctaaaataggtaagtgggatttacgtcagaaaagaaaaaagctagattatgcactttgagaaatgcatatagctttttgcacaataaatacatatatttaacatgatagcaaatcagcatgtcccagactaactttctttgccggcaaggttttctgccaggaacttgatccgttttggatcaatcaggtggagaactggtgtgctctcaataacactaagcacaacttccttaacatcaataacattatagcgatcctctttgcagagaaactcaagagcaacctggaagccattcagaaagaaaaatccttcactttctctcacctctccaagatcagcagcattataggctttggatctatcttcactaacttcagcctgacagagttccggagaatatgaagtgaatcatgaatgtctttgtacagctaagagtcacccaaagaaaaacaagagtcccacatttgctatcattttgtagaactttcaacgtagaatggactttggcagccatgtgatcatttctattttgcagattaatgttaaagccaagtgatggtccatgccagtctggctattaaatctttattctttgatcttgcaatatggtagttagtaatggaattaaagatttggaatatagctggcagcttagtgatgcccgcattgcaataaaatcatattatcagccttgtaaagctctcaaagttgacatgtaccaaaagttaacttattttactatcggaaggatccaaaaagaagaatgacaatatagcatggcatgcaaagggattatagtgaaggccaatcagcaatattgattaacatgatatgatagcaaatatcatagcagcaatatggaagcataagggtagatgaagcactcactcttaaatccaactttttaacttgttcattgcagaattgtttgagccaagtgataacactgggatctagagcttgattaatagcaactccactttcacagatccaaggatgtcctgatatatatatatgtatatatatatatatatatatgtatatatatatatatacatatatatatgtatatatatatacatatacatatatacctacatatacatatacatatatatgtatatgtagagcttgattaatagcaactccactttcacagatccaaggatgtcctgatatatatatatatatatatatatatatatgtatatatatatatatatatcacatatatatatatatatatgtgtgtgtgtgtgtgtgtgtgtgtgtgtatgtatgtatatatgtatgcatacatatatgtatatatatatgtatatatatatatatgtatatatatatatatatgtatatatatatacatacatatatatatacatacatatatacatacatatatatatatatacatatatacatatatacatacatatatatatcagtcaacaaatcaaaaggtttgtggctcttaaataattagtgaaaattaaaattatgtatcaaaatatgttatgaacaatgtatagctactcagcaatatggacaggcaatgaaacaaaagggcaactaatttaggtgaagaaataggtcaattatacttacttagcagttagcacttcatggcccttcaaagttcaaatgctctgaagaatattgagagagcattttccctatatgatacttctcattgtcagatatctttagaactgattgaaaatcaatgagacccttcagaactgcatcaaatattttccttgttgtgtctctggaaaaaggataggatgtgatcactttagcaattccagaatatattagattcaaatttacaacacataaggttttagataactcacctgcccaaaatggtggcactccactcatcaaaacgttaagtaccactgtagctgaccacacatcagattttggtccataagtgcagtacctaagattctggtctataacatatctgtgcagtacctcgggagcaacataatatggactcccaatcaactcggtgaaacctgacctgcaaattgtaaaatggaaaatttaagataaaagttaaaaactaatttatatatccacaacacttcacacatgagctgacacatacagtgccagaactgtcaaggaagatggataaacaacagaatatagttaggatgctcttgattatgttggcgtgcaaatactatccacacatatacagcaaagcagacaaatactctctaaaattattctgtggagtacatattatgttgatctgttactctctaaaattaaaaataaaccactacacatgcattaaaatgtagcataagaacaccacctggtttgaagaacacggatgtctatcgccttaattgacagaccatcgtctttaatctctgcagcctacggatgtctatcgccttaattgacagaccatcgtctttaatctctgcagcctttcgctcgttataatgcccctcctcctgaatcttgtccaagagctcaccaacaatgaagagctccatcacaatgtgcaccgctcggccatcctcacatacatccttgattgcaacaatattgaagggaggaggagagcgcctcgccgttgtcggagctcgtagctgccgcccagctcctacccacctgcgcgccaccatcgacctcctcacccccatccagcgacaaggagaagggggcatcggttggccgaacctgcgctgccgctgcagccagctcgaggagttctgtcgccgtgccgccaccaagcttaaggggaggggcgacgccggcggcggagctcgtcgctgccggagagctgctccccaatctccgcacgcggtcaccgtgttcctcgccccgtcatcgagatcctcggccccatccagcgacgacgaggaggagatggcggctcgccggcgcgtggaaggagagggttcgcggtgatctcactggggtcatggagggaggcgtgccaaagtggtgcagatggagaggagcggcaccagcggggacatggaaaaggaggcggaggcggcggccatggcggggtggaagagaaggcggcgccgcggcggcgtcgttgggagcgcgagagaagagagatggacatatagggattgaacgtttttgccaaaaagacgctaagctcccgtatattacacaagtccaccacatcgattactcatcgtagattatcgatccgtttccgttgccgaatcggaacaaaagacttacttccctcgctgaatcgtaacagaagatcacgccagccctcttatacaaaagggccggcctcgacgggggaggacgtacagaacccatcattaatctcatcgatcctctagttagctttgtaaatatctatggtctcctttggtgacgagggagcaacacgcttgtttccaaagccttctcctccggtgaggaggagaataatacggttgtttccatagcgtacgacgaggggactatagcctcctcctccggtgacgagggaagcaacacgcatgtttccaaagccttttcctctggtgacgaggggagtaacatggttgtttcatgacctgcaacacgcatgtttccaaagccttctcctccggtgacaaggggagtaacatggttgttttcatggcctgtgacgaggggagaaaccaagctggtggtggtcttccccacggcgggactactgcatcggaaacgccggatctgggcactcctcctgactccaacaacgagactagtggtatgtaggaaactgcggcggctgcaagcaaagacgtacccaccatccactttgtgcacgcgagctccggcgacatggatcaccattgttcatcgttgttttcccctcccgcttactgcaattcctactatcccccgttgccgccgcagcccgggagcctggcgaccaaccagatagtggcgaggttgatggctcagatgaactacgaggagggcaccggcctcggcaagtacggccacgggattatcgatcccatcaacccgaccaaaaagtacgggaaaggaggcgttggcaaattcgagtcgtcgtacgatagcgattcagattacaacacagggccgcctgtagagcccaagctcgagcggggcaccggcaaagcagagccgaaggctgttgtcaatgccgaggaggtccgcgccatggacacgctgcagagagaacgcaaagcctatgccgccgcgcgggcgcgggagcggcgccacgagaaggttcgggcctataacatgcgctggcaacgcccaccgaaacatgacgccgccgccgacgacgactgggaagtgtaacatcccggcctagggcttaataggattaatagaatactcatatcaacaaagttgcaacttcttttccagaagccaatctccaaagaactctagggttaagcgtgcttggcctggagcaagttgggatgggtgaccgaccgggaaattcttcccgggtgcacacgagtgaggacaaagtgtgcagaaaagatatgtgttggtctgtgagggcagtctatgacctatgaaagctatcagatgtaagcgggggcgagggcagtttatgacctatgaaagctatcagatgtaagcgggggcctgggggaaggcgggacgttacaggaggggataacctccgggtatacggccatggcagtctatgacctatgaaagctatcagatgtaagcgggcccggcctaggggaaggcgggacgtgataacctccgggtacacggccatcaagcgcgtcttgaaggtggtcctggagcagagcgagtcggggaagctcacattgggcggccatggcagtctatgacctatgaaagctatcagatgtaagcgggcccggcctgggggaaggcgggacgttacaggaggggataacctccgggtacacctccgggtacacggccatcaagcgcgccttgaaggtggtcctggagcagagcgagtcggggaagctcacattgggcggccatggcagtctatgacctatgaaagctatcagatgtaagcaggcccggcctgggggaaggcgggacgttacaggaggggataacctccgggtacacggccatcaagcgcgccttgaaggtggtccgggagcagagcgagtcggggaagctcacattgggcggcctgatccatgagttcgcgggagtgaaggcgaagttcccggaggagtacaggacgaacagtatgccgtacaaggcgatcagcttcgcggcgccgctgctccactcgcagctgagccggcagtacagcgcaggtgagtatggaggcacggagccgttgctgaaccgtacacttgtcatggtagaagcgctcaaggacacgctgggagcggacgcatcagcggcgtaccctcgcctgatccacgacctcgtgatggcacctcccttggatgcgtggtggtggagcgctgcctccttctgcaagctaccatggattccatcctggatgaggtcatcttgcccacgctggtagccgcggcggacgtgtttaggctgacgacgtggtcgagtaagccgagcgtttgcgtgggcatgtggattcctcatctcggccacgcccgcctacgaatagtgtacatcattataagcaggcggctcagagatcacctgtgcggcgggatctctgactatgactacaagcttgcattgccatggaaaaaggtgttcgatccagcaagctaggacgaacacattgagcggcacgtgctgcctcttctgaggaaggctctccatgatcttgagatctcagtaagaatgacttggctacaaaataaaaacttcttccctcttgtaatgaggtgggcatccatcgtgccggtgaagtacatggtgccgcttttgatacaagggttctttaagaaatggatgtactccaactatcggtatctaatgggagagaggccccggctggatgaggcgatggcttggtatgaagtgtggaaaggacttttcacaccggaattgctcgcggagaagtgtgtggtcgtgtagctcgaggctggcctcgacatgatcaaccgtgcgatgcaaggactagagataagcgtgtcagaacattagtaacataaactgctgaggcctatgcgagttcgagatgctgagcccctactagtaagaagcttgtatgtgttatagatattgtgtttaccgaggccaattcatgtatgccatctactatcatgtaatcgtgatatgaagcttaagttcagtttttgcctctttgcttgttatatctatactatgtctatgaatgccatttttactggcttttgatttgaaaatgaatatgaaatgatttttaggagacgttttgccagaaactaatcgtaaaattctgaaatagtacgtagttagcaatcaggaaagcatgcaagttgtacttgtagatagagcagcatataacatttgacaacagagttgtttaattttggtttctaatgaaaatcaatcaagacggcatttgatattcccttttctaatggttcctttttggaacctcaaaatgtgaaaccgtctagggtggagaactgaagaaatttggaaagatttcaaacagtacgtcatcacacgtcgccaacgtctatattccctcttcctcgctcgcattatcttcttcccaccagcctgggttatcctgtacgcttttgaatggcttcctgtttcggtgtttctttccaaatcagctgcttgttagggttgccagtttgccacacagccacagctgtggcgttggcgccgccccattgacctgagccagcttaattacatttcgggatgtaagacttttcttgtaaccttttcttccaatcttaattacattgaatgacctcttagcaagcaaaggcaaatgtaaaatacatctagatctcatggttcataagcttaactctctttactgtatgtaaacaaggacgagcttataatataatcgcgtaacctgagcaaagataccaggtacataagcagaacataactgtatgtcagagtcacagtgcggagggacgcttcctcgcgcaaagcggcgtaaagtaccacctgtgctgggagatcggcttctcgcaagcccgcaattgcacgaatcagagtaccaggtagcagctggcgttcgcttaaaccggcttaaaattcagttgacgaaaggagtatggactatgataccatcagccatcaggggaaaaggtcaagcaacaataccagttcattaacacgataacacgaaacattacataacatcgaaaatgcagaggaagcacgccatatttacagttgttccttcccatcagcaccgctacatatttacacggcctaaatacgtgccagcccttcaccactaggccatccatcagacccttcagcaccagggcgaccagacacaccgatacaagcaggactgacgtacagatcactcgagcttgttcttgtgggaatatgtacatttgtcctgctctaagcaggtggatatttacatgtggacacatgtgcagctaccagattactcgggccgcacactgacgagattgggcagggcagccaactggagcttcttgatctcaatcgcggtcaccttgcaggactccagagacaaggacctcaggttctggagtggcttcagatggtggagcccagaattcgacacccgagagttcgacacgttcagggagaccaaggcagtgaggcctgtacacatggaagatatgcaaataaatagataaattgtgtgttgaatgctttcattcctgacgagcgcaaaagacatacgggaaatcagctctaaggatttgtcagtgaggttgccattttgagataggttaagcagcgtcagagctttgaggtctttgatattcttcactccagcatctgtaattaacccaccgcagacctcaagggactgtagattcttgaaatctgaagaatgcattagcaaacagatttaagtgctacgtgatattttgatgcataaaaataacgagaatcccccaaatttccaagggaataataatttcccagtaaaatatgcaccaagatgctgtcatattcaatgctaataatagcaggggttgagaaaaaaaaagttccacagaatgctaggttaataggatttgctttatgtgtgcacaatgataagctcggtgctacacaagtgcaaaaaggcccaacgtgccattatcttaactcttatagtaaactagcttgttccgataatccaaaatcaccagactagtaaacagaaccttagcatggaccaactttttatgtgcacacttacatttcaagcagtttgtcccagcatcagttatacgagctccaaatagatcaaggtgtgtcaacccagtgagacctgcattaaacaaatgtcacttcaaggcaaaatacaaccaaaggactacacaacgatacagaactggagaattcagacgataaccttgtagccaaattcttactcctactacaatgcacaacaatcaccatttgattaaagcgaaacatcaaaccttgagaggaaaggaacaccatcctaaacagacataaaaaagaccaacactctacatgccccaaaaaataacgtagcacccaatcatgccatatccaattaaattgctaaaatgggtaagataccatgtctaatgcataacaggaaacccaatcatgcacgccagtattaaacaatgtaattttaccaaaaatgaggacatacatgtaagagctgccaaaccattatctgtgatttggcgattatcaagattaagggatctgagtgaattcaggccagaaattttcttcaagccaatgtccgtaaccaatgtaaaagagagattgatgctctgcaaattccgtaggcctgaggagatatattagttgaagaactgttgtgagtaataactaaaaactgaaaccgcttgaactattcaaacatcatatattttttttaaaaaaaataaagtcaatggcactagcatttgtgcagaagattaaacaaaccagagagatgacgaagtccattgctcccaacttctgtgtctgaaagttccaagcttcttagtttcagaagtcctacagcacagagagatgtacaccaatgatttgagaccccaaaaaaaaagaatgtaaccagtaatacaaacaattaaaccaattaagaattccataaggaacaaagtatacttagtcaatgctaaactgacaattgcggactagtctggtacaaagcactaatactatatgccattaaacaaaagtaaactacgacttactgcatgaggcttattgtgtgattctccgccttcagtgttttatgaaatactagcaaaatgccagtattttaaagcccataaaaagttattcctattgtctaatatattgtcatcatgcaacttatgttgtcactttctagctttgtgcctgataagctagctgtagaaataggcaaagtcttatttcactgttggtgggtcccacactaccatctttcgtataagtatagacaagataacaggaaaaacaaagaaaagacatgacaactaagaaactcacctttcaaatgtgctagcccctcgtcaccaatcttgcatgagtccaagttcaaacactccaaattgatcagttctacaagaacagaagaacatcaggaaagctccccacttcatgtgttaattagcatatatagtatataatgatgtcagacttctgacatgtttccagaaaaatcaatacaatcaagtgggtacaccttccacttggtgcggcgtaaacatatatattgaacaaaaacaacatggcaaaagtgaaacaaaagcgtattctggtatgcatctagtctcatatcatcggcaattttaatgacagaaacaagagaatactggtatattaagaaaatataagtgttatttcttgagtaatagtgatcaaattctatggattttcacagcagtgctttaccaaatttcaggactcacttgtcacttagatcacagcgcttcaaatttggatgctagaatgctaatttttaaacattattctacattgatgtcaaatatcatatgaagataaataatgaagagtctatttaccttttagatgaaccaagcaggcatctgtaatatagttgaaccctaaattgagaaccttcaacttgacaagacctgcaaggcaagaccaccgacaacgctaagaagaagtgcaaccatgtatgatgaagaaacagaacttaatatggacagcttacacaacgagacataaagtggcatatgttcctatttgtagatcacaaaacatcttaactattgttgaaaaaaaatggtaggtgaactgactagacgtacactgagaattaaccaatttataactacttagtttgtcatctgcatacaaagggcataatttcctatttgtagacaaaaaacaatgcgctctgcaaataatagagaattgtgttcgccaaaaagtcaacgaccagaggttataatattaccttccaaatgctcacagccttcgtcatatactccacatctactaagattcaacaataccaatgaagccaatcctgtaataacatcactattaatgaaaacttttttgagaatacgcacaaaagccttgtgcatcttttgtattaagagaaagggagtttttaaaactttacaatcttccgctgaaaggaaaacaagcaaatgagaaagaaagaaaacacaaaaggcgtggggctatatctcgcaacaagtttggcaaccgtttagtgagcggtggctcagatgggcaggccagccacacgccagaccgctgcttcttcctccatggccgcgcttattaccccccccccccccccccccgcccgatttcctctcgttgttgaacaccttattgtttctattaatgaaaatatgatctcaccaaacagggagcttgttaagtgttcatgtaatcatgaaatagattacatcaaagagcagtacaccagagttgtcaaacatactgtacgctgagtacagagaaatatcttaggcaactaaagagttctataaaccagcattctaatcgctagctgcgcaacagtaatatggtaagcttacgcttcacagagaaatataggactgaaaaaagaagaagaaaatgtgcctcaagtcaacaatgaatttcctttgaaaataataaaatgaaattccattaccatctataagcaccaaaagtaataaaaaaatctctcatttacaagaagcagcataatagtcctatagtacttcctccgtttcacaatgtaagtcattctagcatttcccacattcatgttgatgttaatgaatctagataaatatatatgtctagattcattaacattaatatgaatatgggaaatgctaaaatgacttacattgtgaaacggagggagtagaagcaagacactctcaagttacctagccactttgtcattctcattcaacttgcaaagggaatttctaaaactttcatgtcaaatccaccagaagagatttctctggggataaatccatgaggtagttgactatatatagaatgagaaccaaaagaaatgtgtgaaatttcatgacatgcacttcttcaggtccctaaatatccatttttggtaatgaatttaatggattattctacatgagttctggcagatgtggcaccctttcaacagtcaaattaaattaccccaaggacttccctagaataaatgtaagacattttcatggaagcgtgaactgataacatagcactcgtatggaaaagatgcaaaacctgaaataacctccaaacaagcagcagttactgcacagccctccaggtttaggtgagctagcttcgatagacctgtaaagaacaaatacaaaatatgaaacagaggctaactttagatgaaacttcatgtcattatattaatagaaacaacgaattaatcagaatattacagatacaaatggatgtagctttaggtagataaggttccactggaaaaggaagaaatttatttctgggatacctcttagataagaaacaccaagatcacttattttgcagcaagaaagttgaagctctctcaaatttgtaagatctacaaggaaaagggtatttattagacgtgcagatcagtatgtgtgataacatacactgcttgacactagatggtcaacataaaggtgttacctgataaatgtttcatatcagaatctgtgatgccattacaatacctcaaatttagcttttccagttttctcaagcctgaaaaagaaagttattattggatctgacagaagtataattaaaatgtattcacgattgagtagcgtttgaacaaataggtagcatgccagtcttccctgtatttattacaaagaaagatatataaaagctctggatgataaatatatctctgtttcattggggtgtagggtgcggggaacacatggtaaatgataaaattagatcatgcatttataataaataagttggctgtggttacattgtgatgatatattaatgaaatagcaggaaaccttttaaatgaacaagtccaccatgaatcttcggacatcgctcaaggtccaagctacccaaattaaccatgtttgcaaaggctttagctccttcagcagtaacagcagaacattttttaaagctcagggatgtcacatttgagaggcctgcagaattaaaaagcaataccataaatgacaggaacagaatatctagtgatcaggaacattgacaccactcttatcatagagatggaagaaaactcaactctcaggctatcagaaaatcactaacctgacaatgttttaagtccatgctccgatatctgatcacagtaattgcatgacaaactttgcaagttgatgcaatccttgagttgattcagtccaccatcagtcacatcagagcaagagatatcaacagataacaatgattgcccttgagaagccgctacttccatccaagcatccctcaccccagggtagtctgccaaacagatgtcctgagaccaagtagaagaatagcataggaggtcaatatctagtctcagagtaacttatcccagaaacaagaaatactccaaatttggtcctttctttatgtggcacacaagtaaagcgattgcttggcttgcttgtagcaggaagatagaagcatcatctgagttacacagaataagatagcagctgtgcacgtgagctcaactggtctattagtatcagtacccagtggaggcttccttgagtggattttcctcaattgcttacaggataaattttaccaacacattttagtttactttcctgagttagcttataaaaataagctataaaatcgtttacaacatagtaagaattgttccaacaagatgcctttattcgttccctgatactacattgaaagttagaaactgctacaagggaatgtcaggattgcattccatagagtttgcaataattccatattgattttccttgtttagaattgagtcatttttttcgcgaacgtgtttagagctcagtcataattacgtgccaaacaagatcaagcacttcacctgcaatgcacaatcacgaaaagctccaagcaactcttcagtgagaatgttccactccaccagttcattaaatacctgctgactaagatctctaggcagcagcgagaaatcagaatacttcccaatatcctgaaatcacccctcatcaagtcaggcaacaatacacacagaaaactcaatcatccaaggccacaagcactacctcgcggactttggccacacagagctccattagcgatgggcaccgcacaggcactggtccctgcaccttcctgtgtacatcagagccgctgcggggcaaggtgtgcagtagccacttgaagctgctgctcttggagaaccttgcactgtagagatcttcctcatcaacaagcagctggcctcttttcctagagcaagcactttccatggcgacgatgcgagcaccgatcacaaaccaatcacttttcttgatggactaaaaagcgcatatcattctagctcgtgactgtgtgattctttgtcatccattcccagcacgattacgacttggcatagacttcgctctctttggccccattctgcacatcaaacaatcgtgtaaattgacttaaaattatcagattatatacagatactgccaaacaatactaaaccccacgagtcctcagtttttggtgggtgtgttcatctttcacgcaacctaggctcttacaataattacggattgctgccaatcctaagtgcaatccaggaaaactaacagatgacactagctcaagaaaaatgaaccatgtcttacgaatcaaagcatcaaccctatctacgtattatcaaatcccccaaacccctaatagttcagtcactgtaccctactttcgattgttccacaccctgttctgcaaatcactccatcaagggagaagaaaccgtaaaattaaaaaaaatgcccaaaattccaacccagaataacacataagcatcgagagagtacgagttgggcagatcaacacgacaaccaaccaacccacccacccaataaaatcgcaacagaattacacagaatacggtggtggagaattacccgattggatatggaaattctcacagggacgcaaatccaccaaaccctaggccaagcaaactcccggattagagttaaaccaatctatcgcgattaaattacctctaatcacacagccaatcctcgccgagaaagagagaggggggaggagagggactcgagaaggggaaggaaaggtggagaagaaatggtttatagcgagagatggagcaacgtgggagctccacgtgtcgccccggaggcccgagctggtacgcctgccccgcagactctgtcactgacatgtggggtaggggtaaaggtggccaacgttgtcagtgggtggagtgggtaagaaggttggtggcgctgtgggggttggggggatgggggccacaggggagtggaagggataaggcaaaagagtaccgggcgggcgctcggcatcccccggattgtgctgccggttttgtgggcccgcgactgttggtccgttctgcggcctacacgtgggccccgcggttttacttctactggtggttgattaataagtggttgttactccggtttaagggcggttcagattgacgttattttcgatcatattatttttttaaagttgctaaaaaaatatcttagtttgtgctaaacttggtaaatatataagaaattttgctaaaattttagcaatattactaatttgccataaattagtaaggtttatttttgcaacaatttgaacaggctttagctgggaaggagtggtcttgtaatacaagttaagagttgttactatgggctggtttggtttgtggtctaaattggccttaccaatttttatcaatgtcaaattttgtcaacttttggcatggctaattttggcaaaggtaaaattgtgtttggattgaaaccaaaatagcctaaattaactgttgaaatggcctattttcttaggcatgccaaaatttggctccaaaccaaatagacaataaacactattgaaattgacaaatattggtaaggccaatttaggcctcaaaccaagccagctctatattaggagagattatattagaagaggtcgcatacccatctagattgaggtcgtgtttagttcaccctcaactaccccaaactttcaactttacatcacatccaaaactttcttacacacataaactttcaacttttttttttccaaacgttcaactttccccaaactttcaacttttttcaggaactaaacaaagcctgagtaattttgggatggagggagtatgtctgaaaataactttattcttattttcctttttaccactggtttgtatttttctattactttagtgctctttaccaatcccttgcctcttacctattcaccattaatcctatcattttattaatatatgcttgcttcgttcataaagaactaagtataatatgtgacgcatcctattaattaagaaagggagactaccttatcgaggacggtattgtttctcggagtaaaagaaagctagtctcggggaaggtatggttgcttggagtaaaagaaatatagtagcaaaggatagttggttttgtgcgaagaaatagtgttttctattttcaagtgagagaaggactaccttaccttggatatgttaggatttctcttagggtgtgtttagttcacgttaaaattagaaatttaattgaaattggaacgatgtgacggaaaagttggaagtttatgtgtgtacgaaagttttcatgtaatagaaaagttggaagtttgaagaaaaaattgggaactaaaccaggcctgagtaaaaaaaaaaaagcacggtgctacgaggagtggccttgtttagttcccaaaaactttttcccaaaaatatcacatcgaatatttggacacatgcatagagtattaaatatagataaaatgaaaaactgattgtatagtttatatggaaatcgcgagacgaatcttttgaacctaattagtccatgattagccacaagtgctacggtaacccacatgtgctaatgatggattaattaggcttaataaattcgtctcgcagtttctagacgagttatgaaattagttttttcattcgtgtccggaaaccctttccgatatccggtcaaacgttcgatgtgacactcaaaaattttcttttcgcgaactaaacaaggccttagagtcacacccaaaatcgaaatgaagctattttgggatagagggagtaaataaactccatagatgttgcctcttatttcggggtattttggtttagggtagtgctaaaacttttggtagttttccggacgtgtttatagagaatgagcgtgtgcttataaaggtgagtgagagcatgtgtgtgtatgactatttgtacttatactatgttttgaaaagaaaaacagtggtgttaaatcttaaataagtttttgcattatcaatatttttggtatggtggagtagctttactcgaattgattgacaacttttgatatcatgcttgtttactttattgccaacaaagtaaaactgatcatttgtgagtaagacgtaagccaaagattggtaatgctattgttaaggacgtatctacaacgagaccgttctctatatagtcataaccaactaactcaatctcatatctaattgctactagtatactcaaaagtgcatgtatttttttttcttatgaaattttctcttagattagtcatccgatttacgatccaattacaccattatgttcataacaattaaatctttataacaagatctcacatgactatatttttatgaaaaaatacaaattacttttataatatatgtaaattacttttagattacattaaattacttcttagtcataaaagtaatttacctatatatagaagtaacttaaaaaaagtaaagtaacttgttacgacattaaaagaaatatatacattcataatgttattcataatattgtgagttgtttgttttacaatcatttttagtcagtgacgtaatttgtgccggttaaatttaatttctatatagactcatgtttttacctccataacggatttaattttgatgtcgtgataaagttactttctttctgttttaagttacttttataatttatgtaaattacttttagactttactaaatttactataatatgtctaagtagtaatttaatgaaatccaaaagtaatttagatatattataaaagtaatttataatttttcatcaaaatataatcatgtgagatcttgttataaagatttaattattacgaacacaatcacgtaatcggatcatagatcggataagttatttaagagaaaatttaatttgaagtataagtggttcctatttgcttgaaacataggggataaactactctctctctctctagcgtagtagagtgcgtcacatgctttccgatttggtctgttctggccttcttggcaatatcggcatgtggaacagatcagacgactacaccagcgtgtgggatcggacggtcctagatgcgtcgcgtgataagaccagatcgagaggcctctcgacttagattttatgtattgttaagttccgacaaggttaaaaaagtaaattaaaggtggtgttgagtcttatatcttattaaattttggtgtagtttcgagagtaaaaagggtatggaattaccaaattttgattgaggttaataacgttgcaatagtaaaatctcttgggtgtgttctcaacttcttctctctcgttttcacacatagcttcctaaactgctaaatgacgtgttttatttaaaaaaatatattaattcatttttatatacaagagagaagttcgtaactttgtatcccgaacacaattagacaatggagcgaacaagcacatcaatccaaaatgtagaccattctattaatgctattatattttaggaatgttggattcaaaccaaatagccttcaccgttgacccagtcgggaacccaatagcacacaaccaccatcaacgtatatacggtatattcgacccgtcatcatgataaaagagatcattagtctggcatttacgtaagtattttttattagaggaagtaacatacattggtggagaaaccatctttggtcggtcaaccaaaattcataatagtcccggttccactaaaaactgaaactaaagatgatctttagtcccggttccactaaaaaccgggactaaagatcgtatgttgtcaggggctgtcaggccctcccgtgatctttactcccgattggtaacggtgatctttactcccggttggtgttaccaactgggactaaagttaggatttttagtcccggttaccaccggtaaaacaaaacctctatccacgcgcacatgcaaagtctcctattaattccatcattatctctcctctcccatccagccatctccatcttatcttcttctctcttcctctcctcctatccttctcttccttcttttctcaccccatctcctcctcccctctctcctccccctcctcccctccggcgggcggtgggatggaggccgccgccggcggcccgacgcagggcggcgagatggaggcggcggcggccggcgccggtcgggaagcggcggctggctgcgtcgggcgcgagacggcgagatggggccggttgagagggcggcggccggctgcgttgggggtggccggcgccggtcgggagggcggcggtcggcgctggtcgggatggcggcggccgacgctggtcaggaggcggcggcaggagaacttttttttctcttctctgtgctatctgatgaatgctgaagatattgtagatgtgaactttctttttcctttctttgttctctgtgatgaatgctctctgtgatgagatgttgtagatctgaacaagtgtaaacaatatggatgctttgttgtttgattttattcattcgatctatgatttaggctttgtcgttgattttattcattcgatccacgagcgaaagctaaagaacaataaaaaaggaaaaaggccaatcggatgaaaggaaaaggaaaaaaaaaaaccaaaactttttagtcccggttggtaacaacaaccgggaccatatttttagtcctggttggtagactaaaaatcaatctttagtctcggttatttgaaccgggactaaagatcgcacactaaccgggactaaaaatcaatctttagtctcggttatttgaaccgggactaaagattgcgatctttagtcccggattcgtagtcccggttgaaaaatcgggactacaaatgattaccaatcgggacaacaaagcgtttctccaccagtgatagaccatgcttacatttgtcatacgttccatcataatctactaacgaattaacggagaaaacacaactatcagtaaaccaatttatagtgttttggcacaatttgattttcttctcgatgcaagggttagatacagatttgaatcaatatttatatattactaactttttaaataacgttttaccatttatcttatttaaaaaattagtgtaaatttgctaaactataagtagtacttaaattttctataatgataaaagatatcacaacaaaataagtaatattatataaaatattttaataaaatgaatgataaataaagttaacgatattatctattaaaaatggtaggagcagtacttgggccctgatcttttctaaccctaaacttcaatttcctcccttttgtttttcatgtttcttaaacggtttaattgatgtgtttttaaaaatattatatagaagttgtttaaaaaattaaattaatttattttaaaatttataatagttaatacttaaggtttacgcatgtagaaaattttccttatatttaaagcaacgaacggggcttaagaagacaagaacctccatgccattatttgttgaagaatttcccaataactttcagaggaaaacaaaaacgatgaaatttcccatttttcacgcttttctaggtgatgactgatgagtagtgcagagcacctgaacggaaatctcccccatatggtccggtcccgatcatctttctgaagactgtaggcgctgccgctgacccggacggcgcggtctccggcggtcgattcgccgccacgcaacgcaaccctccctccctccctccgccgccggtcaaacctccgccccgccgccccccacccgagcagcggctcacgcacacacatcctcctcaccaacccacccgcaccgccgctgacgcgtgggcccccgagcccacctgccagcagaggccggtggcgccaacgatatactagtataaaatatattcagctcgtcggcgtcgtcgtttaccagtcgcctcgcctctcggcgtcccggtcgtcggtctccgctgcctctctctcttctctcttgccctactctactactactaccagcagcacacggtttccgtgaccggagcgcgcagcagccgcccacctaaaggctaaagatccgatcaaatcgaagagacttaatataccttctttttttttcttgagaggaatatttttttttcgctttaccatttcttcgtccctgggggattttcggggggattctgaggagcaagaagcattcggccgcggcgggggtccggcgctaagctcgagagattcttctccggtgagtccttttgctttcttggagctctatcctgacgcgtggtgtttctgtggtggtttggtgtaatcgttattgcttgtttacgcggttagattgcttcatctaaaacaaggatggttttcttgcttgatggtgtggatggcaaaccgtaggaggtttgtcgcatcaccgatcgcagatgattctaccgttgtgttcttgggacatcgccatgggagcctctgtggtagtactagctttcttgatggttaccctgtgccgtcttgtatgcatttttctataatggacagtcacctcgcgttaagattgcgtgttagactttctgaagctctaattttgctataatagcgaggggaagaggggaatacctcgtttggtgctgttctccatttgcgggatagctcaaagtcaactctcagtcaactcatttctttgcctgctttctgtacacatgtgttcgtctatgttataatgatttggttgttcaacaagttcattaattgggaccttatcggtggtgatgtgtgtagtaggagtgctatgcgtactacatagcacgattttgcttttgtaatctgcattcttgttgcatgcattgctcagttgctcaacaagatactcgctataaatatgtagaggtcaaagactggcacttaaaatgcattgtgcaaggcatacgccaaaaggaagtctacctatggtttgggagataattcattcatacaaagtgtaactaatattgcaaaatagcatggatgtctagaaccgaattattcttctactagatggtaaattgttgttccactcattatgaatcttctgattacacgtggagaagctgagagttctcctttcttgattgatcggtgcatattttggtgacaaatatgtctatttctgctattcattttgtactaatgtactacccgggactcatgttatcgctcctcgtatatcttttagtggcattctttccaaaatgctaaactgaatgcttcgatctttttgcagtttggattgcacttgtcagagtaaaagggcttaggacactatgctaatttaagacatctcatccaaatgaggcgcaccacacttctttgttggcaaactgaaatcagatagcattctggtagccactaaacctacagggatgtttcttgtgtgttttgaagccatgtgcccctgttttggttcaagaaggaaggatgggagcgaagaccctgttcttggaagggatggaaattcctgtaagttaaatagcaagctttcatctattggtgatctaatctgttaacacaatgaaacaatgtagatgtcacgtttggaagtataaatgaccatcatgaattgtgacacattccttcatccttgtttttccagtgaattcttctgagctgaggtcaatgtctgatagagttcctccaagccctcttcgagtacctgcaagtccatctagattttcattgtcttcatcaccaagtagaaatgagccattgaacctgagtcttgaacaagttattaaactgacacataactttgcaccagacctgatgattggtgaaggttattttggaaaggtctacagagcacagctgcgagatggccacattgtggcaattaaaagggcaaaaatggtaggttttattttttatttttatttttttaataaaaagcagtgttggcgcaatgatagtggctgtcaacaagcagctatactagagatttctctatttagaatgactgaggtgttttttttcaagtagtctcgctggttgatccatttttgtgtagatcagtacggtaatgaaacagtaatgcactggtaaagcatgtactcacattgcattctttgcaccagtagttgtggatagttattataatttggtgtttttcaccgcttgatcttgttggtcactagtcaaatttcttttgcaatttatatttattcaaaaggtcctgataaagtattaaagttgctgatagaaactctgcttcctacatgtgatttttcttacaagtgaatcgcagttttcatccggtttctttatgcaggaacattttgcctctttacgggccgaattcagtaatgaaattgcattactaaaaaaaattgaacacaggaatttggtccaattacttggttatatcgacaaaagaaatgaacgaatcgtcataactgagtatgttccaaacggcactcttagggagcatctagatggtaaactgcatactaagattctcttttgttgaattccatatagaacaatcagtaattttcaaattatctttcaggtcaacgtgggcttgttttaagctttaatcagcggcttgaaatagctatagatgttgctcatgggttaacttatctgcatctatatgcaggtatgctttgtcacatgtttctgttgctgagcataaaaacagtttaaaaaaacaactgactgttatttttatttttattttcataccaagtcatgcatcggggtattgtcactaagtaatgcaagaactgtaaaccagtattttaactatattttccccctctaaaggttggtccattggctcataatctgctaataaatgctagtatcagatatcctgactgtaatgttctgtagttcggaaattgtttgtggctgtgcatcaataaaggttgtgaaatgagcctaacaaccaagttgaataaaccatgaaaattagccatgtaatcagatgtgtatctgattttaattctttgatcttcaagctttaaagtagcttacagagattctagtttgactattcctattggcaatttgcatatgtattttatttatttgttctgtacttttatgcttttagagaagcccataatacacagggatgtgaagtcatcaaacattctactaaatgaaggcttcagggccaaagtggccgactttggatttgcaaggactggtcctacagagccagaccagtcacagattcagactgatgtgagaggaacagctggctatgtagatccagagtatctcaggacaaaccatctgacagtcaagagtgatgtattctcttatggagttttgctcctggaaattctttctggtcgtcgtcctattgaggtcaggagagctgcaagagaaaggatcaccgtgagatgggtatgtcttcacttccctactttgtgtttacattggtttagacttttgtttctttccattgttttttctagataactatttaggagcaatttacctttgttctggttattttcttgcccccctgacccctcttgcccctgcatacgctcttgcttttctttctcgagcagttatctgcacatgaattcattttctttgtcgacaatttgcaatcccatcacaagttaaaccatacaacatgtaaacttccagtgnnnnnnnnnnnnnnnnnnnnnnnnnnnnnnnnnnnnnnnnnnnnnn

SEQ ID NO: 499 - DNA, 521 bp, Oryza sativa
acagtagttcatcaaactcaaagaaagaatgaaaaatttccaggtaactttctagcttattgtccatcttctatgagaaaacaaattgaagagcttgcagtacagtaatccacatttcatacagaatctaagacaaattattcaagatgagtaccgacaaggcgttgcgaggatggttttcacaggtaaggagttcttttttcaagtcgttttacgttctttctgataaatatttccttcgttctagaatgtaaggagttttggtttgtcttggagtagtttgacttagaacaaatccaaaacaacttttattctgaaacggagagagtataatttacttcaagctattctatcacatgcttcttgataaacctgaatcttgaacagtcactggagagcagccttctgatcaggtgaggacagtagtgctactacgcttggtgttgagagatgctttctcctctgatctcattgtggtgaaaaaaaaaaaaaacatgactaggtgattgaccacctgattg

SEQ ID NO: 500 - DNA, 365 bp, Oryza sativa
cgtgcgcgttccatcgccgcctcgagccttgccgctgccgcgccgcgagcccgcgccgcgccacgccgcgtcgtcctatcgttgctgtcacgccgtgccgtcgtgtcgccgcccatcgcatcccgccccgagccgcgcgccaccgctgtcgccgtcgccatcgacgtcccgtcgccgcgcgcgtcccatcgtcactgccgcgccgcgcgccgtctcgtcgcctcgcgccgcgagcccgccgcctcgcgccccgtgccgcgctgctcccccgagccccgtgccgccgctgctaccgcgccgcgccgcccgttccatcgcctcgcgccgtcgccgttcggccgtcgcgtcaccgctgccgctcctcg

SEQ ID NO: 501 - DNA, 6198 bp, Oryza sativa
cattgcactcgctcccgctttcccatggcccctctactccctggagcccctcctctcccctatgttcccttcctcttgagcgttcaaggaaaacaaaaaacttatgtccgtgaacacgttttgatgtactcacccggctgtgttcaccacaagagatcgtcgttgccgtttctctctctatgggaccatgccgttgctggtcgtgttcccgttgttctggttttcttcgttgccgatcaccatctatggataagtcacattgtgggacatgtctagctaccttactcaccgccgtttgattactggagcaccgtcgcccaccttccctcctcatatgttttttttgtttcgggtagggaagacaataaactatgttagtcgttgtttctctctctttcgttcttcctgcgtgttcaaggaaaaaggaatcccctcatccggtaacgcgttttgatgtatactcctccggtcatgttcatcaacagtgcttgccattgtcatttctctctctatcgggacacgttgttgcaggcctattcttgatgttctggttttcttcgttgccaacctctaccatctatggacaagtcacatcgtaggacacgtatcaccttcctcaccgccgtttggacgacagagcaccggcacacatcttccctcttttttattatggatcaaagtagctgacgcggtctataattttcagtggacacactataaatatgggctaactgtattatatatcagccgcgatgtgtgccaaactagagtaatatatagttggccataaggcccgaggcccgaaggcccggcccacggcacgcctttttggcccggcccaagcacggcacggcccgacttgggtcgggcccgtgctggcccggcccgaccgtcgggccgtgcctgggcctccccaccggcacgctgggctggcccagcacggtcgggccggcccggcacgatgggccggcaggccaggcccggtacataaagtatggggactaaaaatagacatataaacgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggccgtgcctgggccgtgagggcggcacgtgggctggcacggcacggcccggtgcgtcggtcgggccgtgccggcccgacaagcctcggcccaggcacggccgggcctgggccgtgccgtgccgggcggcccacatggccaactatagagtaatatagtgtgtcggtcactgtgcaatggccattttgaccgttctaccgctggtcttggtgatgctgctgcttccgttggctgcaattgcatccggcgacccaccatggcagcactactgcggaagcagcggcaactacacggccgggagcaaataccaggccaacctgcaggccctcgccgcgaccctcccgtcgaccgcgtcgtcttcctcccccgcactcttcgccaaggacgccgccggcggcggcgacgccgagcccgacagggtgttcgccctgaccctctgcagaggcgacaccgcctccgccaacgcctcgtcgtcgtcgtgcgccgactgcgcctcccgcgccttccgcgacgcgcagagcgtgtgcccctacagcaaggaggtggccgtctactacgacccctgcctcctctacttctccggcgacgacttcctctcctctccggccaacccggcccaggtgaggctctacgacgtcgatcgctccacccggcgtggcggcggcggcgccgacttcgtcaccctcgtgagggcgctcctgagctacacgatgcagtgggccgtgccgtacaattccacgggcggcggggccgccgccgtgaggtggtacaccacggtgcggatggacgtcgtcacgccgccgctgttctcgctgatgcagtgcacgccggacatgtccggcggcgactgccggcagtgcctgcaggacctcgtcggcaacaccaccttcaacggctcggtctccggcgtgcgcaacatcggcgcccgttgcggttacaggtacgacacgtacaagttctacggcggggagcccaagctgaagatcgggtcactgtcggagatcaactcaacggcgccatcgagcccaccgccgcctccgccggtgacggagacacgttccggtatgtttggacagtcaccttttatatatactatatatactaggtgaaactatagttggtcccggtcttgcccgggccaagatttgccgggccggcccatgtgctccacctgtggaccaggcacggcccaataagggtcgggccgtgccggaccagcccgaaggcacggatagtccattgtgctttctttgaaataagtttgtttcccctccctcctctttaggttgtgacatatatataactaaaacaagtctatttaatgtccctacactttgggccgtgccaaataatacgtctatttatcctccctattctttgtgccttgtcttataggtggtttaaaataagtttatttcacctccctaaagtttgtgccgtgccagtccggcccaccgtgccaaggcataggcccaggcatggcccaacaaccgggccgtgccggcacgggcccgacagcgatcaggccatgccgtgcctgggccgggctgtcgggccttatggccaactataggtgaaaccccgtgcgttgctgtagaagtatactacgataacgataagtaaaagtaacatgtgttataggtgctagttttagataatctatagatgccggtttaaaaaaatcagacagccacgagccgagccgaaccaagccaacgccccaccacacgataaaaattacgccgctgcccgtatccactcccctcgctcacaaccaaatggggtattgaagttatttcatcatgtgtaatgagaatataaaataaaattatgagcaatgtataattatttttggagatgagatttccttgcagggagaaagaaggtgttgacagttgctttgcttgtgccactgatagcactttgccctgtcgtcatattctgttttgcatggataaggagattaagaaaccgtgagttatagaaatcaacttatcaaatctttaaattgtaatataattattgtttctgagttctgacagactactcttgtgttattagccttttaataacgtatttgttgctttagacaaatcaatgttgcgaaaaaaggatacaatggccagagaagaagtattaaagctttggagactagaagaaagcgattcagagtttatgctatttgatttctctcagatagaagatgctactagcaacttctcggaagataagaaacttggagaaggaggttttggctccgtatacaaggtaaaataaattagatatatacacacacataaaaatcttcaatacatgtttacttgaagtatgaactacttgaactttgtttgaaaaaaaatgcagggccaattgcccaatgggcttgaggtagcagttaagcgacttgctgcacattcaagtcaaggcctggttgagttcaaaaatgaaattcaacttattgcaaagctacaacataccaatttagtaaaccttcgaggatgttgcattcaaggagaagagaacttactaatatatgaatacatgccaaacaagagtttagacttcttcatctttggtatgcttatacattgtttttcaaaaaatgtggttattttctatatatatagcatcaaataaatagtaacatatatccttatacttcactatgcagatctgaaaagagcagcattgctcaactggaaaacacgcctgaacataatagaaggaataacacaagggcttttgtatctccacaaacactcccggttatgcatcatacatagagacttaaaagcaagcaatattctactagaccgtgacatgaatcctaaaatctctgactttgggttagctaagatatttgactcaaatgatgtccaaagaaatacaaaaagggtggtgggcacttagtaagagttaattcacctttcaaatttgttatttagctagtccaagtgatttagggataagctcattttactccctcaactatctggtttgtcttaaaaaacactacttaactctaccaaaccgaacacatacacccctcaacgtacaacctaagggcaatataacccagttctaatggtggtttccatgattttgaaatccaaattcttttttttacttgtattttttaataatggaataacattctggcctttgctcaaaaagctacagctaattattacaattttttttacttatgtctcctagtttggatgatatgtgaatagtatttgaatgtgagtgaaaaaaaaacatatatttttcgatatcaaaatcatgaaaaccattattaaaaccaagctgtgtgttgaacccacatggtattttggttggttttgatagtatgtcgaggggtgtaaaatatccggttacatagttaaggggtgtcttttaagacaattccaacgtttgagggttgtactacagacttatctcttattatgattttggtggatccagactgaggtgttttaacatgtgcatgcattttgttttgatttcagtgggtatatggctcctgagtatgcatctgagggttgcttctcgctgaaatcggatgtctttagctttggagttctggttcttgagattattagtgggaaaagaaacgctgggtttcaccaatatggggacttcttcaacctccttggctatgtaagtttttttaaaaatttagtataagagactaatatattcattttaaagatacacaataatcgagcacactgctgggaatatgtatgaactacacggtttgtgcatgcatgagtgcaataatagttaaaattttatgatagtcggtcttcattttgaaaaattatagcatatgctttatgaaacccgccttaacttggctcatggctcaaaattctcattcactgaaattgcacacaatagctcatcacatcaaacttgttgcaggcatggcagctatggaaggatggaagttggcatgaacttgtagatccatcattagtaagtgaaggtcaaatgatggaaataaagaaatgtatgaaagttgcacttttatgtgttcaagagaatgcggttgatcgtcccaccatgtccgcagttgttaagatgctttcaagcgagttgaaaattctacctgagcccaaacaaccagcattctttaatgtaagggtgaaacatggagagctgtctaatactgcacctagtagcataaacgatgtaaccataacaattgtgaacggcaggtaatgccaatatatatagggactttaattaaaatggtaaaaacccacaggactatataccttgtacagaatgtaattattaaactgcagttatgttacgtagttctgtaacattattggaacggcagatatatatagttgaattacttttgacgaagtgtacaattcaaattaaataatacagtttttccttgtcctaacctttgccaaaattcaaaattatctttggctgtgcatgactttcaattcgctctgccgaaagataaaaggccaaactttactgcattcaagaacaaagaaactgaagcaaactcatcacataaaagatcagttcgttggtattaggacatagatttatgtggaaagctgattgagccaattaatgatttttcatatggacagtgccatcatccataaatatttgacaataagctactctctccgttttaggttatactccctccatctacttttgataggcatatttctaaatctaaaaaatttatttttgatagtcatatttcaatccaacaacctatcctcttaatgacttaattagatttaatgcgtgactctccattcttccatacaagattggctacatgagtatcgagaaatgtaaatattaatgaatcgcttgtttacgacgaataactagtagcatatttaaatgaatgataaatataattacttatccttggtctgtgtgccaagataaaatatgactatcaaaagtagatgga

SEQ ID NO: 502 - DNA, 24068 bp, Oryza sativa
ctctatctcccaaccccagagttcgagtatgcgtcaaatggtgtctactcggaggagtagacttcgtccgtgccgtcgagaatgcctgtggagtggtgttgcccgctgctatccaagtaagacttagtttcagtcatccctttaatttccgatgtatttatgtaaaactttttgtttgtaagacgtggatctgtatgtcaatattgtcgtttgtgtaccctggtctggcctgtcctggacaggggttttaatgcacattctggttggaattctattcgggaatttctgggcgtgacaataccctatctatatacacaaagacatgatattactagctagcactaaaaatctctaattaaaagatcttgtccactatgtcaaataggatactcttatgaatcaccggaatatttcaacgggaaatgttctaaagtttcactatcacaagccttagggaattcaaaccgaatacaatgtcttagagtaaagattccgatgaatcgcaacactgtcaacgcaaaaggctattaagtatcattattacacgcgtatagttcaacgcgataacgtctcaaagtatcactattacatgtcttaaggaattgaaatttcggtaacaacttccattgcactactgggtgcaccaagggtacttgcccttccttgccgcttccgaccccgcatcctttgcacgctgcgccctagccaactttcttgcctgatattcggcgcgttcttccttcttgtgtcttgccaacacccttagctccaactcttctctcctctccctctcagtcttctccattgcccatgctggcattggcgtttctcacgttcttcattccactcgcgccattgccaaatcatactcgtatggaactcatccatctccttgtcaatccactccacaaagtcacaaagaggaggagggatttaggtgcatatacattacatcacaaattatatcttcacgacaaagttgcatatattcaagatgaaacaatagaaaattaacaaatttaccttcactgccatctttgtctttccctcctttcccttaggcacatgcttaggtttctctgggctatatgcatagttgcggcacattcagtacctctggccataggtatcctagtcatgactatgctgaaaacaacactcatccccacaccaacacatagggcgctttacacctggtgctggcagctgctcaggggaatagctaacaacacccttccttaatatcctaaaattgcaaaaatgtttatcgctatatcaattgcaattaaccaacaactatacctacaaatttaacataagtcggttttttcatcaaaccatctattcaactccaaactacaaataagcattatcacatatatactagaacatatcctagaactaatctatcatgcaaccgaattggtctctcctccatataatatataggtacatattatatactcctcgattgataatacatcccgagccatattccccaaatcacggttagaaccaaatcaaccaaaatacaaagtaaaacattagggaaattagggtttttgaaggaggtcaaccttataactaaattctcaacaccgtatatgaatcgtccataccaacatgaagattgaactacaatattacattcttacccacattccttaattcacaccgcatctcgagccaaatttatcaatccatggtttcaaccaaaatacacaagagaaatgaaagcccggttgagcaaatttgggtttttcgagggggtttaccttacaaattgatgcccaatgcaatgcccacgaaatcttggggtggatttgggaatatttggggaagggaggagagaggacgaccgtgtggggatgaaccctagacaaggagagaggagaggaagagagtggatagcataggcttctgagtgttcagtcaaaaaaaggaaagacaagaccaagcaattctaacagccatcttacaatctttaagattaagaattggagtgtcttctggcaaataaccacatttatagagtgtcttaccccaaaagtgccttcctgcgatgtcttgtaacaaaaattgcctttttttaccctctcgcacgctatcatataaatctctgctacttaggcgttgtttagttcccaaaataaaaacttttcacccatcacatctaatgttttgacatatgcatggagtattaaatgtggaataaaaaaaccaattatacagtttgcgtgtaaattgcgagatgaatcttttaagcctaattacaccatgatttgacaatttggtcctatagtaaacatttgctaatgatggattaattaggcttactaaattcgtctcgcggtttcatggcagaatctgtaatttgttttgttattagactacatttaatacttcaaatgtgtgtctgtatatccgatgtgataaccaaacctaaaatttttccccaactaaacaagtccttaaaaaaatcagtaatggtgctcttgttttctggcacaacaaacgtatatgacaggcacgcgtaatatccaacggactggaccacaaacccatcgcgtaatgcacccatcaccatctccacagagatcgcgcattgcgcggacggtttcatcctccgtaaatgactcctccgcctagggccggtccggagatttgggaggccctaggcgaacttgacactataggcccataaggagttctataaaacgcatataccatatagtgacacaaataaatatttctaacatggtaaacaataaatcaagcagtttgatatagcaatttattctcgataaataatatcgatggtataattgacaacaaaaataacaccatagaaacaaagtagtatgaatagcttaataggagaccacagatatcctatatcccttataaaaagagtttcttcgcgcatttctcgaagcgaaatcattaatgaaagtttggagatcaatgctctctaagatattcttctcaatgctgcacatagccaagccgttctgagcacccgaaaataaaattttaacattgtaacaccagaaatagtaaaattgcaaagtaaattatacaacaataaccataaaaattatagcctaaataatctaacttttggagtgggaaaatcatgcaatgatgcaaagcaagaaaatcctaagtccataagtaataagttgctaacctaaatttcttagaaaaatcgaagaaataacacaagaacaaaaaacaccttagttttcctaggacttagggctaaaagagaatggagagtggagatgggaagaggcgtgaggcgtcagcgattagaggccggcccgacgtgccggcagccagccggccaggcgcccgccgcctgacaactcggtgaggcggcgaagtgcttgtgcctccccggtctgctctgcgcggagggaatatcagagaggagtagacgtgtcgtgtcgcggttaggttgtgcagtcaggagtcgcgcaagactcacgaaaaaaaaggagaaacaaagcggaggagacgcgcgtcgcggcctggcagcgccctcactcctggcctagcaacgcaaccgcgcctccctccttcctaggctgcgcttgctcactgggctaggctgcccgcagggggaggggggaaggggtggtaatcacgccctgtcagccttaaccctaggcggtcgcacaaccgacctaggcccagggctggccctacctccgcccactcgtcgccgccacccgcaaccaccaccatcgtcccccgccgcgcactccactctagatccccccactgagccgattcctactactcctcaccaccgacatctactccttcacccacccgccacgcgcattgcccacttgcaaactcaactccaccgcccctcccgcatccccccatcccaccacctcctccgccgtgctaccgacggcccctccacagcgccgctgacggctccaggtcatcctcgtcgtcgtcacacggtcccggccagctcctccaccacgccgccgttggcccatccacaagatacggagataccagctcggcaaccaagccattatggcccagccaccagagccagcctgcccaaccgaccaagcaggtcaggccgtctttcccccaatttcccgccagcccaccaaaccgagccgcccaagcctacagccttttgcgttttacctgctcgacctcgtgtcgcgcgcacctgcccggcgacctagctcacgagccccggccaccgtcgcgtccgctccatcaccagctagctaaggctgtgctcggaagagcctcttcccaacttccctctcgcattttccacactcactctttttaaactgttaaacagtgtgccgcgcactgtacttcgctgcacctgagattgagccaagcccagagtggaaacacgagtacaccggaagcgcagccgctcggtcgaacaaatccactgccaacctaggaggggcaccaagatcccacaaggccaccaacctgttcgctgcgccggtgcgcatcgacaattactctatgtgtgccataacgtaagtcacttcgactttttttaattatttttttaagtttaattaagtttatagtaaaaacacaatagtatttcacccaaaaaaacacaatagtatttacaacacaaaataaatatattatcaacatatattcaatgttggatttaatataactaatttgacgttagagatgttgctaattttttttataaacttgacaacttaaatatgtttaaaaaaaatcaaaacaacttataatataaaacagatgaaatggagagagtattatagaagaaacatgtttcattttaggggtcatccttttttctcgttttagataaaaccaaatagatcaaaagttgtcaagggggtaacttatattgaaatcaaataatgaggctggaaaacgtttgttgaagttgagtttaattgaacagggttgaaagcggttctttattgggttaattggatccatgccattacaattgtgtcaaattagagaaatgccattacaaatcgcctatttcgaagcgtgccatccatatacgcgcagaatagtctccatgccatgccgtacgacgtaggctcgctttgactcattttgaccggtgtgtagttccgtatggtcgcaaatgcccctgcatacatggttacatcggcgacttggttgggctcgaccacgagaaaccactcctccgctgtccccaaaccattctatcgacggcggcataaaccctagccagcggtggcggcggcggcgacggtgagtccctcggcatctctgggcgaccgtgggagtgactgcgatggacgcccaatcgagaaccctttctcggtcgagcaggtgtagagaggagcggtcccgggcagcagcgtgcgacatccccgagctgaagtgtgcttgcgggtggccggcagcttcaggcacatcgacgactgtcaggaatcctggccggcgatggctgcaatgcggcggagaggtgaatctttggccacgacaaattttgagttgcatttctttgatttctttcccaatcccctttccttccctttcaagcagcagggtgcacgatgctatttatggatctgggaggatctcctcagggagtatgtcgaggagatagtggcatactgccacgccggcgagtttgatagcctatgggagacatgtgacgagttgcggtggcagttgttagatgtgcagggtcgcaacatcgagttgtgtagtatcttggaagcaaaagaggcgcaattgcagctctatagagatgagttgaatcagtcaaagagggaggttgcagagatgaagcacaagatggaatcagagaaggccatgctccaatgggttctgtatatgctaatgtttatctgtgttctttgtgtgtcagtagttgtagggaagaactatcttggatagttaattactgtgaatgtgcaatatgtaattgtaaatgacttgtgtaatgaatcctagtttcagtttgagcaaatgtgagtaattgtgcatttgtaattggcccgtgcatttgtagttgtagatttttagcaaatgtgagcaaagctgataaaatgggacttatgagacatgattttcatacatgattttcagcagcatatgtgagcaaacatgattttcatgtccaaatttcagttcaactaaaaactatcaaaacttggcaatgtgagaatgttagcagtaaaacaacaaatttgctggtattttctgggttttccagtagagaaacacaaatttatctaatttccagcagaccaacacaaatcacatatgtcgagcaagttcatgaatataaggtcatatatggaccaacacaaatttatctaatggcacatgtaaggagcaatttcattcattacatatctggtatttcaagcgaatcgacacaaatctgagaatgtcacatatatggagcaaattcattcatcattgcagccaacttcacattcatcattgcagccaaactcagaatacataataagcaggtcttagtgccatttcagtactacatcacaaaataaacaggtctgccagtcatcacaacataggtgtgtcttaggcattacatcacataatatattacaaaagggaacccacttctgtgatgctaacttacacaggcattcacatcacaaataccagcagttcttgggacatcatatattacaaaagaaatcccagtaatcagctaggtgaacatcaagctgggttggttggttgagacccttcaaaccaatctgatagccttctaggagcagttcttggtggagcactggaagaagcaagaactctcctcttttgtggtgttcgcttcttctttggagtttcatgtttcttcttatttggtgctgatgagctagcttcagcattcacattagatggcctcctcctgcaagtgaaaagaagaaacatgattcaacaatagttaaaagtactgaagtcatggatcaaatcagagatcaaaatggaagggttcagtacataccttttcctgggtgtttcttcagtagccatgtcatcttcacatagtggttcagccagtttgcatgttttctcaaagtgctcaaactggttgcatctcttgcatttcaccttctttctcccaggctcaagacagccccttatcctttgcactctaggcctgccagctcctcttcttagtcttggaggatgcactttgaactcaagatcaactgaaggccattgtgacctatcagtcatgggttgaatcctccctgcataagctgctctaaagtactggacactgtaatatggatgcacaaagtcctgaatcttgcccctgttgctgcatatccaagccaatgcatgcttgcaaggttttccagtgacctgccataccctacaagaacaattttggttgtccaagtccacaatgtgcctctgggtgctgttatcactctcaaccattgtgacttcagcaaacccatggtcacttctggccaccttaaccaccttcaaattactagttgcagtgtttagctccttcatgacacttggcaggatttcatcatccatcttgctggcacaatctcttctaagtgcaaatttctccatgatcatttctctgatggaatcaaccaactcatgtaagagcaaaccttttaagcccttgatctggttgttgaaactctctgaaacattatttgtcaggtaatcacacttgctaagttctgaaaatccacatctataccaaatccttgagtggtgtttctctaggaactctattgcatcaggcctgacatcccatatatgcttcaaatgccactgaaacttatcctcagtatagcatctagcagctggatacagatgatcagtgaacactggcccttggtacttcttcatgaaattagcatagagatgcctcatgcattctctatgctctaccttcttgaaagccttacatgctttgtctaaacccttacatgcatctgtagaaataactaaaccctctgtgtctcctatggccttatttagttgttgcataaaccaaagccaattatcatctgtttctgagtcaaacacagcatatgctacataatacaaccagttatgtccatctacagcagtggctgaagctagctgtccagtgtatttaccagttaatctagttgcatctacacctatgtaaggtctacatccagccaaaaatccatctatgcaaggtttcaatgcaacaaaaattctcttaaagcacatcttcttgcctactttctgcaactcaatctctacaattgtacctggtgacttgttctgcagtgcagcctttcagttgaaaagaagcttgaagctttcttcatatgtaccatggatctggtcaattgccttcttcataccagaccatgctttggagtatttcagcttgatctcgtatttttcttcaagcttcttcctacaatcagttggtcccttgccaggattggtcttgagccaatcatgtagcctgtttgcacaccagccttgagtagccatcttcccttcatgtagctttgtagaagaacaagtgtgctcaaatggaagaaccttaatctgcatgacaagtagtgcaacacataagtaaacatcatctgaacaagaaaacaaaggaaatttgtgaagaattcacctttgcagtcttcttatcctcaatcagagatgcatgtatatatgccaagggcaaccatcagctgcacattttgcaataaaccttgtaggatctggcttcaccgaacctttagcaaattcaaaacctttcacgatggcataatgccttacagcttttctgagagctatcatgtcagggaacaaagcatctttgacaatgtttggattctcagggtcatgaatgatgttataaatctgaggatcatgatctgtaatctgtgcctcaggagctgccatagcactagcactagcaccattctctccactctgagcagtagctgcagccccctgaggttcagatccaggttgaccttgctgtttagatgcaggaacatatatgtgctcatcatcaacaccaatatactcctcttcattgtcaaagatatctgcctctctaacttctgcttcctctgttgtaggatggtcagaacctccaacagtagggatgtcagcagggatttcatgagggatgtcagcagggaattgaggagggatttcaggatggatttcagcagggatttcaggaggcaccacacatataggatttaaagcatttatagcaaatggcacaccctttgcagcatccaggatggatacaataagctcaaagtggctctcttctacatacatttcaaacaactctggaatctggccatcctccaacagtctcacatcctcaccaattaacttatgaaaataccatatggcaggagactaatttgggcaacaagttaactcaacacttaggctactcaacacaaactcaatgttaaagctatctgattccacaacccattgatgagttgacccttttgtgtaaattttcctaccagcagcatctattgtcacatagccttgaaccctaacgtctaccgaaaaccagttcctaccaaacaaatcaccacacatgaagaataatgcaagccaaagatgcatgatgcagaaaaaagatgctttgcctcccaacattacagctttcaattgatttagggttagggatactcacggcctcgaacagattgttggattggatttgcctacatccatctcctcgccatctcgcccaggggtccgcgggggggtggttgtcgccatcacacttcctctgccaaggcctactagcggcgcatctctcccgcttgaatcctcgccttcaccgccgccacaaatgccgccgccagccagatctggagcgcgaatagggaggaatggagtggggaatggatggggctagggtttcgactgggaatagagtgagcaagccaacgggtcgagctgaaacaggccagatttagagcgtgtctgaaaggggcatttctgtccatacggatatacgtatccgatactacgcgtccaaacacgggagacgaccaaattatggcatggatcaagattcacatcaatacggatggcacgcttcgaaataggtgatttgtaatggaatttctctaatttgacacaattgtaatggcatggatccaattaacccttctttatttgccattaatcatatatagggttaaaccggttaatccaggaacttggcacgacgacaagcggaaaggcagttgcaggaatgaaggatgaagggtagctagcagcctaggaaaaagaattgcgaatatacttattatttttaataactttacgtatatacttgcacggtaagactttgcataaatatatctatcccacagggtgaaaacacgagaccgaatgtatgccgcaacgcaaaatcgcggaaccaacggtctcgcgggatggtcgcgcggcaccggccgtggcatgcgtagggtgggcatatataatgctgtttgacactgtttagcacaatagagacaccgactttgctactgttcacagagctggttccgtgcaatggaattgcgggaccgtgttggtgtcacgtttttgagccacgggaccgtctcggtgccgtgcgctaccgttggccaccacggtggcgcgtttttgagccgggggaccgccgcggtgtcgcgcgacaattctacagtaccgcgtgaccatcccgtgtgatcgtcggtcccgtgttttttgctgcaactaacatttagtctctcgtccttaccccgtgggacgggtatatttatgaaaattcttcccgtgcaggtatataaacataaattattaaaaaataagtatattcataatttttttagaagcctagcacccattgaagacagttggaaatgatttacattctcatcagttcataattcgcaaagtataacacgaacaacttgttttttcctggttttcttgctaagacgattgtgagctcaaacgagtcgagttggcccattatcgacgatacaacaagtgagggatgaaaatgggacaaaaggaaaattgaggtgaaacgcaaacaatgaaagaattgaatttgtaaattttgttagagaaaagagggaactatgaccaattgactgcacacggtggcatgtcagtgccacaacaacaatactatagttgggaaagtgtttttctttaaaatatcatcactcggagattgaatagctcgagttaagcttgtatgaactgtccatcatgctgattgctgagctccttgatgaacccgacgagccgctcgaactccgccgccgacgagccgccatcggcgacgtcctgcctcacctcgcgcgccagcgcctgcgccgacgccctgatctcgccggactccatcgcctccctcaccatcctctccacgacggcggcgtcgcacacgtccttcatgtccagccccgtcccccacacggcgccgacgaaccggctgttgatctgctggtcggcgaagaacggccagcacaccgtcggcacgccctcgccggcggcctccagcgtcgagttccacccggcgtgcgtcaggaagcaccccacggcgcggtggcgcagcacgtcccgctgcggcgcccaccccacgacgcgcgccttgttgttcttctccgccgccgcgacggcttcgcggagggcgccggcgctctgactcgccccgaccatgtccggccggagcacccagaggaatgggtagccggcggcgacgagcccgtggaggaactccgtgaactgctccagcgagatgacggcgaagctgcctaggctcacgtacacgactgatcggtccggctgcccgtcgagccacgccacgcagccgtcgtccgcgcgccacaggctgcccgcggccgccggcaccgggaacatggcgtggagagggccgatggcgaagacgtcgcgcatgcgcggcgcgacgtgcgcgagcgctggcccctccatggacgcggccgtgttgagcacgaccgcccgcgccccgcggctgtgcgcggtgacctcgatgagcatctgcacgatggggtcgttctggtcctcggtgcagttccggaagttgccaggaagatctcgccggcgcaggaagctctccatgcccggaacgccgcgcaccggctcgtcgaggtcgccgtcggccgggaacaggacgacctcaccgagctcgaacagcctgtcgactgacaagtaggccagtacgctgcacgcgctggccgtgcggaagaccagcgacgggacgccgatctcctcggcgacgtcggcggcgaacggcatgctgccgtcggcgacgacgcaggtcaccggagggaagccgccggaggaggcgccgtcgtcccctgcgcgtacgagcgaagcgagcaaggagcggtacgggacgctgccgttggtccgcagcgactcgaggagctccacgatgtcgccgacggcgcgcgggtggtcgtcggggaggccgtcggggatggacatgaaccggagccgcggcgagtcggcgccgccggcggccgcggcgccaccgaggcggcggaggctgtggtcggtgtggaggaaggtgacgtgaagaccggcgccgacgaggccggtggcgaagtgcatcatgcagttgatgtggccctgcccgggcgccgggaagacgagcacgtgcgccgccgccgctgccgccgccatgttcgtccgctcgcgcggcgggcgtctcactcacggcactgcgctctcgtccaacctgacccgtcgtttccttgtaggcgcctaggcgatctcatctatggccatttggccaatggttggttctacggacaagttgctgaaaaaaaatggtattagtagaaaattttggacgagtctctagacagcaaatttcactgggcgtattaaaaacgaaattgctatgcttccaacttggattgggattcggtgacattgctccggtgacattcccgtgacattgagtcactaacgtgtgggactcctgtcaccgagaatgtcacgggggaatgtcactaaatctgcgtcggtccaactcatactataacttatatccggttagtgtatatataggcataaatactacttgtttgggtccagatgacaagaaacaagctcagtgagtcgaatggctcggtcatacgtatagcaagattctattaaaaactgccgtaacctttctgagtgattcaaagtctagaagtttaatttattgtgtgatctagagaaggtgttggtactatttataactgactttaatttgtttattttatttctccctacgtagatcgagttcagacttcagattctgtggcaggtgctcacaatacaaatgtaacttgcggttgctgccatttgccaactggcggcaataggtccatctcgccttcccttaccctctcttcttcccacactctcaatttcacatcaagacggtgatcccgagactgtgaaggacagtaagggtattcttatcttttttatgtctattgtgtatatttatatgggattcggatcaggtgcagtcactactgtgactgtaactttagcagtatccatcatccaaccatccagcacacaagggatggtttagattcgttgtttaatttccccccagctattcaactactctctgactcgagcagatgtgttttggagggaaaagtctgagagggaagtaagaattggcgccaattctaccatgggaagcatactttacctcctactgccgcacatcacacgcaattaatttggatattatctttttttccctagggttctattaatgttgaagatgtcatcttatcttaaaagttcatttgaagaggtcaatagaacttagaaggcatcgtgctgattttggaagcagacgatgatctacttttggatcatgaaaatttttgtaactgggttaatctagcagtagcatagctagttgattttgaaagcttttgtgtcagtggatgcatgacacccaatttaagcgaaaatagttagggtgtgtttagttcacgaaaagaaaatttttgagtgtcacatcggacatttgaccatatatcggaaggggttttcggacacgaatgaaaaaattaatttcataactcacctgaaaaccgtgagacgaatttattaagcctaattaattcgtgattagcacatatgggttactgtagctgtcggtgacatgggatcaggagtatcatgactagaggtttgaggcagacgcaatcgcccacgtggcctggcaccctcgggggacgtcgggcccgagggtgatgtgttcgacctcctcttagtccccccgagggggtcggaccgcacccgcctcggccccgagggccgaggcgccccgacccctcgtgggttttttctccgcgtgtatgggttaggtgagcacagcggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggttagatatatgccaggcttcatcctaaccattacaggcaagatgttgtgtgaagaagggccaacatgtagattgctaaactgacacgtggtggacaagaatgagcgatttgtgaccagtctgacactggtcatgtcgtcagcagacagccataatcccacgtcgcacctgcttccggcggaagtggaggtaggtatgggccgtcttatcagaaggtcattcggacggcaactatacaaatctccgtccatttatgaaaagggagggtaagtccccacagaaaagagggagatggtgcatgtggtatccccttaagatataaaaggaggaccttgcccacttagaggggggactggactggactggactggactttccgggattcggaacccagaacaagggagaggctggctcatactttgtagctccttcagacacagatccaccaaaaacacaggagtagggtattacgcttctcagcggcccgaacctgtatacatcgcccgtgtcttgtgctctttcgattgtcgcaatccttccacacatcaagagcttagaatttcacccagagtccccggccgaaccggcaaaggggggcctgcgcggtctcccggtgaggagccacaagctccgtcatctggcgcgccaggtagggggctcagcgtgtgtcttctgagctctcgcactcttccgtgtgcgccaagcttttcctgttcagcctgatggccgagcaagcaaaggcgcatgacctctctccgagtgtgagtggcgacgacggggagccgaacccacgccgtcgagctcgtactccaccgccccctccacgccaaagtcctaagcggggggaggcgcttgagagggtcgaaagatccgcgacttcaccgatcgcgggcgatggagaagaacggcgagatggggagcgtcgcctcctcgtctacggcgacggcagcacgccccagggcgcgctccaagctgcgggcgcgctcttacgtcacccgcctgtcgtcctgacccggagtctccagcccaacgatggctggacgacgtggccaaattagtcatgacggcacggcagcgcctagatgctggtgggcggtcctccgccaccaaggcctctggtgctgctaccaccggctccgcgtcgtcaagacggagggcacgacgagcggcagccgctgttcgccattcggccgccactccttcgtcgactccttcgatccgggaagatctgcgtggggggccggacgcccgcaccagcatcgagcgccggcgtaatgaccgaagtgctgcccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaggcgcggggttggctaatgaacttgccacccgcgtcagtccactcctgggaggatttgtgccaacagttcaccatgaactttcagggcacatatccgcgcccaggtgaagaagcggacttacacgcagtacagcgaagggatgatgagtcacttcgctcgtacattcagcggttctgtcaaatccgcaacaccataccatgcatccctgcacacgcggtaatctacgcgttcagggggggcgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgccgctcagacagggcggcgtgacaggaggaggaagaagaggtcagtccatttcgacgacgagggtcatgtcctcgccgtcgagggcgcttcgcgggccacccaaaaggacaggcctgcgagcgacaaaaagaaaaaggccggcgctcccagcagggagcgcccagccggcaagtggtgcaccgtccacaacacctccctccacgacctcgtggactgtcgcgcagtcaaaagtttggcagagcgaacgaggaagtgggaggaggagaggaggcaggagcgccgtgagggcaggtccccggcggttccctccggtaatcggcgaagtgaggccaagcagaaggcccccgccgaggacatcgatgatggcgatgaggacctaggtttccaagagcctggggccaccattgccaccgtcgatgggggagcgtgtgctcacgtttctcgccggagcttcaaggctatgaagcgagagcttctggccgcggcccctactcatgaggcgacgcgtcgggcgcggtggtcggaggttgccctcaccttcgaccagaccgaccacccaccgtgcgttgcccggggagggcagattgcgatggtggtttcccccaccgtttgcaacgtgaagttggggcgtgtcctcattgatgggggagcggccctcaacatcctttcccccgcggcctatgacgccatcaaggccccggggatggtgctccggccgtctcaaccgattatcggtgtgatgccggggcacacatggccgttaggtcacatcgacctgccggtcaccttcggtggatccgccaatttccgcacggagcgggtgaacttcgatgtggcggacctcagtctgccctacaacgcggtcctggggaggcctgcgttggtgaagttcatggcggcggtccactacgcctacctacagatgaagatgccgggccccggttgccccatctctgtccatggtgacctcaaagtcgcgcttgcttgcatggagcagcgcgcagaccatctcgccgccgcgtccaagcccgagggtggcgatgagaggcttggcgcctccgcccccgccaccccgaggcagcagatgatcacatgcgatgaggtcccggtcaaggaggtcgccctgggcgacggcccgtccaagaccacacggatcggtggtcttctggacggcaaataggaagacgcgctcgtctccttcctgcgggcaaatgctgacgtcttcgcatggagaccggcggatatgcccggggtccccagggaggtgattgagcaccgtctcgccatgcggtcgggcgcaaggccggtccggcagaaagtgcgacggcaggccccggaacgtcaagccttcatccgcgaggaggtggcgcgacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacaacaatgcccttcgggttaaagaatgcaggtcctacttttcaacgtactactcgaatttctttgggtagccaattaggacgtaatgttgaggcttatgtcgatgacttggttgtaaagacgcacaaccaggaaacgttactcacagatctagcggaaacttttgagagtctccgctccgcccgcataaaactaaaccccgataagtgtgtgttcggtgtacctgcgggcaagcttctcgggttcttggtctctgcccgaggcattgaggccaaccccgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagctgaaaatgccctcacccagttgaaggcgtatctaagctctcccccagttctggtcgccccggagccagacgagcccttgctactctacttagcggcgaccccgcaagtagttagtgtggcattggttgtggagcgcgatgaggacaattctcatttcgcgcttccccaccctgtgccgacttggcccgggagagagcagggaggagaggcccccgagccgaacggtggcccaaggcccccgacgattggagttggccctctgcccgcttgtcagaccgtgctaggagcccccgacccccaggaaggccctgaggccactgtgggaaggccgcacctatcgccctttgaccccgaggctaaccctgtgctgactcgacccgggaaagagaagggagaagaggcccccgagccgaacggaggcctaaggccccagacgaccggagttggccctttgcccgcttgtctgacgacgccaggagcccccgacccccaggacggccccaaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtgaaatgggcaatcgaactttctgagttcgatttgcactttgaaccacgccatgctatcaagagccaggccctcgtcgattttgtggcagagtggaccccggctcccaagcccgtctcaatccccgaggccagcacggacccctcgcagctgcctcacaccgcccacttggtaatgcagttcgacggctccctgtctcttcagggcgccggtgcgggggtcacgttgacctctccgagcggagacgtcctcagatatttggtccgcctcgactttcgagcgaccaataatatggcagagtatgagggactccttgccggactcagagtggcagctggactggggatcagccgcctcctggtgttaggcgactcccagctggtcgttaaccaagtctgtaaggagtaccggtgctctgacccacagatggacgcctacgtgcgccaagtacggcgtatggagcgccattttgacgggattgagcttcggcatgtgcccagatgggataacatgattgccgacgaactctcacggctcgcgtccacgcgagcccagaccccaccgggcgcctttgaagaaaggcttgcccatgtttgattttgaaatctcaatgacaataaactaaaaagggtaggcagcgggctagccgtagaagagtacagcagcaaagccgctaacggtttggcgggacttctagaaagtaaaaatgaacctaaacaataattatttttgatttttgaaattccaatgacaataaagagaggagccaccagacgagccatcccaatgacaataaagagaggaggcagtagacggaggcagcagacgggccgtagagtatagtggtagcgcttgacgagacttttaaaaatattataaaaatgaatcacaacgagatattaaactctaaacactacaaaggtctaatttttaaaggttcgggaattaaaaaaatataaaaaataaacccaatgataataatgttcgattttaaaatcacaatgacaataaagaggggagacagtggcgagctgtagaagagtattgtggaaaagccgctaactgtttggcaggactaatagaaagtaaaaaaaatgaaccacaacaacaattatgttcgatttttcaaatcccaacgacaataaagagataaggcagcgatcgagtcatagaggagtacagtggcagcgtttgatgagacttctaaaaactataaaaacgaaacccaatgagacaataaactctaaaagctataagatctaatttttaaagattccatagagaatgaatataaatagtggtagatcgagcaagcaaataaataagaggtaacttttgaaaacaataaagttaaacacagggatgataatatttgatctttcaaagtcttaagatatcgagataactatttaataaatttaagtaaaatcatatgaaaaatagataattttatatggatgatagctgtgaaattgtgcgggccacccagctagttcataaataaagaagggagcaaaatcgcgtccacgttgctctccccggggtgacacatatggcacttagcaccagctgccgccaccttcctcccttctcttccccgcgcctatcgttgcctgagtggccgtcagcaaagccggctgcctgctaggatggcagcggcggggtttcttcccccctcggtgccgctgcacggctagggaccaagacgcgctttggaggtggagagtcgccacgccgtattgatccgagcctgcatggctggatccggacagggagagactggcaagcgtccgtggaggtgctagcggggtggctagcggcggtggaggtgtggacagatgatggcggtgacagaagtagaggaaaggcggtggcaagagaggacgatggtacgtgggacagcaggcggcggccctcggcagatctagcgctccggcgctccactggcctgatccggtgccctcttccatctccggcaagggatgtcggatcccctcggtgatgacgtcaaaggaagctttggcagcggggaagagtgcgaggaggcaagcgacgggcaagaccagcgggcggaggtgccaacgctgaggaggacagcggcaagcccgtggcgatggcggcccaatgaaggcacgatagctgtggccggtagcggagatggccaccgtcgagccggacagcggcagagctcatggctacgacaatggcagcgtcgaggtcagcgacggcactgccgaggcagagaacggcacgcgaggaagtgcggggcggcggcggaggccggtgtggtgtgtgcgagaaggcgcgggtgcccatccgccggcggaggttagacggcggttggagcattggtgcgttagcgatggataagcaggctgcgaacggcaggtaaaaacctagcccggccttagccaggccggcaacgatggctttcagagcatcactcctttttttgggcattgtcgtgccatcccatgccctttagtgaggctgccgggtgaaaaaccagtctcggttctctttgagaccttgacagacagcggcggcggtgctttcgtcatttatctccttggaggcgttgtctaggcagcccccttgccgaaacctctgaaacaaccggtgcaagcttactctagattcttgaccccttgtgtcggtgcctagcttacgctactaggccacgttgcatgacctagggggaaagcggttccactcttctttatcaccttctctccctcaatcccaaagacatagatagagtagggttctgtgtcggttgtaagggttgggttttgggagatcccggctatacgtcctttgttggcctagcgccggccggcctggtgctagccttctccggggtctgtgttggtgttgtcggtgtgtgggtagtggtaatgttttctttgttctcctgattacgacattccacacttgtaatcatgtattttttttcctgatttatcaatgtgaactttgcattgtctggtgcgagttgttaaaaaaatattcataattaaaagcttgcatgtgcttagatttttaaaaatgggcctatagaatgatccaatgagaattggaaaccgtgcagctcgtatgctccacgtccgaagtattcgtccgagaagcacgcttattagctttttttattacacatgtgccctttcctagttcatattgctaccgattgttaaaaaaatagaagatgtttctgttataattttggtacgttatccgtgtttgaatcggttttaattttatgtttttgtcaaatcctttccttttttttcttacaccagagtgtccctcttatccgagacgcgtgcaaattaattgggcccgcaccttttcacacgcctcttgttgcatgcagcaatcgggcccgcccctgagcttgttttccacacatgcctttgtgcgccgctgcgattgggcccgcaacgccctcgtgcatgcaatttttcacatgcctgattgggtcacgacacccttgcgcatgcgatttgcccttgccgcatgcctgattgggactgcgtcgccctcgtctgcgatttaaaaattaaagatggttttgtcaatactatggtatactatctgtatccaattcccatcacgcataacattcattgcgaagttacgactcacgagtgaactacgatagagagtctgtgtgatgtggataccaagcgaatgaaactcgcagagtccatgtggatatgatgtacattgttgcccagatcatctgattctatttgtattacacgacacaattcctgggacatgttagcatgatttcaagttagtctttacacatgctcgtacatactaccagtgataccgctacaataatccataagaatcagttttactttcgaaaagaacatacaaccgaaataaaggatgctcaaaatcgttgattccatccgtcttcaatttctatccgacttgagataaagctggaggacaaatcgagctcatgtttgaaggcctcatttttttggcttatgttattcctataagccaaaatttaaattttagaacttaattttgaattcgtttttttgattttttttatcatactttattttacaacatttgcttttaggtcgctaagaacatgtatataaaatatttacacaaaaatagtcttttattcagaaataagtaattcggataagcatatgaataaacgaaacaatgggctatgattatttatccaccgacacatatgtacaaattaaattggctctatccattgcaacctacgggcattttttctagtaaataataaattaaagatgtctctgaattgtgacgaagaaaatatcgatcaatgtttcattcatatttccaatcagtgcctatgaataattttgcattcagtgggaaggcatcatatagataaaaatatttggtttttgattgatgattacatactggtaaattttaacttaattttatagttattctgaaccatgcaatt

SEQ ID NO: 503 - DNA, 5170 bp, Oryza sativa
  unsure (1)..(5170): unsure at all n locations
ggaaaaaatccgaattactcccgaactatcacagtcaaccgaattacccctaacttaaataccaaacattttacagtcaactattcgagccagacaaataaccatttgactccatccattcttattttggtcctacgaggcagcaagtagtcaacaacttttttaaaaaagaatcggtgggaccaacctatcagattccctcccctctcacctctctctatcttagcttcctcattccccaccttctctctccctcttctcccctagctcaagagtgcggtggtggctggcccgtcaagctcgccggttgtgcctccatctcgttagcacaataagcatactgccattgtgacactctcccacacgagctcgcccgatgcctgacggtggagcttgcgcagaggtggagcccaacctcgcgtgtaggcggcgacaagactggcgatgtctcaagctttcttgctctcaaggaggctggtgagcttggctcctcctcggccttcgatgtgatgaaactcgcagtcaccgcagctcctcctcgatcttcgcgggcacgcggctcctcctcagcctctgttggcgttcacgtgttgaggctctagtaatatagaacatcaccaatgggacaaattataggtgccgaaaattgtaaaatcaacatctatagacattttcccacctccacaggatggaaaaatataaaccaatacctttaaccaactatgtataccagttccagagaaaactggaccaatactttatgtgcttattttgtaaaaataccaacaactttaatatattataggtgtcggttaaaccagaatatataatatattttaggtgccggtctgttaaaaatccagcacccttaaaattcgagtcacgccaatggttgggagcgagctaaaccagctcctttcgcatccttatcctctcacgcccctcgcttccttgtcctctcatgcccgcgcacctcgtctcatcgctctctcaccgctcattctctcgtcgcctcctccccttgccctccccttccccctcttggtatttgttacgcacacagataaattcacaagagtattccaagcgtatcgaacagaaggaacgtgtgtatctcagaacaggatttaaccaaggacaacaactaaatgataggcttaggacagagaatattcctatggatttaaccaaggtaaaactctatcgaatgctttgggcaccggcccttccctagtctactgacaggctgagttcggccttgaactctattatgactgtcaccacctgctgcctacctcactttctgtgaagcacacaataaatgaagctaacctctaccctaaacactacgtctaagctaagcaaagaagcaaccttttcgtttggtttttgtttaagtcataagtcactcatacactattaatccaaaggctaggttggagaagtttttttatcttatgtgcggtacatgtataaccacaccattaaacttaatactttatatccattggcttataagttatataaaccaaaaaaactgacttaaaaaccgaagccaataataagtctaagcctaaacaaagagactcttaaaaaaaaccaagttaatatggattacctttttttatttattagtgatttcataatgactttatcacttttttgactaactatacttcaccacccagctgccacattatcaaaacttgactggtgtagtctaaagataaagtacggatcatgttgagagtttgcaaagtattactaaatgatttcacaagtgaatttcaaaccaagatcacgtagtttcattacaacggaacccctcatatatgatgggcggtaacccacatctgtaacgggtatatgtcccatctattctcatttgtcagtgacaaagaaaaccttatctatgatggattccataagtcatctatacgtataagttatgtaccgtcactactagtcatgattttttttaattttaaagacaccaaaaatccctaaaagaattttaaattttactaggtatctagtcgtggtcacgcatcactaaccataaatctacgatctttcccgattgagctttgagcctacttggtgtaattccaaaacttcctcttgtataaaagatatcaatacaaactatcggtagtcaaaactaaattggtgccttttgtcttgaatgaagcctgcagcttctctcatgaattcatggttttaaaacgttgaaattaaaaaaagctagctactacatgtctacatctactaggaacagtagtattattactagcagacagataatagctttattgaaaagcattgataaggtcttgagacttgagtaggtcaagcacgatgacaagtatatattgacccataaaaatatctttctacatgcaatgcatcctgtgctaatcaaaccctaccaagctattcgagctcgagctcactaggtttgcgaacctcaacctatgcttaagtttggcttgtctgtagcattcgagtcgtgctcaaattaagctgtaacaaatcaaactcaaacagattgacagccctatctgtagctaccacacttgttagaaatgtcctgtcatctttgatgacgggtcacaactaacacccattatagatggattcacttctaatcttctatgactggtatccacatatgcatatatcaaacgtacgggctacttttagatccgtccgttagatattagccatttgaaatcggtaatattgatccatcacaaatgacctgctgtgcgttcacgaatatgtgagtgtttaggaacaaatatggaatttttgtcccgatatgtacttaatttagtctttcacctttgatacatattgataatcaggggtgctattcccttttatttaggataaacaaattagagcacagttgataattggaaatatgaatgaaacattgatcggtattttctttgtcacaattcagcgacaactttattttattatttataacaattggtagcaatatgtgaactatatttagaaaagagcacctgttgtaataaaaaagctaataagcgcgcttctcggatgaatacttcttcggattttacattaaagagcacatgagctgtggttttcaattctcattggatcatcctatatccaggtttctataggctattgtgtgggtgatgctataacgtgaaaaacaatacgggaattcctgatcatagcgcgcggtttccgattttcaatctgaagtttcaattcctatagcgtacgtttctaattgtcccgtactgtttccactagaaattcatcccaatacactataaaaacgattatttttttacaagaagccctttagattgcaaagagaccgtacgtaactggcggcatctgcaaaaactgatcttcattttcgcatatacttcttccgtttcatattataattaaggctttctagcattgtccgtacaaataaatatattaatgaatctagacgtatatatgtgtttagattcattaacatctatatgaatgtaggcaatattacaaattcttataatatgaaatgaagggagtagctctttataagacctgcatgccaaaatcaattttctctttgcatgcgggtctattaaggagcctcatgcaaaaataagcctattttctcatgcggtcctcttaagaggacatatgcgaaaaggggacctcttaagtgatccgcatgaaaaatatcatccctttacatattttttttatctccctccactctcttttccctctcatcatttatttattttttgaactcctctgctctactctcctaattatttactttcctctctctcgaatgctctctctcttctctctctctatccgagtaggagccaacggccgataggggtaggagtaggtgcggctactatgacagcgggcaccagaagtggctgcggagacgcgccgttgccgggcggtagcgggagatttggcaacgtcaccctcggaagggccggatctgctgccctaggtagcagctcggtgcgaggcggcgagggtttggcgctcggcggcagncggcgcgcgtggatccgacgatgacagtgggcaaccggaagcaggcgcccgaaagcggcgagcagcatcgacaaggcggctgggagtggggccaccccacatggattcggcaacagcgtcaggtgccggcaaccaggagctggcggcagcggctcgtcccctcgcggatctggcaccgacgacgacggcggcgaccgggaacgggcggcgacggcccgttctcggccgcgtggatctagcaccgggggtctttctcgtgtggatctagtgctggtgacacaacagagggaggtgggaccatcggatccgatggcactaacgacgatggcggcgggcggcggatccgaatgacgatggtggcgggcctaggttcacccggtttctatttttatttttattttttctcgccgaatttatttttgtatgcagccggtataggaaaccgcgtgaaaaaaatggaattttggcatgcggttggccacatgaaaaaaaaaatattttcgcagaccttttggttggttgggatggccgtatgcaaagatcgcttttgaccgtttgtagaaatggtttatgtactactgatatattcatcacaaatttgtattgacagttatgaaaattttgttttacagttgtcacaaatattaaaattttgtttcctaactctgtggagttgtaaaacgtaacacgactggaaaacgaagctggcatggcacacgtgtgaaataattagtgtacgtaaagctcacgacgagtcgatcaagaattgaattgactttgactttagtactccctcccaaaatatagcaatctaaaaccggatggaacgtattctagtactacgaatctggacatgtctcatgtctaaatttatagtactaggatatgtctaatccggttctaggttgctatattctgagacggagggagtacagtacagtagtacgttactccaggtctgttgtcgtgtcttctaactgactttgacttgatttctaactgactttgacttgatttctcttagagaaacagtacgttccatctggggcttgaaaagtagagtgctttaatacaactaggtggcccccgcaattacacggctagc

SEQ ID NO: 504 - DNA, 19077 bp, Oryza sativa
  unsure (1)..(19077): unsure at all n locations
gtctaccactgattctattcatttttcttataacctttaaaaattgaacatcgtagtttttgagtttattttgtcattgggtttcgttttcattatttctagaagtctcgccaaatgctgtcactatactcctctacagcccatccgcttccttctctttgttatcattgggattttaagaatcaaacataataataatttgggttcattttttatttttctagaaatctcgccaaaccgtcagcgtctttgccactttactcttttacgacttacctgcctcccctctttattgccattgagattttaaaaatcaaacatgatatttgttggggtttattttttacatttcagaagtcccgcaatcgccatgactgtactgcttaacgacatatctgccgtctctccttttaatcattattggaattctatttgaggttttgctaataattttcagataacccattaaccgccaccactctactcctctacaggcatgatgcttctctcctctttattgtcatttgtcatcgttgtgttccagatgattattttttgaaaattccatatttttattccaatatttttatttataaattatattattttttttcttgaactcttatatttatttttctattttggaatttattttatttcttattttaaattttaattaatctcatcatgggttctagattgtctttttttgacaatctttatttttattacaaaatttagttatttataaattatatttctagttgaacttttataatcatttttctaatggattttattttattttttattttaaattttaattaatctcgtattgggttcttatatggtttcttctttaaatattgcttatttttatttctgatattcaattatttttaaattatatttctacttaaactcttcttctatttttctttttctccaattaatgtgggaatttctaacacccactgcgagcgtgttgcttctcccctctttattgtgatttgtcatcgttgtgttctagatgaacttgttttcttaaaatttcatattctcattccaatattttttatttaaaaataatattcccacttgaactcttatattatttttatatttttggaaactattttattcgttattcccaattttaataatctcgtcatgtgttacagatggtatcttctctttattacgaatgtcagtatttataaactgtatttctattttccttttttaattattttttttcaaattttaattaatcttgtattgtgctgtatatggagtattctttcaaaattcctaattttttatttttcaatttcagttgtttcaaaactatattcttacttgaactctcttagtttttaatttcagatcttattttattttttattttgaattttaattaatattgtattgggttcttatatggactctttatttgataattacatatttttaatttcgaatttcagttatttttaaattttattcctacttaaaatcttctatttttttttatctccaattaatgtgggaatttgtagccccaataactatcgtgatacctacttttataattttcttaatagtatactacatagagataatagtatcaacaagcatgagtgtcgtcatctggagtagtgtttaaggcaaaatatcttttgaacaaacatagtacgggtctagggcaaaatatctaactgaaatcagtattcataataaaactctagtgaaaaccatcgtcgtcctccactcctccccagtccacactatatatagaacagtcatacatatatatatcacaaatttggcttctacctttcgtttggtcgatatgcaggtcatccaagtagatccaagcggtgtttggacagggtctgagctgtttaattgtcatcctaacagatcgatcatcagctgtttaatcaacgcctcagctgctatctgatcgattaatttgtatatttttgtcgtcatacagatcgacggcttgcatggggtgcagctgttgccgatcgagctagctctgctgcatgcggtccgcccacgcctagaattaatgtgcagcgagaagttagctctactcttcctttttttttttaagaacaagttctagtagtgatatgcatctccatccgtctcatagaaaactaattaatatcagatgtaacacatacttctatatgtacagattcgtaatactaaaatatgtcacatccaatcttagatttgtttttatgagacggggggagttacttcgtagcgtactcctacatgaacatccaattctagcctaacctccgcaatatggtcaactccctccgtcccaaaataagtacagttttatatcgataatgtccaacatttgaccgtttgtcttatttaaaaattttttatgattaatatttttattgctactagataataaaatatgaataatactttgtgtgactaattattttaaattttttcataaatttttcaaataatacagatagtcaaacgttggatacggataccaacggctgtacttattttggaattggaggtagtaagtcatttccagctaagctagctagggccaacgaaagtaggagatcttacttaccctacacgtgaccaaattagtgaactggatggcctcttggagtgtatccgatatactcttaccctacacgtgaccaaattaagctagctagctactttctccgttcttttgaaacgctagattgtcaaaaacagaaataagaaaaaatgtagaaataaaatgtaatgttcaatgcattcttatgggatttaaaaacatatgaaaggtccccaactaccatttaatatttacgcggtaaaaatgaggaattcaagacacatgaagaagaagatatgaggtaagacgtcgtactaattttcctccaaaattccataggaatcttgaattgataagaatcaatattttgtttccaagggtcttatagtattattttccataggatataaatccattggaaatactatgttttttctttgtttcaaagcgcgccatatttttaggctcctctcatttatccaaaataaatttattttaaaataattatggtatcggagtttgtgaaagtaaagaataattgtatcagaagaagataaagtaaaaaatagttgtattacgatttgataaaatagtggtatttcagacttgtattggtttcgtattgtcacgtgtgagagtagtgcatgaaaagtaaacttgacggacggagtactgacttgtccgtcgctcgctttgacgggccgacgtatctcgagtctcgacctgcataatccttctggaatgtttaatacaagtcggcacagcgaatgtttattttgaattttaattaattttattttagattttgatatggactctttctttcaatattgcttatttttaatttcgggtttcagttatttttaaattatatttctacttaaaatctttttttatctttaattaatgtgagaattattaacccaactatcctaataatataatagatatatagataatagtatcaataagcatgagagtcgccatccagtttctaaggcaaaatgtcatttgaacaaacatagtacgggtctaggacaaaatatctcctgcaaattaaatatctaacggaaatcagtattcataataaaactctagtgaaaaccatcttcgtcctccccagtccacactatatataggacggtcatacatacaaatttgacttctacctttcgtttggtcgatatgcaggtcatccaagtagatccaaccggtgtttcgacagggtctgagctgtttaattttcatcctaacagatcgatgttcaaaaaaaaaaaaaacagatcgatcatcagctgttatatctgatcgattttgtatatttttgtcgtcatacagatcgacggcttggatggggtgcagctgttgccgatcgatcgagctagctctgctgcatgcggtccgcccacgcctagaattagggcctgattagggaggtttagattctgagaaacagctatttagtagctagcttttaagaatttggaaaagctttgaaatccagcttctccagcttctgacttcttagttcatttttcagaatctataactacagattctcagaaactatggactgtttggggcattttctagcagaagcagctttagaaaaaagctgcagctaggacaagttctcccaaacagggccttagtgtgcagcgagaagttagttctattgcaaaagtagcgatatgcatatacttactattccgtcttaaaaaaacgaatttttaaccatatatctaaatttataggtagaattatctttttttttaaaacagaaggtatacttgtggacttttaaaatactcctacatcaacattgtttaatcctaaaaccttcgcaatatattgtctaacatttccagctaaactaacttgggccaacgaaagtaggagatctcttgtgaagtggatgttctcttggaagtgtattaccctacacgtgaccaaattaattaagctagctagctacttcctccgtccctttcaaatatacgattatcaaaacatgggaatagaagaaatataagaatagaatgccatattcattagattcatatacgggattcgaaaacacgggaaagtttcaaaactaccgtttgcatatagtcacacaaggaaaatataggaattcaagacataggaagaagaaaatatgaggtaagacctcactgcagtagaagcagcccctagagacggtttttatgtgatgtagagacggccatgtctaggatttattttttctctcagtcaacttcaaaatttaccaaatagattaatgtgatcgtagagacggtctattatcctgtctctaattagtgtatctacgtaagaggcaatgtaggagatgggctttaatagggacgacttgcttaaccgtctcttacgggatgtctctacatgtcctttttgtagtagtgcctcatgctaattttcctccaaaattcctctacaataatccattccataggaattccaaataaattggtatgaatcaatacttcgtttcaaaaggtcacgcaggattatatcccataggatataaaatcctttggaattcctatgtttttttctttgttttgaatggggccatatttttaggctcctctcatttatcctaaataatttttttaaagataattattgtatcggagtttgtaaaagtaaataataataataataatagaagtagataaagtgagaaatagttgtattatgatttgataaaatagtagtattgcagtattttattggtttcgtattattgttacgtgtgagattagtgcatgaaaagtaaacttgacggagggagtactgacttgttcgtcgcttgctttgatggaccgacgtatctcgacctgcataatccctctggaatgtttcataaaaggcggcactgcgaatgtggcagcgacgtgtcattctaggggtgtatatatgttgattggtaccgataatggtttagaattgatttattgtaatttatttactactagcaattatacctgtgcgttttaattatttttcttttttttttctgtgtcgaggcctcgttaggctgaacagtgcaacagacagcttgtggctgtgggcagtttgtggaggcctcattagtcagttttatattttagggtatcgatccgtggaattatcgggccacggcccatcaagagttcacggactatattttcagttgtgttctgtcatgtacctttagggattaagcatttttgctcttggcaatacatgcgtgctcaagtgtctaatatataccttaaatctttttatatatctgatacacaacttttcagtagttggcacaatacaatttaaaaggtggcaaaagtaaagctttacgtatggttgttaagacgatgtttgctttttataaagcaattgattgatgttagtttatcattgctttcggccacttatgtgtgcatttttctaaaaaaccaatattatggttgtagtctaataatatatcttggtcattttcaggcagttggtaaattcatttcttagtgttattttacttggattttacactacaaatgccatatatttttggctgggggcaatgttgtgtgtcttatagggacataaacatatttgtcctggcaatatgcgcacaatgtgaacaaccatagaaaattcctttactcactgcataaaggctttttattaaatcatttactatgtgacttttaaagatgcagttggcttttggctatgcacattatactttttaataagtagtaggtatatcactcggatcatgttgtttgaggattcataccgcctatgctatatattagtattaagtcacttggttgactataattatcaaaaaccacttgtttggttagattatttattccttgactatatacttagtttgtccaactaaccatatagtcggagggctacacctaataaggtgtatctagtcgatgtatctgagtatatattctttattatctcataaaattttttcagcctttcacagccttatgatttggtaaaagcacttgggagaatgtggtgaagatgatcgaagcactcggctttcccaagactagtcttgatttctctatatttgggaaaaaaaacaccacttggtaaatatactggtcctcttgtcttctactcagcaatcgacccatcaaccactgagttgatcaaatttgacaatgtggtgaccaagattccagattggttgatgagagcatggtgcacagctaaatcaagacgatcctataaagtcatcaactgttttttattattatcatcttctttctgctctcctttggcaccagatgctccttctccttctaacttcggcatttggcacttgtacttttgaataactttcccttgccgagtcatagaaaaagaattaatatatgccttcttcagttcttgcatcttctgctccatctctgccttttgctcttcagacagatcttcaaccttagcaggtataacattttctttaccaatgtcagacagtgacgacatggttgaataacaaaactttgtcccactagatgtgccaaaagcttgttgatgtgaaaacacggcggcctaggagatctgcttaactccagtgcaggtccaaggttagccttgagtgtgtctagggcataccagctgatttgatcctgcaatcagcaagaaaggacaaaagcagaatcagtcgatcgatagccgatcgatcgataggccgatagcatatcgttgatggtctcagtcgatggagttagaccaaatcggtatggactggatatatcaaagaataataaaccctaaacatgaccaatcggctgtctatagaatttaacaaattgatttaagacagtattatcaaagtagccgatgcgaccgtattttcgagtgtgaagggctcatgggctactgtggagattacgggtatcatatacccatacgattagtttatcgactgattatatgagatagtttatatctctagaatatgtaaaggattaagccttgagtattacgtttccctgagtattaagggatacggcctatagctctgactccggaatattgtcaaatagataccaggtttagttaggttttatctataatcttgcccccgacctacataaggcaggtaggaggcccctcaagggcataatcatacccaagatcattatatcaaccagttcataccccatgcgttgcagtgggcacactataaaattttctatgtgcataaaattgatgtaaattggtcactgaatcagcatacgaagaaaaggagatttacaatgttgagatagagatgcgcctaaatgttcgtttaaacaagtacaattcaatcaggaaacccaattcaaggtacatggtattctagcgtaccgagctggtcgatttgcttgattgctgtgaagatatgttaggtgtaaaaaacaggattagcctatgattaactgagtaagttcaaaactttataaaaacatcatttgtcatattagcctcttggcaatatgattaacttttttccaagaatttaaggagcgtgtgcagggtgggctggcccaacggaaaaaaaatgatgggaagttggcccaagatatcaacatcgttcatctggaaacatgcagtccaatccaacggctgaaaataaatgatgatgtggcgcaacgtggtgcaaactttatagtaataacttctctagtgggtaccaactatataggaagaagagatacagcacctcatatatacaaatcccttaacatcatgagtatgatattacctctcgataaggtcgtaaacttgtataaatcttttgtcatccaactcacgtactttagttctcatgcgctacacccttttcatattgcggattcctagcatcgacagtaatgttgatccatcacaaaatgacctgctgtgcattactgaatatgtagtattctgtggacccccgtttttataactggaatcaatcgtgtaaacagtaccatttccctggatcacgtagtctggtacacacgaattcatagctgaaataccaagtgcacatacacgagtgtctaatacgaattattacatcataagcccgcaggcgtagtcttaaatcatcggaccgagcggtccggaatacatcccaaaagcagaaatagataaggcagcggaattcaagcagcggcatgccattgccaccggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttctcaagcctaagacctagcatagactgttcaagttttaataccagtgttcatattaaacaatgacggttctatccaccatccattgtgatcccaaggatagcttcccgccattgaatcgtcatggttttctgaggatgtccaccttccctcctctcgggaagtgactccctcagcataaaattcatcatgcaatatcccatcccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagtctcgtcccaacacatgagacgcgtcaccgcaaagcttttcgataacctcgcattggtagtacccgctccatgaacttaaatcctcatgcactctaggcgtccatgtttctaacagtgagaggagttctggcgctcccgggaaagagaagtctcacacacatattaaattatggttcaagttaagttctctctctcacacactcatggcagtcctaccaatggcgacaccgatgtagggcacgcctctcggccctacctcaacggctgtcccaccatagcgcacctgcctcactcaggggtgaaccatctatgcagggatactgcctccgttcggctatctaatccgctaggtctatacccatatgagaagtgcggttgtacgggggtcgtttcatgcttaactttatggctcggtccttaattgaccggggacggtactagcctttcccagataccacccaaatcctccgtccgccccagtcgaaaacaattgtttaattttatttctcctttcacaaatcatgtcatcaacatcatggcaatgtggcgctcatgtctccacatgccgcatctcaattaccttccaggtaattgaccaagcatatagcatttgataaatatgagtatgcatgattctagaatggcatttctaagcaattgtcataattgactagggactcatacgtaattatggttacaaggattttaagggtaaacaataatcaaggcatggcataatcattgcatgcaattttatttgtaaacaaaacaattttgcaattgggatcaacatgttcaaggaatagtgatgacttgccttgctcaaagtcttgcgggtcttggccttcgcttggatccgcaactccctcgggctctatggttacgtgcaaaaattgatttgaattcggttagaattcaaataaaaatccaaataaatccaaatgaaagtcaaatgcgaaagtcgattcctttttattaactttactatctgtcaactacggcaaacccaatttcgatttaaactattttgcgggtataattattttgttgtcataagttttaatttactcttcccgagcattatatccatataataggttagaaatttctattacgagctaaatatcggacgaaatcctagaaatattatacaatttaattcagtctatgactaaacgattaaatataatacacggctaagattcctagtaattaaatccgaatttctaccgtgaaccgatgacttatagagattaccaaaaataatctataataatctataagaattcatctaattgtttagttattaattatatctaaattactaccaattttaatctaatctgtttaagaaacatatttttataattaactcggaatttcgaccgaaatactattacgctcgaggaatttccgaaaataatctatgattaaccccgaccatttttatttcctaaatcctcctaatttctcccccaatttcccttctattttctccttttcttcttttctattttccctctttttctctcctccctttctttttctctcttttctctccctctctttctttttctctcctttttctctcctctctttctcttttctgccggcctctcttttctttttcttttttccttctcttttctcctcccggctcctttctttcttcccttctcttcctctattctctttcggctccttctcctcctctctctcgtgctgcctaccgcgaccggctgaggaaaggaaaaaggcggcggcggcacggcttaccagcggcgacggcaatggcggcggcgcacggtggctgcgacggcggcggcgcacggcgactgcgacggcggcggggaatgcggcacggccaaggcgcggcgcggcgcggtggcgtcgtggcggcggcgcggcagctctatgcgacgacgcggcggcgtcgaggcggcggcgtggtggagtgggtagaggagaggaggtgaggatggaggggaagagtgggagtagggggaggattatataagggaagggggggaagagataatggggaagagggaagaggggcggccgcctcatggcatcagcggggtggcgcggcgcggggctcgactcggcgatgtgacgacgacgcggcgcggcagggcgcggggcgcgaggagcggcagcggcgacgcgacggccgaacggcgacggcgcgaggcgatggaacgggcggcgcggcgcggtagcagcggcggcagcggcgatgggacgcgcgcggcgacgggacatcgatggcgacggcgacagcggtggcgcgcggctcggggcgggatgcgatgggcggcgacacgacggcacggcgtgacagcaacgatgggacggcgcggcgcgggctcgcggcgcggcagcggcagcggcacggctcgaggcggtgatggaacgcgcacgcggcgacgggatggcgacagagagagggggaaaaaagaaggagctgggttaggggaccccgtcgaacaccttaggtgcaatgaacagtgccgatttctaattaacccgattttagtgtattttccatataaatttgattccacgattcctaattttgcatatatgcattttactcaatatttgtgttatcttaactaatgaattcaccctagattaatattactcatattttatttttatataatttatttgagttttaattagggttaattcttattccatcgtatttaaatttaattgatccaaatatggttgcgataatattttatttatttctatccccacctaatctttattttaatttgtatttattttaccaatttgtttttaaggtttattcctaattaactattctttactcacgattaataatcttcgagatcaaatccagataaaatagacgaataagatcagcatgatgcaattagtttaaaaagtttttgaaaatccgtatttttatagttttgattttgtcggtcaaattttcagggtgttacaaacctaccccccttaaataaatctcgtcccgagatttcttaccagttttcgaatagatgcgggtactccgtcctcaagaattcttcggtttcccaggtggcttcatcctcagtgtgattgctccattgtaccttgtacatacgccacactttgctcttagtcctcttttcggcttcatccaatatccggatcgggtgttctggatatgtgagatccttgctaatgtgactcttccagcggagcttgctcttccggcactcgtaaacatttctttagcttagacacatggaagactgggtgcacatccgcgatattctctggtaactgtagctgatatgcaacttctcctcgcctggcgatgatctggaatggtcccacatatcttggtgccagttttcctttgaccttaaacctttttgttcccctcatcggagaaacctttagataaacgtaatctccctccttaaattccaggtttcttctttgggtgtcggcgtaactcttttatcatgattgtgctacttttagacggtcacggatcaagcgaaccttttcttcggcttcttgaataatgtcaggtccaaataccgcctgttctccagtctcggaccacattagcagggtacgacatcgtcgaccaaacaatgcctcattgggtgacatctttaggcttgcttgaaagctgttgttgtaggagaattcggcgtagggcaaacatctctcccagtccttgctaaaatccagagcacaagccctcagcatttcctccaggacctggttggttctctctgtctggccatctgtctgtggatgataagctgtgctaaatgcgaggtaacttcctagggcttcatggactttctcccagaaatgtgaggtaaactgtgtgccccgatcagatgtaattttcttaggtacaccatgaagacatactatcctggtcatgtataactcggctagcttagcactgctataatttgtcttaacgggaatgaatctcgccgtcnnnnnnnnnnnnnnnnnnnnnnnnnaaatggaatcatatcctgttgcggttttgggcaatccaacaataaaatccatacctatctcatcccatttccattcgggaatcctaaggggttgcagcaagcctaccggtcgctgatgctcagccttcaccttttggcacacgtcacagagtgctatgtattccgccacatctctcttcatgttgggccaccagtatccttccttcagatcttggtacatcttggtacttccggggtgcaatgaatatgccgattcgtgagcttcctttaaaattaatcccctcagtccaccctgttcgggtacgtaaattctctttttataccatagaacatctttttcgtcggttgaaaattcctttgcacgtcctgtagctaagcgttccttcacctctcggacttcctcgttgtccttctgggcttcttctatttgggttctcaaaagaggttgaatgtccagggtgtttatctgtccacgaggtactatatgtaggttcagctgagctatctcctccctaagctcagggatcatcccttccattctcagatgattgcaatggctcttacgactcagagcgtcggccacaacgtttgctttgcctgggtgatagtgaacttctagatcatagtccttgattaattctaaccatcgcctttgcctcaagttgagatctgactgggtgaagatatactttagactcttgtggtcagtgtagatatcgcaatggtttccaatcagataatgtctccaaatctttagcgcatgaaccacagctgcgagttctaggtcacgggtagggtagttttcctcatgtggttgcaattgtcgcgacgcataggccacaacttttccgtcctgcatcagtactcctcatagtccttgccttgacgcatcacaatatataacgaagtctttcctgatgtcgggaagaactaaaataggcgccgaggtcagcttttctttgagctgctcaaagctttcctgacactgttctgaccacacaaacttcttttccttcttgagtagttgtgtcattggtcgggctatcttagagaacccttcaatgaaccgtcggtagtatccagccaagcctagaaaactccgaatttcagtcacagatttgggtgctttccattctgtgacagcctccactttagcaggatccactgctactccaccggccgagattacgtggcctagaaaagcgacttcttttaaccagaactcacacttgctgaattttgcatataacttatgcttccgaagtttctcgagtaccaatcgcaagtgttccgcatgttcttcctcatctttggagtagattagaatatcatcgatgaataccaccacaaatttgtccaagtagtccatgaacactttgttcataagattcataaagtatgccggagcgttggttaaaccaaacgacattacggtgaactcatataatccatagcgtgttgagaacgcagttttgggtatgtccccggttctaattttcaattggtggtatcctgaccgatggtcaatcttagagaacaccttagctcctttgagttgatcaaaaagatcatcaatccgtggtagtggatacttgtttttgatagttacttcgttcagtgagcggtagtccacacacattctcatgctaccatctttcttcttgacgaatagcactggggctccccaaggtgacgaactggggcgtacaaatcccttttcttgcaactccctaatttgctttttaagttcatccaactcattgaccggcatccgatatggtctcttggatatgggggcagttccgggtatcaggtcaataatgaactctgtgtctcgatctggtggcattccaggtaaatcttctgggaacacatcaggaaatcgctgcactacgggcattccctttaggggtagcatggtaaatatacctccggcacgttcggttagcctaggatcttgatccatggttgctctcatatccgatccccagggtgtggtcagggtaacttctctacgtctacagtcaattatccctctatgctttgctaaccaatccatacccagaatgacatcaagagtttggggtattagcaccataagattggagggaaataccacatcccgaaggcggatgggtacgtcaatgcaagctgtatccactgctatctcacccccaggtgaatgtactaacattggttgtcttagtttaactctgattaaattgtgttgttgacttgctttcaaagatataaatgaatgcgatgctcctgaatcgaagagaactttaactggagtggagttgagtcaaaacatacccatcagtacgccttggtcttcctgggcctcttcagctcgaacgtggttcacttgcccgcgtccaaattcggtagcggtcctgttagtctgcggagtcctgaatagacctcgtccagcagcaggggtagcagtcccgtgaatagccgttgcattagctccggtgcgaatgggtgtcttgttcggatgaggacatttattggcgaaatgcccatactctccacagttgaaacaacttcctggccttactgatccagtggcggcctgattcggtgcaggagcgcggttctgaatggtaaccggcctgtggaaattactggaggcggcaggtcgactggttgtcaccactgttggtctccatgccgaggaggttgtccctttaggacgctggggtgcggtctgaggcgggcggttcatggcaagcctccttttacgattgtgctccacgacctttcggtcgttctccaacctaacgaccttattgattaaactctggaaactatcgtggtcttgtccaatcatgggcccgcgtaactcgtcattcaagccttcaatgaatttgtcgatcttttcctcctcgttggcaagatctctagtcgcgtagcgcgccagctgagtgaaatggttcaggtactcttgtactgtggtattcccttgccgtagtctcctgaactcattcttcttcatccgcatcactgcggcaggcacgaagttgtcacggaaggctgtggtaaattcctcccagtttggttctccagcatcttcttctcgggattctttgtacgtgtcccaccagtctccggctggtccttccaattggtttgccgcaaagatcactttatcggcctcacgtactcgaataagagttagcttcttctcaatgatccttaaccaatcttcagcatccataggttcttcagctgtggcgaatgtgggtggcttggtcctcataaactctccaaagcttggccctccgcggttgccttggttgttcgcgatagcttgcagaagttgagtttgggtggccataactccggccagagtggctaagtcgggtgtctgagtttcgtcattgctggttgttgcccgacgtcggcttgccatctgtgcaggttgattgattgagtaagtatcctaattctctagctatcttttacggctttatcccattaggggagattgttttgatgtgaactttgttttgcaagcatggtggaataaactcatttataacacagcaacaatagatatcataaataacatcacagagtttcacaaatggcacataaatcatgatgcaatcgactgcatacatacgcagtccaaataaggttcatccaaaagatacatcaaactaatcatcaatctactcgtcaatctaggtaagggaggggggtgtctcgcatactatccaaaaaccatctgatacgagatcgaagctgcaaggagtccgtcagtctagtcctccagccatccgcaggatcctggggcaggtagagggtggtcgctggcacgcgcaaaccggagtccccacggctcagaagtagtggcctctggatctggcttgggcctcttgcccggaggtcgtgtgctcttgcgagtagtgctgagggtgcgaggacctccaaggaaggtgatgcggggaacaggggtctcatcctctgaaggatcagtgatgtctggcttgatctctggctcggtgtcggtcccctctgtctcggagtcgacctagatcggagtctccaaactggaacccagctgcggagaaggtgtagggatcagtggagtgtgcaccatctccgggacaggtggctgtgctgctgtcgggtccactatgtaaggtgctgactcggtagctagcatactagcctctcccagaagagcgtggaacgccggtgggtacggcggggtgaggaagaagtagcggtcacggcctactgctgtggaagtagaagcccctgtggtgctgatcttggctactcgaagctgctcctccagctggctgacgtgctcctgactctctctcagctgctcctcaagagtatccatcatcccgcggcgatcgttgtactggtcagataactgctggaactggtcgccgtggacctggagctgtgccttcagtaagtctatctcactgccccaagcctggtgctcctcctccaactgaagctgctgcactgagaggtcagtcaactcagtctccagctctcccatacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgctctcctcccggaacgggtgatgagcaaactcggtactcactaactcagctcggtggatagagctgagtcggaggaaggcctcccgggctgcatcctgcatcgcggtatctggcaggtctcggtggtgacgtgtctgaaagctgtagtccaactcggaagggactcgggggtgaacctcgacccgagcctcccaaagtgagccacactgtctcactcggtatgacgggaacccagagtatcgcagacgcctcaacatacgatgcagctcaatgacatacccctctgattgaggtaagctcaactctcaggtagcgggtgaatccgaatctgccatctaattttaagaaaaacccaaagtcaattgagagtaaaacttgttttgtgaagaaaatagttaagagtaagatgaaaattgtaccgagttttgtaaatatagcgtttttatttttgaaagtattactaaatgggaatttctcccttggccaacttagaaaaggggtggggcgccttttggtcttttcctacagtcatatggctctgataccagctctgtggacccccgtttttataacaggaatcaatcgtgtaaacagtaccatttccctggatcacgtagtctggtacacacgaattcatagctgaaataccaagtgcacatacacgagtgtctaatacgaattattacatcataagcccgcaggcgtagtcttaaatcatcggaccgagcggtccggaatacatcccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcctgcttctgattaattttatatttgcaagggtgagtaccaaccgtactcagcaagccaccacagcaatgatgcacatgacagaggaattcaaaggatggctatggttcttttgcgcaaagcaagttttgt

SEQ ID NO: 505 - DNA, 480 bp, Oryza sativa
cggagcgtggggctcctcaccgggagaccgcgcaggccccttttcccggttcggccgggggcgctaagtgaggttcttcgccctcgatcggtctggggaatgtttcgcgagagagtaaatgcgcaagacacgggcgatgtagacaggttcgggccgctgagaagcgtaataccctactcctgtgttctggtggatctgtgtatgaaggagttacaaagagttggagagcaagagagttcccactctagagcccctctcactcctcttttctccagtctacttgctcaggtctcctctagtctttttttccgtccctccttttttttggtcccccctcttcgtaggcatggtcctccttttatatctcaaggggataccacatacaccatttctacctacccttcttttgggtggggacccatcctactttgaccaaaacttggctcgtactttcgcctaacaccgggataaccctgtcct

SEQ ID NO: 506 - DNA, 660 bp, Oryza sativa
attacaaaacctttacaaatatttattttaacaattaatttaactacaaatatacatgacacatcattgttaagaatagtttagtaaaaagttaatacctagcctttaaaaaagcacaattattttaaaaacatggtacaaactcaggtgctcataacaagtgcatacttatccctatgaacattgacggagcgtggggctcctcaccgggagaccgggcaggccccctttgacggttcggccgggggcgctaagtgaggttcttcgccctcgatcggtctggggaatgtttcgcgagagagtaaatgcgcaagacatgggcgatgtagacaggttcgggccgctgagaagcataataccctactcctgtgttctggtggatctgagtatgaaggagttacaaagagctggagagcaagagagttcccactctagagcccctctcactcctcttttctccagtctacttgctcaggtctcctctagtctttttttccgtccctccttttttttggtcccccctcttagtaggcatggtccttcttttatatctcaaggggataccacatacaccatttgtacctacccttcttttgggtcgggacccatcctactttgacaaaacttggctcgtactttcgactgacaccggataaccct

SEQ ID NO: 507 - DNA, 1176 bp, Oryza sativa
tcatcacagatattacaaccattttgtaactctcactgatatcatgttaggactccgttttaggtcagaacaattcttctactcaaatattttatacaaaatttagccctaattagaaagagttattactacaattttttcaaatcaatctctaaataaaatgaccctcacctgaaatgaaagaaagtatatgcataaagatgagacataattcaaagttcaaacctaactggtcaaaagttttcaatcagaggagtgcgcttcaaattataacatgttcggtactcacatattctaccatttttttaactcactgatcaagctctaaaccagagggctctgtttcaaattagaacaattctgttaatcatagattttgtaaaaaaaaattagccctaatcaggaagagttattattccttgcatggttataaataaatatggccaaaaaaactatgtggtacttcaatggtgctgtagaaatgcttcaaaagggaaggttcataccttatcacagatttcccaattactcccatatcaagttatcaaccatatacatccaatgatatgcaaattgcaaacctgcgcacattcagataaccaacctggaatagcaatatgcctatcttcattgagatttgagtcattgatcatgcatgaaacaatgtatctgaatagaatagaaagaaccaaactcagtttcactaactgcaaacaaaagtagcacgaattgatcaaggccaactgcatagtactaaattcaccaaaacaaaaaggaaaagtgcagcatgatagtattcattaagcaggatatcctgcagcatgatagtattcattaagcaggatatccattccacgtgcagtaggcaaaaatgagcaaaaaaaaatcaaattcaaaattctagagcttataactggatatcttatatagagcaatttatttgggcaaggagtaaagaacagagagttgcacacgtctgaaatgataaaactcactggaccttactatgcagtgtccatgtaaaaggctgtttcagggagagccttgacctagctgcaatctagtagtactcttttcatgcaaaaatcctaatcctaagaaccaaaataccaataaaatcttggatttaattcctaggataatttatcttacttcagatgtgaagtaactgtaagc

SEQ ID NO: 508 - DNA, 10569 bp, Oryza sativa
gctactctaatgacatgtgaacccaaatggcatgtaattctgaacatacatacattagcacaacttgaaaagaaaaaaaatgaatcgatcgttgctatctcaggctagatcaagtcctaataatttttagtcatggataccaaatgaacgggatgaaaattttagtcatggataccaaatgaacgggatgaaaacattgattttatttgcacagtttgtactacactttaaccatcagaaaaacaaacacctcggagaaacttgacaacacttcaatcaggggagaaggaggcggcgacaacaaattggggatcagcgtcgactgaacccggcggcgctcccgacgaggagagggaatcggcgacgtgacggcgcgacggaggcgggggatcggcaagaacggggcagaggagatgcgggatcagtgacggcgacctgggaacaggggtttgacgatgccgcgacttggatcggcacgacggaggcgggggatcggcgaggacttcacgcgacgacgacggaggggcggcgcgggagaggagagaaatcgtggatggggaatcggtgacgcgcgggtggggcgacgtcgggtgagtgcgagagagagagaggagagaagagctagagagaaagagaggagggtggatgcgccgtgatttcaggagtgatggggtgtgagaaggggaggcgggggagacgtggggcaacaggagcggttggattcgatgattttcatccgttagatttgatgaataaagtatgaaggatgtaagaggtagttggtgaattataggttagattattagaatataattcacaaccatgctacgagcacacgccctcgtactcacccggacggcgatggatcgccctggccctggcaaaatcctcaagttttctccgtggcatgggcgcatggcatgtgctcactttttcggtcctagcaaccggcagtagtaccaatgatgcacctttgcaccagtttacaacaataatggacgtcaattctactgaaccgccctggtgccagcatttaattcgtatcatgcattcatgcgtagcgtaggccataggctcaagcgcacgtcagttgccataaattggcctcgccggcccgaggctttcttcaactttctgcttgcaaagtttcaatacactggagtgagtcagtgaggttggtgaagcagagtgaggaaaggaggatgggaagggtggcgcctagcgtcgaggaggtcgggggcgagcagccgccgcccgcgcttgggcccggcgagaccgtgagcgggacggtggccgagctgagggcggcgtacgagagcggcaggacgcggagcctggagtggaggcagtcgcagctccgggggctcctccggctcttggcggaggaggaggccgccgcgttccgggcgctccgcgaggacctcggcaagcaccaagccgaggcctacagagacgaggttaattgattagttggcgatgaatatgcatttggcatttcccgtgtgccaaactgccaactgatcgatctgctgatatgattccgtttaacttgtatatatgcgaatggttgtgtgattttagatcggcgtgcttgtcaagtcggcgaacgccgcgctgcgtgaggtcgggaaatggatggcgccggagaaggcaagcctgatctgaccacgctttagtgtgcactgttcgattattttacatgaatggtttgcttctcctggttctgagttctgacgcctcgctggttgcaggtctgggtgccgctaatcgcgttcccggcaagggcgcagctggagccgcagccgctcggggtcatcctcgtcttctcttgctggaatgtcccgttgggtaagcaaaccatcatcaatctctcacaggtcacagcgattttttttccttcgtttacccttcttcaagcaagagcattagcagagagtgcggctgcccatgtgaagcattgtcaggaaaacggtgctactctcgcattgatgaatcggtccattaaattttcacctatactttgtcgggacaaatatagctatggctgcctgccatgcggcgatgcatgctgctagcagtacaagagtatagaagaatagcaatatatatatagcaaacgtatatacggagtattagaaggctctattcgatttattgtgtttgtgtgagggtatttaacgtcgaaaatcgctatacatatgactggtatgtccgaccagcacttagctgctactccgtaactgctctggcccacatagaggcccacatagagagaagttggtctgcgtggagcgaaacgattggtagataaggttggattggatgggggtcggacgaggaaatcggacgtatagcaacactcatttacgtcctaccgattgtctggctggccaacactccttcagctcaaagggtgtactagtaccatagctcagtgcacatgattagcttacgatagtccttgaattgtcggattcaatacagcttttgagtttaagtaacagcgaatagctgtgctatggtatcctgttgctagtagggccagttgctaacatgcaaactttgattattcgtagtagtacttcagacgaatatatctctccgtcccagaaaaactcaacatacacagagctaccactgtttcttttggtagctagtttgacgcttgatagttggaactaaagtacttttcttttgggtggcaatcagtttatacttggggcgttgtctcagaatattgcttcagtcgtcaaacccaatgttcagcatgtttctttctgaaaaaatccgaatacccctccctccccccaaaaaaaaaattgtagtactacgaattacctccctcaattaaaaaactagacattcttcatcgtcctcaatttttaataccagacgaattatccctcgaatagactccaaagtggtttaggtcctacatgacacatgtggcagtccagtcatcataaaaatacattaaaaagatagggaccacatgtactgaccaagagaagcataactgacaagtgggccccatatttgtttatatattttttatgctgattggacttccatgtgtgtgccacgtaggactgaaactgctttggagttggccttcgttcagtgtaacaagttgagggtgaaaaaatatgtttgtttttttaattgagagaggtaattcgtacggattgagatcctgactttaggtgttaaagtcagaggttaacagtaccgtgactttctacagtaaaaactgcaaatcactgttttttttactatagcaacatacttatttcactgtgtgctcaaaagggtaatttggactttctactttttttttcttttttgcaaaaacagcgtattagcatgtgtacccctgctatgctcgcctcagcataaaccaagcgacgtactccctccgtcttaaaataagtgcagttttttattattcacgtttaacgtttgaccgttcgtcttatttaaattttttttatgattagtatttttattgctattagatgataaaacatgaataatactttatgtgtgactaaatatttttaaatttttcacaaatttttcaaataagacagatggttaaacgttgggcacgaatatctatagctgcacttattttgggacggtgatagtactagctagcatgtgatacagcagtcagaattttcacaggcagtgaaattgtgaaaaacgtaaatgactgaccgttcatctgcgcgcggtctgcgcctgtggatgtcactctggctaccacaatccacagcctttgcacatgcatgcatgtaataatccagagagtagagacgcaagggtgggtgcccacgaggccatgagggacaagggtagtacactgactggctacttttgggtactgtatcaactaatcaggcaacgactttgtgtgctctatgcatgcaggcctctctctggagcctctcgttggagcattggcggccggcaatgcggtcgcgctgaagccatcggagctggcgccggccaccgctaagttcctcggcgacaacgtcggcaaatacatggacgccacggccgtgaaggtcatccagggcgggccggaggttggcgagcagctcatggaacacagatgggacaaggtccttttcaccggtaatataaccatggtccatggaggacacactggtagcttttgggtcccccggctgaaacgccgttgatatgtgttgggtttctgtcgcgcgcggcattgcagggagcccgcgcatcgcgcgcgtcgtgatggccgcggccgcgaagcacctgacgcccgtggcgcttgagctcggcgggaagtgcccctgcatcttcgacacgatcggcggcagcgcgcgggacctgcagaccgcggtgaaccgcgtcgtcgggggcaagtggtcgtcctgcgccggccaggcctgcctggccatcgactacgtcctcgtcgaggagcgcttcgtgcccgtcctggtgcgttttcacctcacgtcacgcctcctctgctttgctacccgagtcgcatttgtgcctgacgtttgtgtgtctgtctcgcggcgtgcacgtgtcggtctcgtccgaagatcaaggcgctcaagtcgacgctgaagaagttcttcgccgactcggaccacatggcgcggatcgtcaacgcgaggcacttccagcggctgagtgaccttctcaaggacaaatcggtcgcggcgtccgtcctccacgggggcacattggacgccaagaacctgtaaattctgaacaaaactgcgtgtcgttgatcaatctgtcggtaagacaacccaaagttgaccaactcacgaaaaaatttcaggtgcatcgagcccacgattctgctgaatcccccactcgactccgcgatcatgacagaggagattttcggccctctcctgcccatcatcacggtaaattaaaaagttcttaacatcctcctctatgcagagcggagtaccactagacagatcaaatgaaacggctacctttctcacaggtgaagaagatagaggacagcatcgccttcgtgagagcgcggccgaggccgctcgccgtctacgcgttcaccaaaaacgccgcactgaggcgccgaatcgtcgagaagacgtcgtcggggagcgttacgttcaacgacgcagttgtacaagtatgcacacacgccttaccccacccaggccttgcttgatgggcttcaatctcggcccatcagtttatatgggccaaactgagcccatccaaacaagaacataggaattgcagatccagtacgtactacagagttatttgatgtcatcttttcttgtggcaatcctctgcagtacgggatcgattcgctgccgttcggcggcgtcggcgagagcggattcgggcagtaccacggcaagtactccttcgagatgttcagccacaagaaggcggttctgacgagaggataccttatcgagctgacggccaggtacccgccgtgggatgacagcaagatctccatgatgcgacagctctaccgttacaattacgtcggattcgtcttaaccttcctcggtctaaagaagtgaaaatttggtgggaaggaattggtgatcgcttttgtggagttcaaagtgagtgcatttagcccaagagactactgatgagaataaatatagacttatatcgcttagtgaataagaacaagatttgcagttgctagtataaagcagcaaaaatgtactgcctgcattatataagaaaaatgcgctacctgtaatttacgtttcgtcaagaaaccaccttttaagtaaggtaaatgtaaggtactaaggtgcaatttcagtagttttgggttgaatttcagccaacaacaagcttctcttgccacccacagtcccacaccgtccgtccccttttatctcatggccaaggtggcgccatctccaccccatcatggccaccaccagcccaccgtagcgccggccaaccctctatctggtggtgctaccaccttttttcgtcgtcggagaagacgctagtattagacagtgctggaatatattgatagaatagggaaagaaaaaaaaacgattttgctagatatttgtcattaaatttcttctcccgatatttgtcgttttttttggtagtccgatatactttaagatgcgtgcacggtttggtttggatcaggacgcgtgggagtcaaaacctggtctcctcggtctcgtggcgctgttaaatttcgatttccacgccatgtccgtagccgttttttttttcttacttatcgctttctcctcgttgtctccgcgcgcgctctctctttcgttcactctcgctttcttgttctctctctcattctctccagcgagagggagagagatccatcgtttggatcgattttctccccctggattcaaccggtgagtccaatcttcgtttgtagttcccactggtgaaattttttcaacggttttttggttagttttctcgatttgaatcggtcaaggtttcgaagcttggtcctgagtcgatttcgttttcgttttagtttcagtggatccgtgatttctatgtattgttgatcagatttatatgttctaggtgattagtgccctgatctgttgatttctatgtcatgccgatgagatttatatgttcaaataattattagggaactgcctagctgttgcttttttattttgttaagttctaggtgagcagtgctctgatctgtttatttataggtaaagcgacacactatttgaaattttctaggttatttctgttttttttgcaggtgaactttcacagtaccttttccttctgtgttcatgagatgaaagattgagagggattgcccagatagagtacatggatgagattatcagcatatcaattttctgctttgtgtgatttgggattagactaaatcgtaaccaacgaactaggcatcggtggaaacgatggctggatttttttttttttgccttgtcactgagctcggatttgtggctggtagatagggattttttttgtgtttgatttgcatttttcggagtaaattgaacatccttttagcagatttacaggtttgctaggatttttcccctctgttctgttctgtcctgtacaggggattttgttatttccttctgttcttaacatgcacaactccttctgtatatgtgatatgcaagcagcagatttagtgatgaactgtgtacttgtcaaatgagagagagagagagagagagaccgccagacagagagagagagagagagagagagatgttttgaaaggtttcagcgatcttatttggctcagagatcacgaaatgaactccctgactgaagacagtgacactgctatatttctatagattatttgcttgttcaaaattttgcatgggaggcgaagagagacaactctgctttctgaaatgtttctctgtgtttcttggttcactttcacccagcacatgcctgagtaccgacggatagcaaatgatgcttcgtactagcacaccatatttttcaggactggactgggcttgcatttgttttgtgtaaactgcatatacattcggcgacgtattgcactccctggttgttgtagttgcattttcaaatctgtgcaacttcagttataaatttgtgtaatcattgatttgcttctctgtacagcttttttatgtgtctatgcttggaaaagtaggaagaagatgccacattcaacgcataagcttagctatgtttttttggcagacatctatggttctgattaggagaagaggttattttccaaggggtgcttttttcacacataagcttagctctgtttccatagttttgaatgatgcacctacatggttaatggtatataccatgtgtgtttcatatttcttaatgatgccaagtaaatctggcatggcatcttgccaatttccctgtgtgttcctgatcttattatgagcatataataactgtatcaatactttttcaggtttgctcagtgccttatttttcttttcaattatgaatgcatcccaatattgttcagtggtgctgatccaaattagttagcaacaagccactataaaatccagtattttctggcctctcattgtgttctttttgtatgttagtatcatgtagttgtctgtgttttgtttctgctggagtagaactcctactatgcacaaatctgcaaatcacttgcagcagatcagtgtatattttgtgctttgtgtgatgtggggttagcgcacagcgaatcggtgattttttttttggcttgtcactgatcttggatttgtggctggtagatggggatttcctagctccaccccagtaggattggtagggggaattaattatgacaacattatattgctgatatgtgtcatttgaatacagtaggggaagcatcgctgcaactttatctgaatgttgcattcattttcagatatttagttgactgatctgttaaacgccttgcatgtgtttgaatttttctgcatgtgaagcattttcatttcagagatgattgatctgtcaactccctgcgtatatctgaatttttatgcatatgaagaatttcgtttcacatatgcatgttaactcatccccaagtatgttttgtgttgccttcttcatcttatgaatcgcttcttttcagatatgtgcggcttgatttcccagtatgctgagttgtttggttaaatgaaatccaatcccctgcatgcgttttgccttgattcttggtttgttgctctttctgtgtatatgttgttctttggttcagaatttgttttgcttgaacaaggatagtagaacttgtatgatgctttcaggaatttaaggctggtgctttgaattttgtctctgggctagagtggggagtcttggcttcattttttttttttgctgaatttgatgttctttcaagttaaaaatctggatgctttttcagtgcgtacccccttttcttgggtacatgttgtgtactttcttctctgccaatgaaatgaggcagagctagcttctgactttggatggactgtatggttcttaattgacatttctgatttagtgcatgttttattagagttgttttgtgtttcttctttggggagagcatgaaatgagacaaatctttaactgtactgaatgctgaacagtgcatagtctatatatagcaatataatctgcatagtaaaagtaaatgtgaaaacatttttctgtctggtttgtgaaccagcagtatattagatttgcagctgcatataccttgtatgtctttccatgttgtatagctgacatttcaagatttaatgtctccattaattcatcttgaaactttttgaaaattcccaagttgtacacctccgatgcttgcagaaattgttatttactttttgaaaattcccaagttgtacacctccgatacttcatttgcttgcaagctgacacgtggacttagaattatgtgttgcatgaggttagtatagctcatttgtccccccttcacctgtttacatttattcgacaaagaaataaatatattcttcatttttggaaaacatgattgtacttaccagtctttcattttcgttaagaaatgtgtattgatcataaagtatttgtgctttatttttgccaatctctgatccaattgttgctgattttttgcctttttccaaaatcctggaggtaatgagatcctagaactgaaaatgaaagcatcattagtcaaaatttgagttttgcaaaaaaaaatcatatgatgttgacaaaatgaaaggctttttttattgttttgacaccatttttgaggctaaatactgcttgatttatatttttgaatctgaataagtcccactctattagttttgctttcacatactactgcattatccttagcctctaattcttcatatgatgttgattttgcttaatgtattccccttatagtccagttacagtccatatacactgtagttacagttgtaacttttattatttctcactgtaactgaatgcaggtagttagattatttttatttatcatgcttcacctctaatttttaatgtatataaatttgtgctagatgaaaatttctacaaatatcatatatggtgccaatgacaggtaagcatgattttctgaccttgaattgtcttcttgcttcttaattctttggagtcgattatgtcacttacacatgtctttgattgtgtattccctgtaacttgagcctgcaatctatgacatcctgcatgttttgggtcattttataacatgttacaatatggaataatgctgatgctattgaattttaggagaaagttaagcatgattccagttacagtccatatgcactgtagttacagctgtaacttttgttatttctaactgtaactgaattaaggtagttagattatttttatttatcatgcttcacctctaatttttgccttatataatttgtactagatgaaattttcaacaaagatcagatatggtgcataataataggtaagcatgttttttctaaccttcaactgtattgtttcttctta

SEQ ID NO: 509 - DNA, 31104 bp, Oryza sativa
cttcatgacctgcaactggagaaaattgaagttttcatgagaaactacagtgttatgtttggtaagtatgaaaggttcattaatataatttgttcaataggtcaaaatagtttgatttctattttgagttaattgggaacaatatagtatctatttatagttgtttatgtacttttcatctgtagtggttcttttttcttggtgtccaacttgatgtccttagttgattctacagctgagattgttcctgcaaaatgtaaataaaagcattacaaaatgtaattacaataattctaacttaaaacataattacagtacaactcagtgaagttacagtggaactatacctcagttacatttgcaattataactgactgttctaatcttatgtaattttgttaagttttgaaatagtatttcagttctcaatttcattgatagtagacatgattttctggttgaagataggccatcatttaggtaatttataatatgatttagatcatgttatagtagggaataatgttgatgttgttgcatgagtattggatttttggacaaagttatgcatgattccagtcatagtccagttacagtccatatgcactgcagttacaggtgtaatttttgttatttctcactgtaactgaatatacagttctaattttttggttaattatcactgtaatttttgtcatgcttcatgactaattttttacatacataaatttgtgctagatgaaattttctatgaagatcagatatgatgcacaataataggtaagcatgattttctaaccttcaactgtcttctttcttcttaattcttcagttgtatttcctgttacttgagactttgttctatcaacccctgcatgtaatttaaatcaagtatggttggtgcatgtaataaaaatatttaaaaagcatgttagttttatatgttctaggtaatctgactacctaacttaaatatttttggatttcatgcagtctgaaaatacagtaattctaacttaaaacatacttacagtacaactcgtcaccatttacagtccagttacagtggaaatatacctaagttacagttgtaatttctgttatctctcactgtaactgactgttggtagttagattttgtaattgattgaccttgggtatattactgatttgtgtgaaaactaggacacttgtagtttgggaaccctagggactctttttgtcagttgtgcatgcataagttagaatatgtgtacttttagtttcataaaaacaatagtgagtttgtattgcttccccttatgttgtagattttttttccagtcaatgcagtgtagggttatcatccatttttgaattaattagatgtttttactgaaattagcttgccttcttgtgccattgcaagtgtgaggccgcttcatttatgttgtctgttaatgtatgcaaccaacattaactttctttctttgtcttgcatagattctgctttgtttttgcttaacaagtgctgcccgggacataactcttatgtgtctacttattcctttcattaaaacagaaaaggagaactagccaggtaaattctatgatcgtcaaactttttcttgcagaaaaatttatggatgtatagctccatgtttttttattggttgcatttatgtggatgtcagcttcaatatatgttttctattaggaaattacccacaaaaaatatatctcttgaggcatttgaatggctgatcttaaaccttgtatcttttttgatttagttatggtatttgatgcccacttctttcatctggggatttagtttagttttcaaattgtattttcagttttgaatctttgatttaacagatgaagtcaatattttaggtttcatgcagtcctaaaacacacttacagtgcaactcacaccacttacagtggaaatataccttagttacagttgtaatttttattatttcgcactgtaactgactattggtagttagattggtaattattgatattggttttatcagagacttgtagtttggggaaccctaggcatctttattttcttagatatgtgcctgatatattttttttttgctagttagtaatgtaggcctagttttgtactgtttttttttctgttatctctatttctcttgggagaatatagattgacctgaggcttcttccttgatagaagcttgacatactgtctctagtttacttccattgcttagcatggaatttttaggtttagtgtggtgcccgttatctcacaagttatctgagatagcaactgttgaggaatttttgtctctaatttcagatgtgcaagatattcttatctataatttttagatgtgtccacatgacattttcatttttttggtctattgttctctgtgtgatattgactgggttatatgtgtactttttagcaactttgttttggcttttgttgctcttgcatgtgttgattctgggagcaagggccttggagctgcttggattgtgggatgacagcaatggtcagtaaatgaaatatttgttccttatattttgttttgagttccttttttgaattgtcttctgctgtgcttgctatctaggaaatcaatcatttgttttttttgaactgttgtacaggaaattgatgtcaacgtgggtgaaggtaagttttgttagcagagaaattattcttatcctctgagcattcataaatcttgggttcttttgttgctggaagtgtagtaaaatttgttctttttgctcctcattttggcggtacagggatcatgttcattgaaggacatactagttgtgatcaacagaatatgttttgggatgcaaaagttagagatatgtgcactgtatgatgtatgttcttctggtgccctatgtttccccttatttcaatatgaaacttatagcttattagaaggatctttttgaatcaaaagtcatgtttccctactcagtactgcttgatgtaaaggaatccaaaatttcatgcaatttccctaagagttttcaaatctgagttgtttttgtttgattttgatactgtatggcatatccggtgaaatcaacaacaaaaaggtaaagtggaacttacctgggagattatttgttgttgatttgatcttcttgacctccatgttcttggttagaatctgcttctttttctttttctctttctcgtagctgtccatggcgtgctcgatttctcctgattgatctgtggatttccttttgtgtgaagtagcgtgatctgtgtgatctctgccttttttttgtctttttgtgacctttttggtttgcaagtccccttgtaatggtttttttttgttatttttgggctgttataaagttgtcctgtgtttttgggctgctcactttgaatcatgggatttaaattttttttttgtattttctatgtgggcttgatttacagcccatgttgtcttttgattttgtccggacagaaaaaatatgtttatgaccttttttccctgtcctttggatgctaatccaaaggcaaaaaaaaatctgggtgattttggcccaagaatttgtcgacaaatagatagggagttcaaaaaaaatacaaattgttatttaccgggcttcatctaaacgaggcctgggaagggaaagtctttacggaattcctcccaaaacggtatatacacacatacatagaattcagcccagtcctttagaccccagcccttagtaattttacacaaagtttaggctctgcaagtttgcacgattgcacctgtatttctctttcctactcgaacaattacgatggcgaaataatattttacatgataaggaaaatgaatggcaacaacaagcacgagctggcgatcaattgcgccgccgagacgcgcgagtccgggcctccgttgggcagcaaggggtactgatccggcggtggcatgacgcactcgtggccgtcgaagtacaccctcctcgggaacgcccatccaccggagaaggtgaagtcgctcttgtccttcttcagtatcatctccgtctgcacattaccgtcctgcagcatcatctcgttgtagtactggatcccccagaacatccccgtgtcgtctgcaaaatcaaacaacaacttctgtggttcactctgttcatccaattcgaacggagatcatgctaaagtgagtgatacctactcagggtgccgtactcgatgagaggctggtagttgaagctgaacagctgcgtcaggctccggaggttcgggtgctgcaccaccaggttccagtcgctgtagttcttgacctggttgtagttggtgatcgtcaccttcaccctccagtactcacggtagctgatcttcacgtgccagtgcacccggactgggcacatgtggtcggtgcaccggaagaccggcgcgaccgcctcaccgtcgccggccggcagctccggcttctcgccctcgctggaaaattaaaccaaccaaaaatgcagatgagtgagtgggatatatagcacaggatttaagcggtgtgggaaacgagggtgcgcggggggttttgcctgatgcattgcggcgccgtgggggatcgtgggcagccgcagctgcaacgcggacacggcacgatcgtgctgttgtagaacgacgagagggagacccagcacgtcggcgacgcggcctccatgaactgcgagtacgtgcaggtgacctgccatgtcactgcacacggcgcccgcgcgcgcggcagcaagaatcgttcagaactcccgctcaacgcacgcgccgcgataaagaaagaaaggggagaagccttacgcagagactggacgtgccggtgcctgccgatcggtgacctggtcgcgttcaccttggtggcgttgctgcaggagtacccgggcactccgacgccgaagcgtgacggcagcgcggggcccctgtcgccgtcgtggtacgtggcgcgcctgaagccgccgaccaccatctggaacgccgcggtggacgtccggttgttctgcgtgagcgacgacagcacgccgccccggcagcagctggagacctggttgttgtacggcgtgccggggggcaggtccacgatgaccggttgcttctcgcagcaatgcggccgggtggcgccacggatccggtggcagtcgccctgctccgtcgcctccgcgcccgtcatgccccagatgatctcgttgccagcccacctccagctcagccgccacccgggctgctcgatgtggcggtacagctggtgattgtggacgctcaccatgacctgcataagcacaggatatatcgattgattcgtggtgttggcggttgcgaacgtcaaattttttttgtcagaatatcgtatttcggctgtactaatgataagtttcaccggaggaaataatggggaaaagttagaatcgagataaaaaggatagttgcaacgatggtacgtctgaaattctgaatcttttattcgactgcatatctactactgggatgatcccaaacagtgaaaaattaacggcagtactaaactcactagcaggcatgcgcaccgtgtagacgttctcgatgctctgaaaatcccagttgattatgatgttcccattcggatctaccggatcatacgcatctgtcaaaacatagagaaaacaaatcaccgaccgtagttcaatcaatcaaacctaagaacaacactcggagggcaaacacgacggcgatgtccaagaaacagcacgggaaacaaacatgacttgaatatcacagagctcaccagcaaacctcgaggacaaacagcacacaaagacgaacaggatcagctggtccacgtccatcgctccgagccccgaaggattgattctttagcccccacaaaatcacaagcgaaccagagaaaaattcgaacccaatttttttctcaacggggcacctcgcaccaggttcgcgtaggcgacaaagggaagaggaaggagcagcagagagggtacgaggaagacgacaggatcagcagatgaatccggtcgctgatgtgacacgaacggcagcattagcctcgaattaaacgccaaagatagcgggtactactactcgtattaacatactactccattcatccattggcaatgagttgctcgttttctggtggcactgtgccagtgcgatcacgatttggaaagccatcccggattggtcacgaagggttcctcccctctgcaacatcgccaacaccggatgacgcgcatggttgccagatatggagggaagttttgaatcgagtggactggagcacgctgacgcgtggggtccactggggtgatgaggaaacttggccgagacatttctgtaggcgggacagtgtccaaaaggaaacatttctgtaggcgggactgtttatgacttcgtttcaatgagatgaacgatgaacaatgggggaaatgtaattgatgctctttcttggaccacggagtgagctccgtgatgttaaaaagatctgtaggatgcacagtaaaaaaagagttacctcgtttgctgcttgcatatccaccatgttcttcactcctcgcaaaaaaaataaaaatcagttctttaccatgttgttgtatgttgttgtacacgcaaaagagaaataaatggagacatcatctttgagcccaccatatttcagcgaacggcccatcaccactgagcccataacagagcgttctatgggataacgagcagtctttgggcaattgggttccgttcattttgcaaccttggcccctcttcccctcaaatggatcaaacagagtgggaaaaagtacatcaatgtccctcatcttgtcgtcgaattataaaatcgtccctcaacccaaaaaacagatatatgacatccttcaacttataaaactaggtcactctgagtccttaggcggtattgaccatagttttgtccgacgtggaggctgagtcagcattggacccacgtgtgccctacatgtcagcggccaaccctgatccctcatctccctctttcctccgttcgtgcatggggtagaagcaggcggcggcgcttcggcgagttcaagcaggggcacggcagcctaggagttcgaggggactatggcggagctcgaggtggcggtggatgggcacgggaaattgtgaggcaacaacgcaccgtgtggtccggtggcacccgaacagaggtggcagcaggagggagcaccggtggcattctgatagcagaatcattggggccggagaggggaaatgaagtaccttgcatggataattcatttttaccttcaatttggtaggattggcgatgtgtgcgatgaatttaggagccaagtgagtggcaactggattagggttccgggaatttttcctccggcgatggtgattgagtcggcgaaggtaggtgcagactgtggagagtggaagaggtcgatactgcggttcttttgcctctagtcttgagtctcctggttgaaagatggaggagatatggtggcaaaaagcaggcaaactcgaagaaagacagtaagtaacgtttaaggcaaaaaaaaatgcaacaccactaatcgatctctatatgtaaaaaaaactccataaatccatcaacatggctcacatccatccactgaaaattagcagttagctgcactcactaacaaatcgtagacaaaaccgaaccgggcaccgaaccgcttgagctcctggttcactaggtcactggttggaccgctgggtcgaccgattcgattgttgaaccggaaagtatatttatcatacataatccgacgtaaacaaggttaccaacttagcttggtggtgtggttgatgcgcttctattccatcaaccagggattgatccctatgtgatgcactttttcctcattttaggcaaataaaagataattgggccgcaacaatccaagtgggccttagaatctagccatctgcttcacgaaccggcggttcaaaatagccagggccgccgtttttcctcaaaaaccatccggttcatccggtttgcaccggttccattgcatgtgcggtccttaaaacaaactgacctggtgagagtgatggttccgtttttctcggttcaaccgctgggccggtccgttttttgtactacggtgaggatgtagtacgtccgcttcccgtcgatgcccattgactacaacagcgtctcaagatgatgaccttggcaaattagacgatgttggagacgtagaacaacgttgttagcgccgatgggatgacgagctctgactgcatgaaaacaatggcagaaattagtcaggcaatcgagtcgagcggcgggagcacgacggagaagatggtttcgaggtaggtggagtagctaccgaagtagctcatccctaccgccaacgatgacgacacaggggggcggcaatggtgcccgacgatggaggggaagagaaagagagagaaagaggtggaccggagggggaagaggagggagccgaagaggaggaaagagtgacgcgacagtgggatgggacgagacggcgacagtcgcacgcgccggccgctgctcgcgccgtgatgatgggggagaggtggtaaggggaagaagaaggtgaggtgtcactgatatgtggggtccgcgtgggtcctacgctgactaggacagaaccaaagtcaatgccgcctaaagacccagagtgaccatgttttgtcagtcgagggatgatagtttttttggttgagggatcattttgaaattcaatgacaagatgagggacctcacatgcactttttccaacagggtgtgattagcgtagcccaaagtcgatccgctcgtgatgccgagtgcttaagctttcagtcttgagcttgctgctaactggaagtgattattaccatctactcaaaatttaggggatgtttagattgatcatttcaaaccatactaattttttaaagttgttaaaaatgtgcatatattttttaaaaaaactttgtaaattcataagaaatccgatcaaaattttagtaatattgtcaacttactaaaatttggttagatttattttggctacaatatgaaaagctccttagtgaagcacttctgttgacgggtcgcttaaacagatacgaatgcttgctcagtaacggtgatcgccgcacgttcagcttgcgctgcaacatcctgaaaacttcataacctaatggaagagtcacaaaatctgatttgcagtacagaagatgcagaggggtgaacgtgcagattaaatggcagaccgtacagttcgacatgttcgcaaggggcgtataattctttgccgcccaaagaggacactaccactcacattaattccccaaacattcaggagtcagggattcatccaagacacgcgttaagctcaaaatcaacatccactactaaattcctaatcttctaacgctactacctcagtacactggtacacaagcatcgtacatttcgtactggctgtggctgataagcgcacgtttttttttcaccagtacaagcagggaggcgacgccctgggtcgcttgctgccggcgccccactccgcgttcatctgcggcacccaccgctcgcggctggcccgctcgtcggcggcgacagcgacgccactgtgcagctgctcccggccggcccacgccgcgtaaccgtccggcaccccaccgatctgagccagcagcccaccctgcacgaaggaaagcagcgaaatgccaattgccacatgagtccaagcacaagcttctagcgaccttactgttttgaacatgcagacagagtacgggaaattttcaaatagggaaagcagggaacaatctgctcgtgaggggaggatgaatatgatatgcaggtttacgggaaattattctaaactcttaagaaaatatctttttgttgcttgtggcatatcacttcataaacatgtgaattcaaattcaatttatatatctcataacgaaaaaatatattaaactacagctagctagttaacgtataaatacaattaaatttatttttttcgttacaatatatataaattgaattttaacttgtatgtttatgaagtgatatatcacatattagtacatcttctcaaatttttttataactatttgagcgacatacaaacaatgagtgaacgtccccttcaaagtttaaaatccaccctcatggatttatcgcttagtattttatttttgtggtctccacaggatattatcctgacaccctggtccagcaattacatatattttttgttattgctagctgtgtgagcatgactacaaactacctgcatggtaaaatttgtccgctcacgatattgtgaacagattggcttatgtgcccacgacggccggcagggcctgaacagagtttggcgcgccgtgctttgcctgtgcttcgttcatggtgctcacaagaacgtgtgtggattggtttttcagggtttcatgcatgaaccggactgaatacgtattcaggttttcgttgccatggaaagtttggatcgttaacagtggatgaactgacctgaaatagcccgtctgaggaggaggaggcggcggtggcctcgtcgacgaggaagtcctcgacgtgccaaccgggcagcgtcttggtgaggtactcggagatgctgctcccgtcgctcgcgctccccgcggcggtgccggcgacgctgctggggctgcagctgtagtcctcccctgcttcctcctcctcttcctccgacggcgcgggggagtccatcggcgccgacgagaggcgcacgccggtgaggaggaaccggccgtgccgcctcgtcagctcgctcgtggtgtgcaccgtgacgtcgcactcccggcacaggatcgccctgtcctccttgcagaacaagaaccccctcttctcctgaagtgacgagagtccacacgcttcagagttgcagcaagcaacagaagcaacccgaggaaaaagagcagcagcctctcgccgcgtgcatacctgacagatgtcgcagagcggtggcttctgggcggacgacgacgacgccaacggttggaggagggagaatcggcggtgcttcccggcgagcttgttcgcgctgtggacgcggcggtcgcacgcgtcgcacagcgcggcctcgtcggcgcagcagaagaccgaggcggcctcggccgcgcacacgtcgcactgcaccttcatgtctccccgtccagtccgatcgatcggcagagacagctaacgaagcgggaaagaaagatggtcgcgtctcggccgggaggggatgcagataaggcagaagcgcacaacaagctcaggtcaatgccttgggttagaggactaacgacgatgttgcaaggagaagtagagtggtaggttattaggagtggacgagtggtagttgtagtgcacgagagagtagatgtgtttatatattgggcggcggcagtggcacggccggttttaggccgaggtgaaaggaaaataaagctgaaaaggcggtgtcccctgcaaatcaacctaaccctgatttgtgaaagtcttatgaatcgtgttcgtgctgattgggagatgactatactacatggtagtgatcagggcttgtgagagaagtaaccttaattattgccaggactaatcaactccatgttgtatgtgcatctggtgctctaagcaatactttttctctgtactaagaaaagaacaactagcacattttgtaggacaagttactgtctagtaaatcgtttcttcggcacaatatggcgaataaatattgcaggagaagcgggcaaaaaggtcgttctgtcgagatcaattatatatccaataaataagaaaaaatcaggctccatcatgctttcatatcgagaaaaaaatgttgaaaaggaaaagcgcactcgttttcgggaccacatgcgctgattctatcaaggtctgatcatcttcacccgagctaaatctgtccaattaagctcgtttccacgtgcagtaacagtgtgtttacagtagtattgacagctgacagtaaaaatgttacctttcacacctggtgccgtactcacgtcacgacgagctcgtgctgagattttttttttctcaacgcatgcttttgtcaataatttgcaaggatcatgccacatagccaggtaatgcaaaatgttttattatagttagtgtacacaatatcttaagaaataaattacatcccaggagttagtgcacacaatattaattgataactctgtcttgtgcaacaagtgcaactgagagaggatgatgaatttgtaaagctgagttgctgtgatcgccagtttcctctgaacttctgtagagaagaagtcacgcattaccattcccacgtcgcattatctcacctttcggttgaatggactgaagaaagttcaagccttgtgcggcttaatgatcaatttgattagacgttccaggattgtggtcgtggatcatgccatgatgggcatgaaatgggctgttgatggtgatcagaggtcagacatggccgcatgggcgctccaaggtcatgatcaccaacaaggacatcgtcttccaaggctccaacttgatccctcttctgcaatttgcattcttcagttaacactttcaaaaatatgatttcttcacaaactttccacatcgacatggtttagatgttgttcttttctcctaaagataaagatgaagatgaagattaagttttttttacgcaaaacgaggtggtattaacgtatgattgattgagttttaattattacaaacttgaaaaatagattaatacgatattttagagcaactttcatatagaaatgtttcgcacgaaacgtaccgttagtagtttgaaaagcgtgccacgaaaatcttaatcttcatccaactctggttggaaaaaagaacgggacctaaccacttgttagtaatatgtaagttctatccttcaaccttcagacttcattcataatttatatgaaaataacgtgtcctatagcgaagggaagaagaagaaatacgagccgatcaacgctgaacttttcttttatcgcatcatatatgcatgaacaaggcccatgttgctgattttgtaccaccgaaccgaatagtattaatcatatgtttgtgagtttgtttgttggagtggatctaaattcaagagacattatttaataggggacatttgcacatgttgtgtcctatggcttaatagaatgacatttttttaacaacactccaattaaatcttatatgcacgtactatacaaggtagcacactaagttcggtatgggcccagttgcaaaagagcgaggagtaccacttcacaaaatcgcattgagatgatcttgagaaacatctcgatctcctacaacctctcataatcgatgctttgatctcgattcctctgtcgccttgcccctactaactaccggattcattcattggactcaacagctctagaacgctagtgcatttgctcgctcacaccatctaagggggacaaagaagaagagttccatccaatgccacttcacgttgcacgaatagatccgggcacaaacatctccaatccaatggtactttggccctagataaaacattgctccctaaccatttctggcacctccagcgagcccttcgtctgctcctcgccttcctccctccctggttgccgctagcatcaccactgagctcatcgctgtcctgccaaagcccctccttgctgcaatcacctccaatccacgtaactagatctggacaaggaaaccaacgatctaacaaccaccgcgcctagagcaattgcccgtccacaatagaacactagaaagcactatcacaaacagcaaccgctcttggtgtcaccactagggccatcgccactggagagcaccggcaacgccaccatcaaggcagagatttagtgataggattaattcccgaacaatgtcatttcatcaaaactgttgttgaatgacaaacatttttgttgaaaggtaggcttcactcggagcggtaggaaaaggaaaacagtaaaaatatattaattgaaaaatcggatcctctattaaaaaaccattgggatctattaatgcgtttacaacctagggtttttgtatgctagtgaatttacatggttgtccctctggcggggatgtttataagggtaacatttatcttttggcccaaccagccggcccatggaccttatcagggtcctcctaggttgtttattaggcttctcctagtattagcatatcctagccgaacttgcttcaccacctaatgaacccgctttgccactaggggtttcgccacccggtgcttcgcttcgtggtgtggccttgctccatggcctaggcttcgtcgtatgccccttccccaagctccttcacttgttactgttgttgttttagcaagttggccgaaggtcctcatggcctacctccaacggaaagtttgttggtgtcttacctttaggattcattcatgcaggtatttgtgatgtaaactttataacaattggcttttcaagctaaggccaggacttcccataccttaaagttatatgcatgaacataaatgccatatttttatctatggaattctgctgataaaaacatttgcatattctaaaattctcaatctctaaccgaattaagtacaattaaaatggatacatgatacatatgtatggtcgcaggcttagcaaccttgcaaggggagtggattctaatccctcaaggggatgtcccctcgtatacctttttctttcaaacttgatgtaaatagttgtgaaaaattctaaaagaaaattgacaatgtagagtatagagatatccatcggtccactaaaaattaagtttaaattcagcctattattcatacgctgaatttatctttttatatatatatatatatatgtcggagtatgagatgagtttgaacctaagattttgtggagttgtatagatatgttgtgtgagtgttgtcaaaaattttcataaccgtttggatgaacgtttttaaacaaacgagaggatatttctgcgagatcaaaatatttttccccttgctgtacatgtgctctacaaaattgtccaattcttctgtacctttactgttatttatttatttaagaaaaacagtacgcaccctgccattcctatgaataaatactcagctacgcaagaacatggcgacagcgcattcctagatcgtgcagtttagaatactttgcgctgcacatcggaacactgcaagtgccaagtgctccaatggcagctgcaacagttgggaaattgaaaagtaaggccgtttttgctgataataacaaatccaaattcaaaaggcgtacgattcttgaacaatgctatggtcccctattattgctttgcttgcatcctaataatctaacccccaactgatcccccgaaattcctttccatttgatgtcacgggtgacctcaattaccgaaattttattaggatatgtaccctcctctctggcatagatccgctagatttggggggctaaatctacatatgcgaccattcaacaagaagaaggtcgctaggaaggaagaacagggttgacaaatttaacgtagtagtttgattatcatggttattatatcaaacttatcaagccggtacaaatagaaaaacagttcgatcaaattttgcaaaagtctgtctaaatttcactagttttcttctttaactaattggtaatcgatgtagcaacaacgtgagatttgccacagtgtgcatgaagaaagtgaaaaacgaaatggcgtgtacacccgccacaggtcgattgcaggtatagctgggtacatgtcactgtcgctgcgcatcacacttcaagttctataattccccattcgatggagacacggattaatatttgcggagaggtcagatcagccccggcaacctgcacagcggaaacaataagaaaacgcgcaggggtttctcatcatccgagttgttcattcgagaccagcgcgaaaagggcggccttggccgtatgcacttttctcggctggcgtcatgggcgtggagatcgcatcctcctggcatcatcagataagtagataatctgcgtgcatcttaccagccgtccagcagtgccgggccgcaagcatggagatacggcacgatccgttcacattgctgttgatccaacttactccgatccatatcttaattgaagatcagaaagtacagatttttttattgggttaaaaaggcaccttgagcgccttgacaaatcactcggttcgtccacccggctaaagaataatccaatcgatccgtatttgcctctgcactgaaaacttcttggcaacagtagcgctagtactgcatgtagtaccacgattacctcttggtcaggactcaggagggtgattaacaataatcacacgccattggataaagtcagaaagtcaagccgtcgttttacttgcacgtcgccaccagtccattatacgcacacgatggccacatcccccggcatcgttttatttatcggtttttcagaagcgatgcatgaaaagggctccaatttccgaataccccgagcgacagccacaagggctgcaacctgcgccacggaaaacgttttcgctccaggaaaacgaagtaattaacgaacgccgccgctgactgtagtgcgacgagagattggcacggatcgtatgtggtagccggagggagtgggtagttgccgcgcgtgccatgcggatgcaggcatcgctgtatcaccgggccctttcggagagggcatgggcaagcgccggccccgcgctttattgccggcgacagcgatacggcggcggcgtacgtgagcgggatgacggcgacgcgaccgcgatttcggaggggatcgatctggtaggccgtcggtggtagctggctggccagctgcaacggtgccgaggcgatctcacgtccgagtccgacccgaggcggcgctgctgatgcctggctggctggcgccacagcttgcaggaggctgcggcgacgctttcacggcgcgggacgataggaatattcgcgcgctaattattggtgcgatctgatctgcatcttgggagaaaagcctgcttttactcccagattattgggggaaaagcctgcttttgtcctcttcctcgttgaaacgatcagaactttcctcttgattttgggctcttcctcgttgaaacgatcagaactttcctcttgattttgggctgttcagattgatgccattttcaaccatatcattctttttataaagttgtcaaaaaaaactatgtttagtttgttactaaatttgataaatatataagaaattctgccaaaattttgacaataaattttagtaatattgccatcttaccaaaattttaatatttttaaaatttggtaaggtttattttgactacaatctagacataccctctgtctttcaatagaatcctgatctgttttagccaatgcaagtgttctactgcctgctggcaaagcgcgcgagatgacaaagattttcgtgcctatccggattgattgctcagagagaggcctgggccaggaaacaaagactttcggaaagcaaaaagcccctcatcttatcactgaattgcaaaatcatccttaaacagcaaattcaggtacaacacatccccaaacttacaaaactaatataaactacgtccctcagcggtattatcctccggttttggctgacgtagcgtctacgtggctcctttgactagttttcatcctatgtgacattgacatggcgcttacgtaacaattcaatacgagaaaaagaatgaaaaccatgggacccacatatcatttacactagaaaactaataaataaatgatgggacacttgtgagacccacatgtcatcctcattcccattttctcctctcctttctttcttcttgttttctcttctcctcgccattcggcgccgggcagagcaggcgagttcaccggccccgcctcctccctctccatcgctcaccaccagcctccccgcttctctctcttcgtcgcctaccgcctcctcctacatgttcctcgccaagcagtacaccacgacactcctgtatcggtggtcgcgacagagagagctcgcgccacaggagtaagtggtgtggagcagggtgtcggtagcgggcacaccacgtcgccggtcaaggcttcctccgcccgtgaccttttccaccacatgcaccaccatcacccccaccttgtcggcgatgatgatgacgaacttcctctatcctcccctttccctcctccgcttccccttgggctcctcctgctactatacctaggctcttgctccacaggcttaccgtgcgtcgcctcccacgaacatgccgcgtcgacgacggcatgcacctgccgccgcaaccctttcctctcccgcagcgtgagctctctccgccgcaaccaccggcaccactcacgcattggaaagagatgagggaagagaggggaaaggggaagaaaaagttgtgtttcactaacatgtgggtcccacattgactcagctgccacatcggataaaattgcagtcaaccagagtcaatactgcctaaggatataaagtgatccggttttataagttgagagatgtcatatgtctgattttccggtttagggcgattttataactcagcaacaagataagggaccttatgtgtactttttcctttcgaaagtgtgctccgtggaggtggtaggcccgttttatacctaacccttcctttctcgcttttcctttccttctagctgtggtgaggtccagttcgcaaatatctggcccattattggtcaatggtatctttcgccacatagagtatcggtcaatgggccacacgagtacttcttttcctctttggaacgggccacagtgccacaccgggggacgtcgtcctcaacgcagccatgacgcccagccgcgtcagcgtagggctcgtcccgccacctccaccgactggtgggcccgcgacgacagcgccgtttataggccagggaggcggaagaggacgcggttcgtgcgtgcgccaccgtcggccgtgcgcgagccaagccaaccaccacgagaaagaaactaacatcggaggagcgactagcgagccgtccttccccaacccctcgtcgtcgtcgtccagcctgagaaccaaacgaagaaaaaggagggggaaaaaaggggaaaacggggagaggctaccgacgcggcaggcccggccgtcctcccctctcccggtcagcgcgccgcggctttttgcgtccggagaggcggagacggggcgccatggaggcgctgtggaagcaggcctccaggctcaaggagcaggtctcccgccaggtgacgctctcccatccccctcgatctctttgaactcctgtgttagtacggttctcgatcgatccgagtttgtgattgcgcaaccggggtgggtcgatgtcgatccctctcaggtgtctgtcttgttcgatccggtctctatataagtttgatttgatgtctatgctgatgggttttgagaggctaccgtactcgtctatggttaggcgtctcaggttgattttcattcatgctggcgagtggtgaaatgaattgtgagggggaggtccaagcttttgctctcgaaaaaaacaattgtgagggttgggaccgcgatgcgcgtgtttgcaatccctgagatgagaaacatcaggttatgattttacgacagggttgatcaatctggttaagctattagcaacctgtggcttttctatttaaaagcgttgctcgtgattcctgttcgaaatatagaaccatgtaaacatgacctacccgaatttgctgttttgagtaataccgccttgattattttcatccatcttgcacaaacataggagggttggccgaaaggagttacactgccttaggaagacagctaagattagcagtctacacaacaaagtagggaacaatatctggtatctattcaggtgttctggtttcgtactgtaggcctatactactatttccttgctatgagttttgcctggaatatatagtctttgaaaacggatgttccaatgttaggagttgttattactaatgtctgcgatttgcaaagtaactggaaactctagggctgttaaatgccagctacatatctgccttcacatggaatatatactgcattatctttatatgttgtgggatattttcttggtatttaactgcatcgaaaagtcagctctttttaatcttggtatgaaccatgtaacattgtacctgtctacaccattgcagggcgtgtttaagccatttggagctgcctatggaaattcagaaaatgcgtttacagatgaatcagaagttaatctacaccagaggctggaaaaactttacttatcaactcgtgctgctaaagtatgagcaagacaaatttattagagaaacagtatctctttcctttctacctagattattttgataaacattggcatcttttggccagcattttcaaagggacattgtccggggtgtggagggatacatagtcactggatctaaacaagttgacataggtatgtttctccaactatatattagcttatcagaataattttagcttgacacaatattaattactcagtgtttacattactgtatgttgattagttgcaacctaaatttataggaaataaattgtccgacgatagccagaaatatggcactggaaacacatgtacaagtgataacactttatccaaggctgctatgtactatgggaaggctcgttctctgatggaaaaggaacgtgggaacatgttgagagcatttggtacacaggtctgttcatgacttcatgttgatcgacattttttaccttatgacatgtatgattagcatactagtagtttacctgtgcaactagttgttactatgtgcagaacaatgaggtccattcttatggtattgataaatgtgaatagaacgcataacttcagtaagagattgttggattgtaggtggcagagccactgcgagcaatggtcatgggtgcgcctttagaagatgcgagacatctagcccaaagatatgaccgaatgaggcaagaagctgaagcccaggtgaagtagtgtataacttttacttaagtctcttcaaggttatataacatcccaggatattgctctcagatgtacttacagcatatttgaaacaatatccattgacgagcaacctaagctatacaattaaaaaaatagtttgtgtattttatgattctacttccacacattcctaattccttgtaccgcaaggcttacagatgcatagtggagaaactgttattgggaaaggaaaaatgctatgaattctctgagaaccaggactatcccaaaatttctcaacatcacaatattttggaaagcatcacactatattatgtgtacggccagatcttgtcgaccttatttatctatagaatctccataacttgaaactctaaaatatggtcacttgcaagttgcaaagcaataataccagtgacattgccaagttgccttcagttgcacgcagactttgttatctaagatcctactatcttctcagatcatgtgattagttgagtcattccaaaacataagtaatttgtgttccttttctgtgcattgaccttttggtttaaactgaactgtttagcttatttttttctgttcgctttcctaggctgttgaagtttcaagacggcaaaacagagtaagagagtcagctccgaatggagatgtgataacaaagctggaagctgctgaatacaaacttgaagaacttaagtcaagcatggtaggattagggaaggaagctgttgcagcaatggctgccgttgaggctcagcaacaaagattgacattacagcgccttattgcgatggtaaccatgagctatacccgttaacgttacattttctggtgcatcatgctattgcatttatctgaaaattatatatagctgctaatcagtcttgctctgaaggttgaagccgaaagagcctaccatcagagagttctggagatccttgaccacctggaacaagaagtatgtatactccagcactatttacattttttttaaaacatggcctgttgacacagcccacacactgtcaagtgtgcagaagtcctatcttcatcaagttaatgattattttttgattggtttagatggtatcagagcgtcaaaagattgaagcacctccgaccccatcagcagaaaattacatggcacagccaccaccatcttatgacgaagtcaatggcatgtttgcatcctcctctgtcgatgattcagtgacatctgtagatttcttcctaggagaggtctggcattcttttcatgcaaaatctattgcaccatctgccaaatgaacatgaatttaccgatgttatgcttcttacataaattgtttggtcgttatgatgcaggcccttgattccttcaaggctgaaagtgagtctgagcttaacttgtcagctggagacattgttattgtccggaaggtaatatacctctgctgtccatgttttgtaatcttcaattgagttgccgatattgttccgatgtttctaaatacaagttcctggcagctaacatatcataattgagctgtcagtaatctaatgtggtcttgtccgaacacagatatcaaccaatggttgggcagaaggcgaatgcaagggaaaagcaggatggttcccacatggttatatcgaaagacgagagcgagttctagctagcaaggttccacatattttctaggagttcgaggataaatgtgtgtagttttgatttcaaatgttgaaacagtatattcgtcttctttgcccccacttatagcttccacgtgatgctttctgattcatgtgtatagactacacttcgtgttatttacaagttttgaatggtatagtttgtaagacatttcggtagactgaattggcactagagggccttacatagttgaaccctggtttccaaagggagtaaagtatttactgaggcagttcgtaaccttcttttttatccctgtgtatacacaatggccaatccaaaagagaatgctactggaggtgaaacggtcaacctgaagctaccaaaccatcggattctggaagaaaattaaacagactaacctaacctttcatgctcgtaacttgtgggctgtggctgttccgtgttccagatgctgatgggaacaagatggcgtggaaatcaaagctttgtcaaggcagatcaacgatgccctgaacagaccgattctgtatggcttcacgcatgcctccaccagaatccggcccgtttcctgtaagcaagcagacgaaactgctggcgagaaggtgttccaacttctaactaagggcggtaatcctttcctgaatgcttagatttaccaattaccattgactggaccaccccgttcaagaagagcagacggaatcggtgtaaaagtgaaagtgaaaacgccaaaggtgcaaaacgaagtactagtatcgacatgttgcagagttagcagtgcattagattatcagtttagcacccaccacttcttgcaggtttaatcagtgtcggatggtccacttgggacagtggccagtcggcagagccttatcgaaatggttgtgtgctttgggcctcacaaactgaccgaattaatgaaagcaatgcgacaacagcaaaaaacaccatgatcactgatcgagggggtgttgcgagaatcgaactcgcgacctctcgcacccgaagcgagaatcataccactagaccaaacacccagtttgattacttctttatcttgtattttcaaatcctaatacaatgtagcatgagtctgcagtgctcgcaggccgcagcttggtgtattcagagcccgggaatattttgagctccaatatatacagagtacagacgaagcagaagacggtacaaactactacaaaacagtgaacagcgacgtctttatgcatatcatgcgtcttctccggaacacgcatgcatacctccccgaacggaaaatgaaattgatgacacgagtaaaacctaaaaagagttgcatcacccacagcaaccactccgtgccgatgtgtcatgcagcacatacgcctcgcctcatggagtgacttcatcgctgatttgctggtgacctaccgatccaatcgatcgcttatctcctccagtgggtaaacggaaatcagttatatactgcacggtgtgatctgcgattgaccccttctcttcgtcaagtggccgaggcagcgagagcgcgcgaggtggagggacgacgagtcgacgagggagatagccgccttcgccgtcggtgtcactcctgtcacctctccgacccgacccacttacagatactccctccgtttcacaatgtaagtcattttatcatttttcacatttatattgatgcgaatgaatctagacccacttacagatactccttccgtttcacaatgtaagtcattttagcattttccacgttcatattgatgcgaatgaatctagacacatcaatatgaatgtggaaaatactaaaatgacttacattgtgaaaggggggaagtagcaacgttggtaaactgccacttgatattctgaaattctgaaacatcctcaagctggataactgtcctctcgaattcgcccatatcagtaatcagccagacacctgacggagagaaagttgagaaacacacatgccaggatagaattagcaagttcttcgtcagattttgatcaaaatgattgtattccaagggaaagattgctcacactgtaaagccagtctcccccggccctccctatatacctccctagatactcctggccactgtgtggtgacagtgcgtgcgtaaattaaagtggtcaaaagtaacaggcacagcagatagtacaggcagcaagacaccacaggcaaaaaaagagagagcgagaggaagcaatccgtacccatctttccgccatgatccatcatgcaaacccagcaaaaaaaaattggaaagaaagaaacgggaggctacggctagcacgccgctccaaaaatacctggccgcgagcgagtgaggaactgcgtgtttcgccgttcgagtgcatgctaacccgctaatcattacggccctcgtaagcaagtgcctcgctttcgcgtagcacctatcattccatcgcgcccacatggacaggaggaactcatttgggaatagagggagagggatgcgtcctgcaataaccaattccctgttagtttctgttgctctgtcccttggccagaatttgccatgctactgctgggtttagcacccaaacggccagacggaatgaattgcaaacgaggaataaatggaaaggaagggctggaggccatacagcagccagccagccatatactgtacttcatggctgtgtttagatccaaagtttggatccaaacttcagtcattttccatcacatcaatatgtcatacacatgtaacttttcagtcacatcatctctaatttcaaccaaaatctaaactttgcgctgaactaaacacagccatcgttgagttttgatggatggatggaagctgaaacgagcataggaatcatcacacatgatgttgttctccaatagctcaaacctttccacttatgaattatcaactgtatagaactggagaatgagctgctacatgtatctggtagttgttgtttggctgattgatcagtactactagtaggtaggaacatgaacatctgggtatactgtatacatatataatgctgctgcttactcatttttgaagttgatattattatctgagcctccatgtgaccaccacgtagtaggcatgacggagcagacaattatagaggtttgcaagctaagctcaattcaattcaaccgcaacgctcagtacactgcaggctagagcttccattgactttcggtgctccttttcctttccatttccctgattaccaaataaagacttggttttggacggttgagatggaaagcaggttgaacggctgcttggtgaatcctctgcaacaaggcgattaattgcttccagcaatccagcgttgtcatgtatactaacaacgtttggacgaccaaataatatagccagtccgaaagtcactgctagataaagagattatcgtccctctcttttcttcggcaagctgttaagataatgatcttaccatgtatcctacttttcatactattttaaattagtgcgagttccacacgattttacgggatcgttagaatcttatataggatcctggttttacgatatgtatatattatttaagtttcatttaattgaaaataatgttaataagtctattcaagttttcaaaaaattaaatttatcaaaaatcaatgttatgggcttcggtttttaatataatgtctaacaaattatatgtgaaaatatgtactttaacctgatatgatcatgatcctaaaatccgattctacaattcgatacagttatgataaaaacgatcctactcctacctactatccctattctgacagccttgttcttcagaagttgattggcacaagagacaaaatccaggagctctgcaattcgaatctccttgtttcagcaattcagcgtcgcatggatatatataaaaaagagatgtacattttcatgctttcatgtcgcaactcgtcattttaggacccctcgtaacaaaaaaaaagtgctagtatttgaaggcgacaagttttaaagtggaaaatattctattttctcactaaaatgtggtccttggggttccatttgatatatataatggattgtggttgaaactgagtttatgataattatttaaggccagtattagaaaattaagaagttggttttaaaacattttcaaataaataataagaagaatgcttgcaaataaatcgtattgtttaacaacttatgaagcgtgtccaagataatgcatactaatcgataagccgaaaagaacagtacccgaggcttagcacttagagaattacatttagaaaaaaaaaatcatgttgctcgcgcttactcctatcaagctataaaacttcattcacaaaagtgtggtgtaaagcctcaacaaaccaaccatagtcttcatctccaacactgccatattgtggttaagagatgtcaaatgccaagcatctactcgtagaaacttcatccatcgtggaacatggaatttttttaaaacgaatagcacaagacaaatatgcatgcatattgtttctttgaatagagcaataaaaattacaagactaaaaccttgaaaggctaagggccccctttgaatcaaaggatttatataggaatttcataggatataactcctataggaaattttcatgtttggccctttgatttaaaggatcgaaactttctaaatcctatgaaattcctatggaatggcacattgcatgtggattttggaggaaatgtagcaagagctctaatgtagacccccgatttttggaaatcggaaatcttctgtgtttatccgtaccaatccctggatcagtagttggtacacacatacatagttggatcacaacatatcacgaatgaattcaagctaaaagagttaaatacttacattagggccaggtaggccaacaactatcagagaacaacagcggagacaaaaaaataatataagggcccggttaacatgccacaggcagtcgactggggaacaagacctagaacaagaccgcactccgatcatcttgttggttacgcaagcgtaccgacaagggcttctcttcaacactctcctaaaagatatataaatagcaagggtgagtaccaacagtactcagcaagccaccacaacaacaatgcatatgatagagggtatttcaaggaatggcctcaggttcttttgcataaagctagttttacaattcttttcacaagcttaatacctagcatagactgatcaagttttattaccagtgttcacattaaacaacgacggttctatccagcatccattgtgatcccaatgatagcttcccgccattgagtcgtcatggttttctgagaacgtccaccttccctcctcttaggaagtggctccatcagcataaaatcatcatgcaataacccatcctacacaagttaagaatttagagtctagccaagtgtaatacacgtcccggtgctcaataaccgcgagcacggctactcgaatagatttggtttactcacactgcagtggatgtacactttacccgcactccgcgacttcccaacacatgagcctcgtcccaacacatgagatgtgtcacggcaaaacttttcgacaacctcgcattggcagtacccgctccatgaactttacatcctcatgcactctaggcgtacacggtttctagcagtgagaggagttctggcgcacccgggaaggaaagactcacacatgcattaagttataattatgtttaaattctcacatggcagtcctactgatggtgacaccactgtagacacccgcctcgcggttctaccaatggctgccccaccgtagagcccctgcctcacacatcaagaaaccactatgcatggatactgcctccgctcagctatttattctgctaggtctatacccatacgaaaagtgcggttgtacgggggtcgtttcaagcttaacttcatggctcggtccttaattgaccggggacggtgctagcattttccagataccacccaaatcctccgtccgccccagccgaaaacagttgtttaattttatttctccttccacaaatcatgtcatcaacatcagggcaatgtggcgctcatgtctccacatgccgcatctcaattaccttcccaaaggtaattgcccaagcatataacatttgataaatatgagtatgcatgattctaaaatagcatttctaagcaattgtcataattgactagggactcatacgtaaacatggttacgaaggaataagggggtaaacaataatcaaggcatggcataatcgcaagtaggatgtttatcattgcatgcaatttttatttgtaaacaaaataattttgcaattggtatcaacatgttcaaggaatagtaatgacttgtctgctcaggatagtccttattcttgatataattcttgatcaaccttcacttcctggaggctgcagacgttgcctcacgactaactgatacacaatttctataataagcgagaaaaaccaatattcaaacaacaatcaaatgtgcacaacaaaatgttatattcgtgtttgctaatggattccaatcatgctaagggctaaagtttcttaatctttctattgtcatcatggtctatttaggagttaaccaacatagcatttattggatacatatatatatttggctaatcggtggtttagtctatcaaatagctatcgaaggattatggctatatatgcatatatctaaataggacggttatatattagaggttctgttgttagatggatttaggatcaatcaaataatgaatcatttgtattattatttagttgatggaggctttactttaattatgaacatattttacttgtcacaataaattataaaaggttaataattatccatgctttgtatgttaaagttgtttaggttaatcatattatagttacagattatcccatcacataattttacaatgaataatcctaatctacaattgaacttgtgttatattaggtcaagggttataattagtatttatccaccatacatgtttgtcatatatcctctttaatttaatatatgcaatcaagcgatctaatactacaacgtatagctataatggactgtacagtatatgtgagtgcacaatatcttaatatttgaataatttatttaaatagctgctatttactttaagctatatagtacatgtgattttaagtggatttatgagtgagttactgtctaacaacttaagggtcgatttccaacctaaacatatactactgtatagggaatgtcgttaattaatttcatattggtgatttaatcatacaagctctgctattatttctcataaacaatttaaagactcatctacatgtgttcaacttttactcacaaagtatgaggctatacaatttggacgtcatgagtataattatatattgacatatattaataaatggcactagtatttcctatgctttaattaatttgaaacaatgctcctaactagtttacataggttttatagtgaggaagcgtgttaaggacaattatttgacatctactttacggtacaatatcaattttatttattagcacatttttaagttaactattatgcatcatcttgatattaattatttaatatttataaatatattttatcaaatagtgaattatataccattggaaagcttatgaatttatatgaatttaggttcaagtttcactcaaatccaagttaaaatgagagagttatgctagtttaaatattcaaatttgaataattgcgaaacagtactgttcctaactcatttatttttattccataatttacattgactaacctgtgggaccggcctgccatggacacaacatatataagtgaattttcatagattttaatcatagggaccccacatgtaagggacttaactaataaagatcaaggggaggattactatttactaatcacgtggggcccactctaacctctctcctccattctcttttctctctctctctcttctctgttttctctcttctctccctctctcacggcgcggcgcggctaccagcgacgaagggaggagggagggcttaccggaccggcggcgacggcggtggagacacggcggcgaggtgcggcgcggcggcggcgaggcgccggggcacggcggcggcgaggccccggggcacggcaacggcgtcgtggggctcggggcacggcagcggcggcgcggcggcggaatgcggcgtcggtggaggggaagaaaaggggaaaaaaaagaagaagaagaggggaaatggcatgg

(The sequence listing continues in the following parts.)

We claim:

1. A substantially purified nucleic acid molecule comprising a nucleic acid sequence that shares between 100% and 90% sequence identity with SEQ ID NO: 60151, wherein said nucleic acid molecule encodes a serine/threonine protein kinase or fragment thereof.

2. A substantially purified nucleic acid molecule comprising a nucleic acid sequence that shares between 100% and 90% sequence identity with the nucleic acid sequence of SEQ ID NO: 60151 or the complete complement thereof.

3. The substantially purified nucleic acid molecule according to claim 2, wherein said nucleic acid molecule comprises a microsatellite sequence.

4. The substantially purified nucleic acid molecule according to claim 3, wherein said nucleic acid molecule comprises a region having a single nucleotide polymorphism.

5. The substantially purified nucleic acid molecule of claim 2, wherein said nucleic acid sequence shares between 100% and 95% sequence identity with the nucleic acid sequence of SEQ ID NO: 60151 or the complete complement thereof.

6. The substantially purified nucleic acid molecule of claim 5, wherein said nucleic acid sequence shares between 100% and 98% sequence identity with the nucleic acid sequence of SEQ ID NO: 60151 or the complete complement thereof.

7. The substantially purified nucleic acid molecule of claim 6, wherein said nucleic acid sequence shares between 100% and 99% sequence identity with the nucleic acid sequence of SEQ ID NO: 60151 or the complete complement thereof.

8. The substantially purified nucleic acid molecule of claim 7, wherein said nucleic acid sequence shares 100% sequence identity with the nucleic acid sequence of SEQ ID NO: 60151 or the complete complement thereof.

9. A substantially purified nucleic acid molecule comprising a fragment of about 100 to about 200 nucleotide residues of SEQ ID NO: 60151, wherein said nucleic acid molecule encodes a serine/threonine protein kinase.

10. The substantially purified nucleic acid molecule of claim 9, wherein said nucleic acid molecule comprises bases 1679 to 3133 of SEQ ID NO: 60151.

11. A substantially purified nucleic acid molecule comprising a nucleic acid sequence, wherein said nucleic acid sequence comprises bases 1824 to 3096 of SEQ ID NO: 60151.

12. A transformed plant comprising a nucleic acid molecule, wherein the nucleic acid molecule comprises a sequence that shares between 100% and 90% sequence identity with the nucleic acid sequence of SEQ ID NO: 60151 or the complete complement thereof.

13. The transformed plant of claim 12, wherein said plant is an *Orzya sativa* plant.

14. The transformed plant of claim 12, wherein the nucleic acid molecule comprises a fragment of about 100 to about 200 nucleotide residues of SEQ ID NO: 60151, and wherein said nucleic acid molecule encodes a serine/threonine protein kinase.

15. The transformed plant of claim 12, wherein the nucleic acid molecule comprises bases 1679 to 3133 of SEQ ID NO: 60151.

16. The transformed plant of claim 12, wherein the nucleic acid molecule comprises bases 1824 to 3096 of SEQ ID NO: 60151.

17. A transformed seed comprising a nucleic acid molecule, wherein the nucleic acid molecule comprises a sequence that shares between 100% and 90% sequence identity with the nucleic acid sequence of SEQ ID NO: 60151 or the complete complement thereof.

18. The transformed seed of claim 17, wherein the nucleic acid molecule comprises a fragment of about 100 to about 200 nucleotide residues of SEQ ID NO: 60151, and wherein said nucleic acid molecule encodes a serine/threonine protein kinase.

19. The transformed seed of claim 17, wherein the nucleic acid molecule comprises bases 1679 to 3133 of SEQ ID NO: 60151.

20. The transformed seed of claim 17, wherein the nucleic acid molecule comprises bases 1824 to 3096 of SEQ ID NO: 60151.

* * * * *